United States Patent 10,167,482 (GENES AND USES FOR PLANT ENHANCEMENT) - sequence listing, part 5

SEQ ID NO: 16663 - protein, 363 aa, Bacillus subtilis subsp. subtilis str. 168
MAELNKTKVRKELRTERPSIYSFELDEIKQWLTDNGEKPFRAAQIFEWLYEKRVSSFEDMTNLSKDLREKLNTRFVLTTLKTAVKQTSQDGTMKFLFELHDGYTIETVLMRHEYGNSVCVTTQVGCRIGCTFCASTLGGLKRNLEAGEIVAQVVKVQKALDETDERVSSVVIMGIGEPFDNFNEMLAFLKIINHDKGLNIGARHITVSTSGIIPKIYEFADQQMQINFAISLHAPNTEIRSRLMPINRAYKLPDLMEAVKYYINKTGRRISFEYGLFGGVNDQVEHAEELADLLEGVKCHVNLIPVNYVPERDYVRTPRDQIFAFEKTLKSRGVNVTIRREQGHDIDAACGQLRAKERQDETR

SEQ ID NO: 16664 - protein, 455 aa, Salmonella enterica subsp. enterica serovar Typhi str. CT18
MSFDSLGLNPDILRAIAEQGYREPTPIQQQAIPAVLEGRDLMASAQTGTGKTAGFTLPLLQHLITHQPHAKGRRPVRALILTPTRELAAQIGENVRDYSKYLNIRSLVVFGGVSINPQMMKLRGGVDVLVATPGRLLDLEHQNAVKLDQIEILVLDEADRMLDMGFIHDIRRVLAKLPAKRQNLLFSATFSDDIKALAEKLLRNPLEIEVARRNTASEQVTQHVHFVDKKRKRELLSQMIGQGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRITTPGYEPDPSIKAEPIQNGRQQRGGGGGGRGRGQNQGGAGRSQQPRRQDSGAAKAKPKPRTGEGKPAGDKARPPRRPRRITPAQ

SEQ ID NO: 16665 - protein, 134 aa, Burkholderia xenovorans LB400
MADSQHGSHLPRTENPATLSKPGGHYSHVAIANGFVFVSGQLPITPQGGKLSEASFEVQAEQVLANVQAALESAGSSVAQLVQVRVYIVDVEHWMSFNQIYARWAGEARPARAVVPVPQLHYGFRIEVEATALV

SEQ ID NO: 16666 - protein, 427 aa, Burkholderia xenovorans LB400
MSKNETLFERAQRTIPGGVNSPVRAFRSVGGTPRFIERAQGAYFWDADGQRYIDYIGSWGPMILGHVHPEVLEAVQRVLGNGFSFGAPTESEVEIAEEICKLVPSIEQVRMVSSGTEATMSALRLARGFTNRTRIVKFEGCYHGHADSLLVKAGSGLLTFGNPTSAGVPADIAKHTTVLEYNNVAELEEAFKAFGNEIASVIVEPVAGNMNLVRATPEFLQALRRLCSEYGSVLIFDEVMCGFRVALGGAQEVYGITPDLTCLGKVIGGGMPAAAFGGRRDIMAHLAPLGGVYQAGTLSGNPIAVAAGLKTLQLIQAPGFYDTLAARTTRLAQGLANVAREARVPFAADSLGGMFGLYFTESIPTSFAEVTQSDVPRFNAFFHKMLDAGVYFAPSAYEAGFVSIVHDDAIIDATIDAARGAFASLAA

SEQ ID NO: 16667 - protein, 343 aa, Brassica napus
  misc_feature (13)..(13): Xaa can be any naturally occurring amino acid
  unsure (1)..(343): unsure at all Xaa locations
VDPRVRWTLMSFXKLGFSEHEILESLDEENVVGGGASGKVYKVVLTNGETVAVKRIWTGSVKETEDTDPEKGDRPGVQDEAFEAEVETLGKIRHKNIVKLWCCCTTRDCKLLVYEYMPNGSLGDLLHSSKGGTLGWETRFKIILDAAVGLSYLHHDCVPAIVHRDVKSNNILIDGHYGAKVADFGVAKVVDLTGKAPKSMSVIAGSCGYIAPEYAYTLRVNEKSDIYSFGVVILEIVTRKRPVDPELGEKDLVKWICSTLDQKGVEHVIDPKLDSCYKEQISKILNVGLLCTSPLPINRPSMRRVVKMLQEIGGGDEESLNKTRSGKLTPYYYEETSDQGSVA

SEQ ID NO: 16668 - protein, 202 aa, Glycine max
MGSSGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKIFEGEGFKYIKECFENGTLHLIGLLSDGGVHSRLDQLQLLLKGVSERGVKRVRVHILTDGRDVLDGSSVGFVETLENDLANLRAKGVDARIAS

SEQ ID NO: 16669 - protein, 84 aa, Triticum aestivum
  misc_feature (40)..(40): Xaa can be any naturally occurring amino acid
  unsure (1)..(84): unsure at all Xaa locations
TYHYYRPAQNNWDLGAPAVSAYCATWDASKPLSWRSKYGXIVDQCANGGLDLDWDTVFTKIDTNGIGYQQGHLNVNYQFVDCRD

SEQ ID NO: 16670 - protein, 362 aa, Arabidopsis thaliana
MATVTDLPDDLVREIFSRVPLTSLRAVRSTCKKWNAISKYDILGKKAAAKNQFLEFMVTDSRVCSLRLDLQGIRSEEDLIDLSIKQISIPNKVDQVEISQVYHCDGLLLCIAKDNSSVMVWNPYLGQTKLIQPRKKLHRYDKFALGYDNNRNHKILRFLYEGSPRNVIIDVYDFSSDSWRVLDIDIDWHELFSHNSVSLKGNTYFFGRKGPRLPMLFKPPSRRFEYLTLSCVRNEKLAVLYSHLNRFGTIEICISTKIDPSAVSWTTFLRIDMTLINGLPDNFFVHSYATSFFFDEEKKVAVLFGTNRYRGRETCQYYQRACIVGDSGYFKAVNIELVFNSQLQSCQLVSSSYVPSLVQLQD

SEQ ID NO: 16671 - protein, 900 aa, Glycine max
MAEEEEDDESFGDFTFASFPSQPTSNDTNPVDDDDDWGDFMNHSNQINGKPFDAFGVPTDPTNKHVNDNNGVAVQAEAAKKPKGAIPLSIFGEEEEEEEEQQEKPASANVFSNGGGGAVKRGSDSNGSVGISDLISSLYNQQRPQVDSHNNGSVSVSNVDAPNSTNSNGSKLNSDEVDEDDDGWEFKSAEWETGTKSQDVKAETPKHDSGALDVGTVLDSSNGISDKAGGWHMEFEFSPRFASQDHINPQPSPKNESNDIGTGFAMFNQNFGEFSSGSGPGPNQNLEAPKKAGICATNMELLKFNGATPHGTIDSSLTSESHQSDEWNFGFNFNSSYVGEDNHSSDSYFKTKNNQDDNNRNNASPTNIDVDSHVNFFDSESDVTQHEKPLTSPENRREALPLSIFGDETPDTDEHPVSQDLSPYTPSSPIRNSFTSPGSNFSINDIWNLYNQAENQSSSNVTPKASENQIHAPPEVSGSSLVTGNDDLDDDFWDYKDAATETRFTNESAQKTSSPQVNENGLQSSPTFLNSDLTNGDDDFEDDSWEFKEATSGTINQDHTSTLDHRGLPQLSTKLEQVDYAEFYSKVKDELCNYVLFHLQNLKKTQNVAALSGEDAKAKALQEEISEFSKILHQDTMSIPNEYLSEDYCPRNVRFNELLEVLKEPKFQPVESEYQLASRLSMAEKDIKYGMELLKDTVSTLRILKLGSREEQSSYLTIWSKIAFVCSQELKHGAYVWKQAVLQNVHDQILSSQKGVQYILALGEIYRVAEIIEASAKLHKPWMLSGAIDHKSLCALLNECYSIWLASGLEEALLSIANQNNFELDGISRELVESIKYIHELDEHALQSFVISGEQTTCQLSALPAGFIPGLNLVKWNGKHYIVKLANLWINLISSDPPKK

SEQ ID NO: 16672 - protein, 487 aa, Methanocaldococcus jannaschii
MWWILMESIKKVMVFGSGPIVIGQAAEFDFSGSQACKALKEEGIYTILVNSNPATIQTDTDMADKVYLEPLHPTIVEKIIEKERPDAILPTMGGQTGLNLALELHRRGILDKYGIKLLGSNIRTIEIAEDRELFAEAMAEINEPVTKCKAVNSVDEAVEFAEEIGYPVIVRPAFTLGGTGGGIAHNKEELIDITSKGLKYSIINQVLIDESVLGWKEFELEVMRDRKDTCIIVCGMENIDPMGIHTGESIVVSPIQTLPDEFYQKLRNAAIKIIRHLGIEGGCNIQFAVNKEMTEYRVIEVNPRVSRSSALASKATGYPIARIAAKIAIGKTLDEILNDVTKETPASFEPTLDYVVVKIPRWPFDKFKTVDKKLGTSMKSTGEVMAIGRSFEEALQKAIRSLDIGRFGIIGDGKDKDYTDEEIEEILKNPTDERIFVIAKALEKGWSVEKIVELTDIDEFFIKKIKNIVDMKKELEKLKEEIKKLNA

SEQ ID NO: 16673 - protein, 394 aa, Staphylococcus epidermidis ATCC 12228
MKLSLNSSSKFLRAPSIRQFSNRIKAIDDCVNLTIGQPDFPMPDVVKNAYIKAIKNDKTSYSHNKGLFETREAISQYFKRKYNFLYSEEEIIVTNGASEALDTSLRSIIEPGDDILIPGPIYAGYIPLVETLGGNPVYIDTTQSDFKVTPELIESHLTHKTKAILLNYPTNPTGVILERSEVKNIVDTLVNKHIFIISDEIYAENTFKEQHTSFAEFPEIRDQLLLIGGLSKSHSATGIRIGFLLGPEYLIEKLTFMHAYNCICANVPAQIACTTALNEGINAPLYMNRDYIERRNYLKEKLESLGFELTAQPEGAFYIFPSIKRFTENDFEFCVDVLEKAHLAMVPGSSFTDIGKGYIRISYAYDMETLKKGMHRLENYLQQHYPEQMTTPTK

SEQ ID NO: 16674 - protein, 131 aa, Sulfitobacter sp. EE-36
MMQKQTEGTAMDFDTSTLKFNEAGLIPAIAQDATTGEVLMMAWMNAQAVTQTLETGRVTYWSRSRQSFWIKGDTSGHVQELVELRIDCDRDCLLVKVHQTGAACHTGRRSCFYTLVEDGAERITLDVMDDE

SEQ ID NO: 16675 - protein, 1061 aa, Coprinopsis cinerea okayama7#130
MKSILIALAALIQLATATPYSRQPSAHPFTFIPHGGGGGDHPAEPGSSTFWEKVFVSVALVLIGGVFAGLTLGLMGLDELHLRVLSASSDDPKEKKNAQKVLKLLEKGRHWVLIVLLLGNVIVNSTLPLFLDSALGGGLAAVVVSTFAIVIFGQKLTFNRVIPQAICVRYGLSIGAACAPLVLAMMYIFAPIAWPLAKLLDWALGKHDHHTYKKAELKSFLQFHRTGEEPLRDDEIAILNGVLELNTKKVEQIMTPMKDTVILSADTVLDHSAVDAILTSGYSRFPVHEPGNPLAFMGTLLIKKLLTYDPAKALPVSSFPLTILPEAHPTINCFQALDYFQTGRAHLLLISRTPGQAGGAIGVITLEDIIEEIISEEIVDETDRYEDNRSKRQARRVTTASIMRGIVERERRRGESSERSALLGGGINIGSQTNSLEVRGYGSIPEGISQSPTAHEDEDLQRTPKNSHIKFTYKNYTVAALDAGLVNFAKERSWTSPMTLEDWSLSVAGLACATSCIGKSNKNKRNREATVGRLIEVFDYIEDSLEALVRSAVDPVIFAAALDMEAILTLVATNISNMINLDPRLEAHVFSSPILTNIVLRMWTMRKPDNEGEVYLNYSPDPDGVDILDLVANYLSRQDGVNTITLALLSSRVKLREFANAFVARLVQLAQNPPPSTADAISGRSRHFSRLYTIASALAKDLTIYGALRRAGFLQCWAQSLSILLANPRPRDFNALVLISHAFLLAWDSKGDAVSAVRDVLEGGIIDPLAKALSVVRLGGDLEKINTAKLLIVKLAEYSFCPRTLSVMDMQMLKVGKTVHQQIEEKKEVGERWEALVSTLEWRNMIRRLTSKMKLNICDNAMHPHDFEDRAYLKDGHVPFKGCSDCHMVIYCSKKCQLEDWRNRHRDECSDMRRAYIDSKNSKRRYHQSTRDYHVKFTEWMFNKSQMSIDISLMEKGLQNTQVVTISDSSRGLNIRSLDHRTWHEYYSYRLPSLCPAIDKRADDMIEEFKRNGTETSYLMDTAFTNGPEEAVSVLVRLERYYDKLTKGPRWTAIQSVARVV

SEQ ID NO: 16676 - protein, 272 aa, Triticum aestivum
  misc_feature (66)..(66): Xaa can be any naturally occurring amino acid
  unsure (1)..(272): unsure at all Xaa locations
MAARSRARRLLPLLTFVALGMVLGSLLQLAFFRRLDDHSHTGHFDNDQEAADLRLGYVKPEVISWXPRIIVFHNFLSSEECDYLREIARPRLEISTVVDVATGKGVKSDVRTSSGMFVNSEERKFPVIKAIEKRISVFSQIPVENGELIQVLRYEPSQYYRPHHDYFSDTMVHLQFNPQRGGQRVATMLMYLTDGVEGGETHFPQAGDGGECSCGGRMVRGLCVKPNKGDAVLFWSMGFDGNTDSNSLHSGCAVVKGEKWSATKWMRQKMTF

SEQ ID NO: 16677 - protein, 822 aa, Burkholderia vietnamiensis G4
MAGLAPTFGRGAMTNHWVDIKNADVILVMGGNAAEAHPCGFKWVTEAKAHRKARLIVVDPRFTRTASVADYYAPIRTGTDIVFLGGVINYLLTNDKIQHEYVKNYTDFSFIVREDFAFNDGIYSGYDAEKHAYPDKSSWDYERGDDGFVKVDPTLQHPRCVYNLLKQHYGRYTAELVQQVCGTPKEKFLKVCEMLATTAVPGRAGTVLYALGWTHHSIGAQIIRTGAMVQLLLGNIGIAGGGMNALRGHSNIQGLTDLGLMSNLLPGYMTLPMQAEQDFDGYIKKRAQQPLRPNQLSYWKNYKAFHVSFMKSWWGDAASADNNWAYDYLPKLDKQYDLLQAIELMSAGKMNGYICQGFNPLAAAPSKAKTAAGLARLKWLVVMDPLATETSEFWKPHGDFNDVDASKIQTEVFRLPTTCFAEENGSLVSSSRVLQWHWKGAEPPGEARSDLEIMSGLFLRMRKMYQAEGGKYPDPIVNLTWPYANPESPTPEELAMEFNGRALADLPDPKDPTKTLVKKGEQLAAFAQLKDDGTTASGCWIFCGAWTQAGNQMARRDNADPTGIGQTLNWAWAWPANRRILYNRASCDVSGKPFDPTRKLIGWNGSAWKGADVPDFKADEPPENGMGPFIMNPEGVARFFARAAMNEGPFPEHYEPFETPLAANPLHPDNPQALNNPAARVFADDRASFGKVSEFPHVATTYRLTEHFHYWTKHARLNAIIQPEQFVEIGEDLAKEVGVAHGDRVKVSSKRGYIVAVALVTKRIKPLTIDGKKVQTVGVPLHWGFKGVAKPGYLANTLTPSVGDGNSYTPEFKSFLVKVEKA

SEQ ID NO: 16678 - protein, 350 aa, Coprinopsis cinerea okayama7#130
MIRYRLTLGLMGLDELHLRVLAASSEDVNEKQNAQKVLNLMQGRRHWVLVVLLLSNVVVNESLPIFLDNALGGGVSAIILSTAAIVIFGIIPQAVSVRYGLAIGATCAPLVSAMMLVMAPITYPVARLLDWALGAGERHTYRKAELKSLLQFHKTGEEPLRDDEINILSGVLELGSKNIETLMTPLQDTFVLSSDDILDQKAVNAIMNSGYSRFPVHLPGRPKAFIGLLLVKKVLHIALLTYDPKQALPVCAFPLSILPEAHPSINCFQALDYFQTGRAHLLLVSLTPGHEGGALGVVTLEDIIEEMITEEIVDETDRYSDNQSKVIAPRAATELIMNNINPVNVGASTM

SEQ ID NO: 16679 - protein, 1453 aa, Ustilago maydis 521
MAAVGPTALGNASGADSYIASQQTVHRDETLPHTAAQSETNSAEASSDHHVDVGSAERQFNELSRQLSSKYAKDSDVEKHQPFDLRNWLSGTLEQADQMGNKRKSLGVSWSDLRVIGTASRDFNVPTIPSMALFEIIGPIFSILKLFGIDPAKSKTRDLLQAFDGCAKPGEMVLVIGRPNSGCSTFLKTIANKRNGFIDTKGQVLYGGIGADEMAKRYLGEVVYSEEDDQHHATLTVARTIDFALRLKAHAKMLPDHTKKTYRKMIRDTFLKMVNIEHTKHTLVGSATVRGVSGGERKRVSILEGLASGASVFSWDNSTRGLDASTALDYVKSMRVLTDLLEATMFVSLYQASEGIWEQFDKVLVIDQGRCVYFGPRTEARQYFIDLGFADRPRQTSADYITGCTDKYERIFQDGRDESNVPSTPEALEAAYRASRFYTQAIQEREAFNQIATADAKATHDFRQAVVDAKHRGVRTKSQYTVSYFAQVQALWLRQMQMILGDKFDIFMSYVTAIVVALLSGGIFFNLPTTSAGVFTRGGCLFILLLFNSLSAFAELPTQMMGRPILARQTSFAFYRPSALTLAQLLADLPFGVPRATLFVIILYFMAGLDRSASAFFTAWFIVLIAYYAFRALFSFFGAITTNFYSAARLAAIVMSMLVLWAGYVIPQAAMRRWLFWISYINPVFYAFEALMINEFKRITFTCEGAQIIPSGPGYPTQLTANQICTLAGATPGSDQIAGIAYLTASFGYQESHLWRNVGILIAFLVGFVAITALVVEKMDQGAFASALVVKKPPSKQEKELNQKLQDRRSGATEKTEAKLEVYGQAFTWSNLEYTVPVQGGQRKLLDKVFGYVKPGQMTALMGSSGAGKTTLLDVLADRKTTGVIGGERLIEGKPINVSFQRQCGYAEQQDIHEPMCSVREALRFSAYLRQSHDIAQADKDQYVEDIIELLEMHDIADAIIGYPGFGLGVGDRKRVTIGVELAAKPSMLLFLDEPTSGLDGQSAFTICRLLRKLADNGQTILCTIHQPSALLFETFDRLLLLERGGKTVYSGPIGKDGRHVIEYFAARGAQCPPGVNPAEYMLDAIGAGSQPRVGERDWADWYLESDYHQDNLRMIEQINRDGAAKPKSEERQSEYAAPWLYQFKVVLRRTMLSTWRQPSYQYTRFFQHLAFALLTGLLFLQLGNNVAALQYRLFVIFMLAIIPAIIMAQIMPFWIMSRSIWIREETSKTFAGTVFAATQLISEVPYALVCGTVFFVLIYYLTGFNTDSNRAAYFWVMTFLLEMFAISIGTMIASFSKSAYFASLFVPFLTIVLNLTCGILSPPQSMSSSLYSKFLYNVNPIRFTISPLIANELYGLDVHCAANEYSHFNPPANQTCQQWAGMYIARIGGYLANPQATSDCMYCTYLNGQQFYTPFGISFSERARDAGILIGFIAFNCIATIVFTKLFRFSNR

SEQ ID NO: 16680 - protein, 196 aa, Burkholderia vietnamiensis G4
MLQMSRRQFLKVTATSLAGSSLALLGFSPTQALAEVRQYKLARTVETRNTCPYCSVGCGILMYGLGDGAKNAQSSIIHIEGDPDHPVNRGTLCPKGASLIDFIHSPNRLTRPEYRAPGSDTWQPISWSDALDRIAKLMKADRDANFVETTDDGARVNRWLTTGMLAASAGSNEVGYLTHKAVRSLGMLVFDNQARV

SEQ ID NO: 16681 - protein, 436 aa, Ostreococcus tauri
MVVKEATTETATTNGETFAAPRAPSPATAVKPKTRSRSVSSLRPALKLEVESGPSRGATMIASLGVDEFSFGRGQKNRFVVEGAEVSTVHAEVRWDGSSWMMRDMGSLNGTRLNGATISVESRVPGPWEKISHGDVIKLGERSGSPHVSVHFFRDESITKDSALHLHHVVRADGSKGPKSEDRVLVECPLRGNPAVGVFAVFDGHGGHMASERARTLFPEVLARRLAGKVPGPEGVRTLLEEAFIESDETMAVEYEGCTASVVLVWRDTKTGGLMLQAANVGDSSVAIGSAPAPSGKTHDAHYLTPEHKVRHAEEKDRLNKAGAELPPEATRLYGLALSRALGDKFLKDQNVGLIAHPFVTEVIHIEPESREKVLTIASDGIWDVINPAEVYDVLQEGDSCAHTALQRLVASARRRRSVDDISIIMVRLADRPFDD

SEQ ID NO: 16682 - protein, 491 aa, Oryza sativa (japonica cultivar-group)
MAVTIQSVKARQIFDSRGNPTVEVDVGLSDGSFARGAVPSGASTGIYEALELRDGGSDYLGKGVLKAVSNVNTIIGPALIGKAVSNVNTIIGPALIGKDPTEQVDIDNFMVQQLDGTSNNWGWCKQKLGANAILAVSLAVCKAGAMVKKIPLYQKLQHIANLAGNKTLVLPVPAFNVINGGSHAGNKLAMQVKYCLNNKTMSMHDSVIFSAHLAAVQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 16683 - protein, 265 aa, Oryza sativa (japonica cultivar-group)
MAAGPRGRLLLVALVSAAAVVAGALLPGCAAAAAAGEKVPLALYYETLCPYCSRFIVNHLAGIFEDGIVDAVDLRLVPYGNAHVVGANNTISCQHGSEECFLNTVEACAIDAWPDLRVHFRFIYCVEDLVVNHKQREWESCFGKLNLDPKPVTDCYKGERGHQLSLKYGRQTDALQPPHKYVPWVVVDGQPLYEDYENFEAYICKAYKGHPPKVCEGLARPPTPTVLEVAEAVNRVSYYDSGDIRLKPDEDGHAKIKKVVPDDDD

SEQ ID NO: 16684 - protein, 735 aa, Chlamydomonas reinhardtii
MAATYSLATSPLTRSTPIPFSTKRVPSGRSSGALPVPGSQARLSGAGAVALDGLEGGRDDWHQRYSLSTSGRRRSVASGSPSNTGSSEAKNVVMASNNVTVGFSVGASSSAFSDASSFSFPARSAPAGPVARPPRTGVSLLSRALSTGEKEQDLLAHLPPVLPSTDAADPLLFFPGIPLELLREAQAEFPIFNNELLVHAYGLAARAHQNQQRKNGESLLSHCVAVAKTVAGLGLDAETVAAALLHECVDMVSRSQLEEFMPPSVVSVLEHVNTISEMSRLYRQHSATGSFSDETFQRLLVGFEDVKAVIVKLSDRLAELRTISVLPADRQAALARETLEVYSVVANRLGVWCLKAELEDLAFSVLHPQEYNWLKEAVRTRQDPVALETAINSIKGALQAQGVAYEDISGRPKNLYGIFMKLQKDGKPLTIESLNSLYDLMALRVVVAHKHECYTALRAVQSVYRVMPSRSKDFIKDIKKPNGYQSLHETVYGEGDVPVEVQIRTHKMHYIAEYGFAAHWKYKEQMDSEDEWLEKETQYKRWLTQYKLRVHDKKVRPQGSPPTDSSLKSLGVAYMDMPEEQQRGLLDPFLQHERFKLQVPAKTEVSVLLQTCDGIETKDFPLGTTANQLWRDLGLGAQPGYALTVNSRLPSGEAALQSGDLVQVLPLSTILSRSPPQSAPLAAVLEDWEEEQAHAAAEAAALAASANNYLEVYSRDGMTTWSMGPNAGAAVPAGM

SEQ ID NO: 16685 - protein, 525 aa, Methanosarcina barkeri str. Fusaro
MTQARRPLMLIIFDGWGYREAKEGNAVMTARTPNLDRLEKECPWCFLKASGEAVGLPKGMMGNSEVGHLTIGAGRIVNQDLTRINISIKNGDFFKNPVFLNAISNVKANASSLHLMGLASCGGIHSYMPHLHALLKLVQEKDLKKVYIHAFLDGRDEPPKAALGDIKKLDAFCKEHGNAKIATVSGRYYAMDRDKRWDRTKLAYDALTRGVAPYTAPNAETAVSNAYSRGETDEFVKPTIITEQVITEQVITEQAEKPVATVQDNDSVIFFNFRADRARQITWAFVKDDFDGFMREKRPEVYFVCMTQYDETLEVPIAFPPIKLENVLGEVLSKHGLIQLRIAETEKYAHVTYFLNGGEEKRYKDEDRCLIPSPKIATYDLKPEMSAYEITDEVIRRIQSGKYDVIVLNFANMDMVGHTGIFEAAVKAVEAVDKCIGRIVEVLKEKGGVALITADHGNAEEMIDLKTGEPHTAHTSNPVKCIYFGNSEIKALRNGKLCDVAPTILELLGIPKPQEMTGKSLLVKD

SEQ ID NO: 16686 - protein, 450 aa, Acinetobacter sp. M-1
MTKHYDYIAIGGGSGGIASVNRAAMYGKKCALIEKSEIGGTCVNVGCVPKKVMWYAAHVAESIQKYGPDYGFNTKVEVFDWQVLIKNRQAYIDRIHQSYQNSLSKNNVDLIQGAAYFIDQHTIEVNGERFTADHILIATGTQPSLPKIDGVEYGIDSNGFFELSALPKTTAVIGSGYIAVELAGVLNALGSQVGLFIRKDLPVRRFDSFLSETLVEVMQTDGITVHTQAVPLKVTKNADGSVVLHLENGERHTVDCLIWATGREPNTASLNLEKTNVQLDERGYIQVDKFQNTSQQGIYAVGDIIGKMELTPVAVAAGRRLSERLFNHKSDEHLDYDNIPTVVFSHPPIGTVGITEQEAIEKYGQKEVKVYNSSFTAMYSAITQHRQPTKMKLVCVGENEKIVGIHGIGFGMDEILQGFAVALKMGATKKDFDNTVAIHPTSAEEFVTMR

SEQ ID NO: 16687 - protein, 459 aa, Rickettsia rickettsii
MQEFDLVVIGSGPAGYTGSIRAAQLGMKVACIEKSDTLGGTCLNIGCIPSKALLNSSEKYEAALKHFENIGITADVKLDLQKMLANKDKVVLDLTKGIESLFAKNKVTRIKGEAKISSSNIVEVNKEQIKAKNILITTGSSVIEIPNIKIDEEFIVSSTGALKLSKVPENLIVVGGGYIGLELGSVWRRLGAKVTVIEYAPSIVPMLDKEIATQFMKLQQKQGIEFKLNTKVLSAEVKSGKVNLTIEEDDKSSVVTSDVVLMAVGRKAYTQNLGLESVGIITDKQGSIEINDQFQTAVSNIYAVGDVVKGAMLAHKAEEEAVAAVEIMAGQAGHVNYNLIPSVIYTYPEVASVGETEEQLKEKGINYKVGKFPFLANSRARAIGSTEGMVKILADSKTDRVLGAHIIGADAGTLIAALTAYMEFGAASEDIARTCHAHPTLSEAIKEAALSVDKRTINI

SEQ ID NO: 16688 - protein, 291 aa, Saccharophagus degradans 2-40
MLRGSMVALVTPMQADGSLDWEALHKLVDWHLQEGTDAIVAVGTTGESATLDVKEHIAVIRAVVDQVNGRVPVIAGTGANSTSEAIELTQAAKDGGVDACLLVAPYYNKPTQEGLFLHHQKIAASVAIPQLLYNVPGRTAVDMLPETIVRLSHVDNIVGVKEATGDIARVGQILESAKAGFLLISGDDDTAVDFIAAGGVGEISVTANVAPKLVAQMCELAAQGKVEEARAINARLADVHTAMFLESNPIPVKWALAKMGLMPNGIRLPLTPLDAKYHLQVEQALRAANLL

SEQ ID NO: 16689 - protein, 130 aa, Aspergillus nidulans FGSC A4
MVKTSVLNDALNAINNAEKAGKRQVLIRPSSKVIIKFLSVMQKHGYIGEFEEVDDHRSGKIVIQLNGRLNKCGVINPRYPVQLGDLENWAVQLLPSRQFGFVVLTTSAGIMDHEEARRKHVAGKLLGFFY

SEQ ID NO: 16690 - protein, 181 aa, Thermoplasma acidophilum
MLRELGVDTKIVPNDIDSSELDGLDGLVLSGGAPNIDEELDKLGSVGKYIDDHNYPILGICVGAQFIALHFGASVVKAKHPEFGKTKVSVMHSENIFGGLPSEITVWENHNDEIINLPDDFTLAASSATCQVQGFYHKTRPIYATQFHPEVEHTQYGRDIFRNFIGICASYREIQKENFQH

SEQ ID NO: 16691 - protein, 338 aa, Oryza sativa (japonica cultivar-group)
MRPVSSAEEVGALLSRSDSSGRRRRSSPVQSASPRPAGCGCGGPRRQSSFRDDVGHAASETYLVTRLTFSLLQYLGLGYRWMSQLLALTIYAILLMPGFLQVGYYYFFSSQVRRSIVYGEQPRNRLDLYIPKDINRPCPVVAFVTGGAWIIGYKAWGSLLGRRLAERGIIVACIDYRNFPQGTIGDMVSDASQGISYVCNNIASYGGDPNRIYLVGQSAGAHIAACALIEQAVKESSGQSISWSVTQIKAYFGLSGGYNMHSLVDHFHERGLNRSIFFSIMEGEESLSRYSPEIVVKQSSSQTIALLPPIVLMHGTEDYSIPSSARFLLMPSADVHLR

SEQ ID NO: 16692 - protein, 679 aa, Oenococcus oeni PSU-1
MIDTQFENIPLKELNRQDEQQAVNAIRFLSLDMIQKANSGHPGLPLDAAPMAYTLFQKFLNFNNRDPYWINRDRFVLSAGHGSALLYSLLHLNGFKVGIDDLKRFRQLDSLTPGHPEWKHTPGIDATTGPLGQGLTMAVGMAMAEKHLSAIYNRPGFNIFDHETYVIVGDGDLMEGISQESMAIAGEKRLSKLIVLFDSNDVSLDGSLKLSTGEKIQDRIIGNGWDYQFVADGNNLSDIDEAIREAKKSDKPSFIEIKTIIGYGTPLQGSSKVHGAAIGEENVAKTRDFYHWPYQPFEIPKDVYDLFNDSHQAKDRYYKSWQESFQLYAEAFPRLAEQLENNDSTLNTDNLKLAENNDQELATRVSSSEVMQQIADQNRTFWGGSADLSSSNKTYLKDQGDFTDLTPQGSNVFYGVREFAMAAITNGILLHGNSRAFASTFFIFSDYMKPAIRLAALQKLASIFIFSHDSLAVGEDGPTHQPVEQLETLRTTPGIDVYRPADQNETLAAWKAIAKTTNRPTALVTSRQKLPVLRETKDAPVERGAYIVSSAKKDLPDAILIASGSELHLALEAKRELEKEGYDLSVVSMPSMEAFQRQSEEYQASVLPKQVVNRLSIEMASSLAWGRYTGIFGKNLAVDTFGKSGKANDVIDDYGFNLAHISRMVKKMIDENKNLQIVK

SEQ ID NO: 16693 - protein, 403 aa, Magnaporthe grisea 70-15
MTTATSNGSAQDKAAVGILKTPISAPLEGCTPPAKDPLTKEQEIKYDWLLEQVKKWTEVPSTKGKGGPLTDAERMWLTRECLLRYLRATKWVEKDAEKRLRETLTWRRDFDVADLTWDHISPEQETGKQVILGFDKEGRVCHYLCPGRQNTQPSHRQVEHLVFMLERVLDLLPAQREKLVLLINFKQGKNRSYTAPGIGQAREVLNILQTHYPERLGRALIVNVPWVVQGFFKLITPFIDPLTRDKLKFNEDMSNYVPKEQLWTEISGGALEFEYDHSTYWPALRKMCEERQVEKEKRWTAGGKQIGELEDYLGGKASQGITPPVAATTEVAATATATSTAPVAAPAATAAASEVAPIAVAQESAAPEKPAVEGAKKEESGAVSEKQGDKVEDLKVDELKVAE

SEQ ID NO: 16694 - protein, 228 aa, uncultured cyanobacterium
HEVAGAGQHELGMKYAELIEAADNVMIYKYIVRNVARKYGKTATFMPKPVFNDNGTGMHVHQSLFKGGQPLFFGEGTYANLSQTARWYIGGILKHAPSFLAFTNPTTNSYKRLVPGFEAPVNLVYSLGNRSAAVRIPLTGPNPKAKRLEFRPGDALANPYLAFSAMMMAGVDRIKNQIDPGDGFDEDLFELPAERLASIPTVPASLNGSLEALNADKNYLMEGGVFTE

SEQ ID NO: 16695 - protein, 196 aa, Caulobacter crescentus CB15
MARTAEVVRETKETQIRVWIDLDGTGVSTISTGIGFYDHMLESFARHGGFDLKVETKGDLHIDMHHTVEDTGIVLGQAIHKALDGFKGIRRFGSAYIPMDETLTRCAIDLSNRPYLIWKVEFKRPKVGEMDTELFKEFHHAFAMNSGACIHLETLYGDNTHHVAESGFKALARALRQAVEIDPKTGGQAPSTKGVL

SEQ ID NO: 16696 - protein, 282 aa, Ostreococcus tauri
MALVHDEVVARLRSHCARGRKPMVVGVSAPQGCGKTTLTRMIVDMVRSTPRRFIDGVSDGNVTAATVSMDDFYLTAEAQTALAESNPTNAMLQYRGNAGTHELELGTKTLDALAQINDAQSSISLPRYDKLARTGRGDRKPESEWDQVSAPIDVVLLEGWMLGFEPIEDEKARAINPDLVAVNEHLKSYKAALWGTERVAWWIIFKVQDPKWVYDWRLEAERKAGGGLSDEQVKDFVDRFIPAYDAYLPALYENPPPGSLVVVVDKYREVQMVSVVSNEHDT

SEQ ID NO: 16697 - protein, 170 aa, Photobacterium sp. SKA34
MAGQSIIVMGVCGCGKSTIGEGIAHSLNAKFIDGDDLHPRVNIQKMVSGTPLNDTDREPWLERIRDAAYSIENKNEVGIIVCSALKKKYRDQIREGNKNVSFIFLDGDRELILERMRARKGHFMRDTMLTSQLETLERPVDEMDVFTVSIDGSINEIIEDAVQQLREANL

SEQ ID NO: 16698 - protein, 485 aa, Magnetospirillum magnetotacticum MS-1
MTDLDASLLKTHAYIDGHWAEADDGRRFDVLDPATGHLLASVPDMGGAETRRAIEAAEMAWGPWRRRTAKERAAILMAWFEQIIAHKDALARLLSAEQGKPLPEAQGEIVYGAAFIQWFAEEGKRAYGDLIPTTASDRRLLVMKQPIGVVAAVTPWNFPMAMITRKCAPALAAGCPVVVKPAEDTPLSALVLAELAERAGLPRGVFNIVTTRQPGAVGGEMTANPLVRKLSFTGSTRVGKMLMAQCAETVKKVSLELGGNAPFIVFDDCDLDAAVAGALASKYRNSGQTCICTNRFLVQAGVYEEFGRKLAEKAAAMVVGHALKGPVQQGPLINAAAVAKVASHVADAVSKGARVLTGGRPHELGGGFWQPTVLADVTAQMLCFQEETFGPVAPLVRFETEEEAVELANASQFGLAGYFYSRDLARVFRVAEAMECGMVGVNESLISNEVAPFGGIKESGLGREGSKYGLDDFMETKYVCIGGLS

SEQ ID NO: 16699 - protein, 393 aa, Acinetobacter sp. M-1
MHPIVIIGSGMAGYTVAREFRKLSPEQELVMICADDAVNYAKPTLSNAFAGNKAPEQIALGDATKMATQLNMRIDADTWVKAINAENHELTLEKNGQTITQPYSKLVLAVGANPIRLAIAGDGSDDIHVVNSLVDYRIFRENLANRKDKRVVILGAGLIGCEFANDLLHSQYDVTVIDLAPQPLGRLLPNHVAEAFKTNLEQAGIKFALSTTVEKVTKINNGEDYEVTLANGKTLVADIVLSAIGLQPNISLAKAADIQTSRGIITNTLLETNQADIYAVGDCAEVNGTLLPYVMPIMQQARALAKTLSGQSTAVHYPAMPVAVKTPAAPLTVLPAPLNVDVNWETEEFDDGMLAKAADGEGTLRGFVLLGPTAGKQRLTLTKLVPDLIPAQV

SEQ ID NO: 16700 - protein, 345 aa, Ostreococcus tauri
  misc_feature (345)..(345): Xaa can be any naturally occurring amino acid
  unsure (1)..(345): unsure at all Xaa locations
MAVLNDYTKVLSAEAQRAHAREQEPSDSERVIADKTRRQALERMDAVVGEIWEGLPPNTLLLFTSGVGDAHTLRLAQEQKWKRHQSIGGWGAWTDEAEHDLRRLYDRTKHAVTLAATFNANAFRRRHRSHDALPQTVETFLQPAPLTRRTQTHSIHARALDRLPIDRALPKARRASHEPLARARIALCVSPSSLSLHRRATDRRPAERDRRESAADGEDGAKKTAEGASKRARARSVAPPWASVVMACCSHDHDCDASTCANASLHAFVDVPGVVAFNAVNDENAGRVCGPWESRHDDAREALVSDDDGELVIRIPFTADVKLRGIMVIGGGGGRAPREMRAFAX

SEQ ID NO: 16701 - protein, 390 aa, Magnetospirillum magnetotacticum MS-1
MFPDNLLAVFDRTDVIFEHGEGAWLTAADGRRFLDFGAGVAVNALGHAHPRLVAALGEQAGKLWHCSNLYRVPGQERVAQRLVDASFADTAFFCNTGAEAMELVIKIARRYHHCAGHPERNRIIACTGSFHGRTIATLAAAGTAKYLEGFGPVAQGFDHVPYGDLEAVQGAIGSNTAAILVEPVQGEGGIRPGDPAYLRGLRALADEFGLLLLMDEVQTGIGRTGKLFAHEWSGIAPDVMGLAKGLGGGFPVGAVLATEKAAACMTPGTHGCTFGGNPLAMAVAEAVLDEIMAPGFLDRVQAVAAMLRGKLDDLARRYPQAIAEVRGQGLMLGLKTVPLNTEFNAKLFAAGLLAVGAGDNVVRLVPPLIIGEAEVVRAVEIIEGVCASFS

SEQ ID NO: 16702 - protein, 485 aa, Silicibacter sp. TM1040
MTHPAQPKASHFINGEYVEDTSGTPIPVIYAATGETIATVYAATPAIVEQALTAAEAAQKEWAKMSGTERGRVLRRAADIMRERNHELSVLETYDTGKPLQETLVADATSGADALEYFGGLAGSLTGEHIQLGEDWVYTVREPLGLCVGIGAWNYPTQIACWKGAPALACGNAMVFKPSETTPLCALKVAEILMEAGAPAGLYNVIQGMGEVGGKLVTDPRVDKVSLTGSVPTGKKVYAAAAEGMKHVTMELGGKSPMIVFEDADIESAISGAINGNFYSSGQVCSNGTRVFVHKDIKEKFLARLAERTATAKLGDPMDESVNFGPMVSERQMEIVLGYIEKGKSEGARLICGGNRADMDGFFVEPTVFADVKDDMVIAREEIFGPVMCVLDFESEDEVIARANDTEFGLSAGVFTKDFTRAHRVIGQLEAGSCFINSYNDAPVEAPFGGVKASGVGRENSKEAIKHFSQVKSVYVRMGDCEAAF

SEQ ID NO: 16703 - protein, 147 aa, Nicotiana tabacum
MERVNNYKLCVALLIISMVMAMAAAQSATNVRSTYHLYNPQNINWDLRAASAFCATWDADKPLAWRQKYGWTAFCGPAGPRGQDSCGRCLRVTNTGTGTQTTVRIVDQCSNGGLDLDVNVFNQLDTNGVGYQQGHLTVNYEFVNCND

SEQ ID NO: 16704 - protein, 380 aa, Acremonium chrysogenum
MTTTYKILVLPGDHIGPEIMAEAIKVLTTIETHRPNLHFNLTTDLVGGTSIDTHGVPITQSVLDAAKASDAVLFGSIGGPEWAGVHPTPESGLLQLRQHLDAFANLRPCEFLVPSLVGASPIREHVVKGTRFIVVRENCGGAYFGEKKEEEDVASDLWVYTRPEIERLARVSAAVARIMGRSEDDNQAATVWSADKANVLASGRLWRRITSDIFAKEFPDITLQHQLADSMAMLMVRDPRRFNGVIHTDNTFGDILSDISGAITGTLGLMPSASLCGVPGEGHRSNGIYEPVHGSAPDISGKGLANPVAQILSVAMMLRYSMGLEKEATAVERAVVKVLDAKSEGGLEIRTGDLGGRATCSQVGDAVCEVLGPLLQGKKA

SEQ ID NO: 16705 - protein, 581 aa, Coccidioides immitis RS
MLDFGLRVLPLISRLPKSPRRPWQRAPCRCTIPLLTRRGVASASSNQRKPYYVTTPIFYVNASPHVGHLYTLVLADILKRWQVLLGNNDAQLLTGTDEHGIKIQQAAASHGLEPIKLCDQNCQTFKDLAQKANVQHDHFIRTTDPEHRDAVQYFWEMLDHRGYIYTAKHEGWYSVSDETFYPSNAVHATLDPATGRKIMSTIETGKEVEWSSETNYHFRLSAFKDRLLDFYRENPTFIRPKRYMDNIVQSVSSGLTDLSISRPVQRLTWGIRVPGDDTQTIYVWLDALINYLTYAGYPFTPGKENQSIWPANVHVVFARSSQKADACPGADLDARFHCVYWPAFLMALDLPLPRQVLSHAHWTIGREKMSKSTGNVVNPMYALARFGVDPLRFYLAHDGGLSDDADYENAFVTERYKKTLQWGVGNLTSRLVRSKKWNVRRSIEWGVEGRFPPPSEADRKHQQLLEGIRNVTRSWMDDLNPRKAVESVVGIIHESENTEPTELSRVIYNTAESLRIAGILLQPFMPEKSARLLDMLGVAGDPEKRSFEAAIFGADEHYGVPLVELKKGTEATLFPPLVTEN

SEQ ID NO: 16706 - protein, 150 aa, Oryza sativa
MAARRGRGRGREWEDAGAFVGSLVGYGQGLLTNKGMKGSLSSAGSSAKTFAALSGVQSFILCLLRRLRGKDDMINAGVAGCCAGLALSFPGAPQAMFHSCVTFAAFSCIMDGLNKQQAAMAATLASKPSTIKHQEGDVLPPFTLPPLLNA

SEQ ID NO: 16707 - protein, 433 aa, Marinobacter sp. ELB17
MEKITHITAREILDSRGFPTVEVDVLLDNGVVGCGRVPSGASTGSREALEKRDLDSPRYNGKGVLQAVNAVNTRIAPALVGQMVFEQSQIDRLMCEMDGTPNKAEFGANAILAVSLGVADAAAKARKLPLFRYLAELYGCASPSVLPVPMMNIINGGAHADNNVDIQEFMIQPVGAPSYSEALRMGVETFHALKALLKEKGLSTAVGDEGGFAPNLQSSEEALELIIEAIEKAGYRPGTDIVLALDCAASEFYSDGCYDLKGAGKKYSSEEFADYLVSLAKAYPIASIEDGMDENDWAGWKLLTEKVGERVQLVGDDLFVTNTVLISEGIQKGIANSVLIKFNQIGTLTETLEAIAMAQGAGYTAVISHRSGETEDTFIADLAVATRAGQIKTGSLCRSDRVAKYNRLLWIEQELGAHAFYPGIGAIRCALDS

SEQ ID NO: 16708 - protein, 366 aa, Aspergillus nidulans FGSC A4
MPSYNIVVFGGDHCGPEVTAEAVKILRVIEKSRDDITFNLQDHLLGGCSIDATGSPLTDQALEAAKNADAVFLGAIGGPEWGTGAVRPEQGILKLRKEMGTFANLRPCNFAAPSLVESSPLRPEICRGVDFNIIRELTGGIYFGERKEDDGSGFALDTEPYSRAEIERITRLGAHLALQHNPPLPVWSLDKANVLATSRLWRKTVTEIMAKEFPQLKLEHQLIDSAAMIMVKDPRKLNGIVITSNLFGDIISDEASVIPGSLGLLPSASLSSIPDGKGKVNGIYEPIHGSAPDISGKGIVNPVAAILSVGLMMQYSFALFEEARAVATAVSNVIEAGVRTGDIGGKASTKEVGDAVAAELEKLLKK

SEQ ID NO: 16709 - protein, 528 aa, Oryza sativa
MQPTWLATMPAASSLVVGVAFTAAVAVAVAAAVARRAWRHRGLRLPPGPPGWPVVGNLLQVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLDLRVEGRDAVPTDEELVTLCAEMINGGTDTTATAIEWAMARVMDNPSIQARLHGEIMQRVGDARPVDDRDTEGMPYLKAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 16710 - protein, 268 aa, Marinobacter sp. ELB17
MRKPILIGNWKMNGSLQSNQALVSRLLPRLRPLRKVVDIAVCPPLPYLFQVRDLLGYTGITLGAQNASGFVSGAHTGESSATMLKEMGCVYVLVGHSERRSLYGETDADIAARFAAVRGLGMTPVLCVGESLQDRESGRTAEVVQAQIQAVIKKVGLAGLAEGVLAYEPVWAIGTGKTATPEQVAETHFGIRQFIAGCGEPKAKVISQALRILYGGSVKPANAVAIFSLDDVDGGLIGGASLHADDFAAIAEALGATYPEAVGESESH

SEQ ID NO: 16711 - protein, 470 aa, Saccharophagus degradans 2-40
MTDSALPSGENKSFVILISCIATIGGFLFGFDSGVINGTVDGLVTSFGVTKTAVGVHVAFMLLGCAVGAAAAGRLADLYGRRAMLIVAAILFIVSAWGSGVATGIVEFDIYRLLGGLAVGAASVMAPAYISEVAPARYRGRLTTIQQVAIISGLTAAFLSNYVLAHTAGSSLEPFWMGIATWRWMFWIEIAPAAIFFFALMVIPESPRFLVASGKKDKALTVLTKLYGAQAAPGKVAEIDSSLDHDHKPRLSDLISKVTGKVRPIVWVGIGLATFQQLVGINVIFYYGSILWQSVGFSEDHALLINVVSGAVSIGAVVLSLVLVDKIGRKPLLWIGSAGMAVTLTLTAIAFATGTLDANGDLQLSDNMGILALVAANVYVIFFNMSWGPVMWVMLGEMFPNQIRGSGLAVAGLFQWGSNWAITMSFPALLAGLGLAVTYGFYALCAFISIIFVIKYVNETNGVELEDMEG

SEQ ID NO: 16712 - protein, 358 aa, Acidithiobacillus ferrooxidans
MKKIAIFAGDGIGPEIVAAARQVLDAVDQAAHLGLRCTEGLVGGAALDASDDPLPAASLQLAMAADAVILGAVGGPRWDAYPPAKRPEQGLLRLRKGLDLYANLRPAQIFPQLLDASPLRPELVRDVDILVVRELTGDIYFGQPRGLEVIDGKRRGFNTMVYDEDEIRRIAHVAFRAAQGRRKQLCSVDKANVLETTRLWREVVTEVARDYPDVRLSHMYVDNAAMQLIRAPAQFDVLLTGNMFGDILSDEASQLTGSIGMLPSASLGEGRAMYEPIHGSAPDIAGQDKANPLATILSVAMMLRHSLNAEPWAQRVEAAVQRVLDQGLRTADIAAPGTPVIGTKAMGAAVVNALNLKD

SEQ ID NO: 16713 - protein, 228 aa, uncultured cyanobacterium
HEVAGAGQHELGMKFAQLIQAADNVMTYKYVVRNVAKKYGKTATFMPKPVFNDNGSGMHVHQSLWKEGQPLFFGEGTYANLSQTAQWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGDGEDRDLFELPAEELSKIATVPASLNGALEALNADRGFLTAGGVFSD

SEQ ID NO: 16714 - protein, 228 aa, uncultured cyanobacterium
HEVAGAGQHELGMKFAQLIEAADNVMTYKYVVRNVAKKYGKTATFMPKPVFNDNGTGMHVHQSLWKGGQPLFFGEGTYANLSQTARWYIGGILNHAPAFLAFTNPTTNSYKRLVPGFEAPVNLVYSEGNRSAAVRIPLTGPSPKAKRLEFRSGDALANPYLALSAMLMAGLDGIKNQIDPGDGEDRDLFELVAEELSKIATVPASFNGALEALNADRAFLTAGGVFTD

SEQ ID NO: 16715 - protein, 118 aa, Bacillus subtilis subsp. subtilis str. 168
MKTMQKLIEDITKEQLRTDLPAFRPGDTLRVHVKVVEGNRERIQIFEGVVIKRRGGGISETFTVRKISYGVGVERTFPVHTPKIAKIEVVRYGKVRRAKLYYLRELRGKAARIKEIRR

SEQ ID NO: 16716 - protein, 520 aa, Sulfitobacter sp. EE-36
MTDISHDRLLIIDFGSQVTQLIARRLRELNVFCEIHPFNTVDDAFLKDFAPKAVILSGGPSSVFAEGAPMPPQSVFELGVPILGICYGQQVMMHCLGGKVERGHGTAEFGRAYVTPSEARLELLEGWFLTEKEQVWMSHGDHVSAIAPGFEVYGTSPHAPFAVTGDVSRNFYAVQFHPEVHHTPNGARLYENFVRLAGFKGDWTMSAYRDEAIAAIREQVGDQKVICGLSGGVDSSVAAVLIHEAIGDQLTCVFVDHGLLRKGEAEEVVTMFRDNYNMPLIHADEQELFLGELDGVSDPETKRKIIGKLFIDVFQKHAKEVGDATFLAQGTLYPDVIESVSFSGGPSVTIKSHHNVGGLPEKMGLKLVEPLRELFKDEVRELGRELGLPPSFIGRHPFPGPGLAIRCPGEITREKLDILREADAVYIDQIRKHGLYDEIWQAFVAILPVRTVGVMGDGRTYDFACALRAVTSVDGMTADYYPFTHEFLGETATRIINEIPGINRVTYDITSKPPGTIEWE

SEQ ID NO: 16717 - protein, 228 aa, uncultured cyanobacterium
HEVAGAGQHELGMVYEELIQAADNVMTYKYVVRNVAKKYGKSATFMPKPVFNDNGTGMHVHQSLWKGELPLFFGEGTYADLSQTARWYIGGILKHAPSFLAFTNPTTNSYKRLVPGFEAPVNLVYSEGNRSAAVRIPLTGPNPKAKRLEFRSGDALANPYLAFAAMMMAGIDGIKNQIDPGDGFDGDLFELPAEQLKNIATVPASLNGALEALNADHHYLMEGGVFSK

SEQ ID NO: 16718 - protein, 228 aa, uncultured cyanobacterium
HEVAGAGQHELGMKFAQLIEAADNVMIYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVSPSLNGALEALSADRAFLTEGGVFTD

SEQ ID NO: 16719 - protein, 613 aa, Medicago truncatula
MRSSWADLAANSAAENAPTPPPSAAAAVANNAANTRPVYVPPHLRNRGPSAPAPAAPAFDNSGSRWAPPPRNDYRGGGGGRGGGGYGNRGGGGWDRREANPFADQDDSEEPVTQEEQENTGINFDAYEDIPVETSGGNVPPPVNTFAEIDLGEALNQNIRRCKYVKPTPVQRHAIPISLGGRDLMACAQTGSGKTAAFCFPIISGIMTGQPAQRPPRGVRTVCPLALVLSPTRELSMQIHEEARKFSYQTGVRVVVAYGGAPINQQLRELERGVDILVATPGRLVDLLERARVSLSMIRYLALDEADRMLDMGFEPQIRKIVEQMDMPPAGVRQTMLFSATFPKEIQRLASDFLSNYIFLAVGRVGSSTDLIDQRVEYVQESDKRSHLMDLLHAQRANGVQGKQALTLVFVETKKGADALEHWLCLNNFPATTIHGDRSQQEREAALRSFKSGNTPILVATDVAARGLDIPHVAHVVNFDLPNDIDDYVHRIGRTGRAGKKGLATAFFNENNTSMARSLQDLMQEANQEVPAWLSRFAARSSFGGGKNRRSGGGRFGGRDFRREGSFSRGGSDYHGAGNSGGGYGASGGYGGGGYGGGYAGNSAGPGVTSAWD

SEQ ID NO: 16720 - protein, 445 aa, Frankia sp. CcI3
MGAPILVDNADLAVKTLGVCRIDSPLLPLLGERPTTQHYIDESDKVLYDDTALMISSRGVALDDLPGFEPAGPRRKIYFDPSKTRVGIVTCGGLCPGLNNVIRGLVLELTSHYRVRRIFGFRNGYQGFIARYGHDVVDLTPESVANIDEDGGTILGSSRGQQDPAEIVDCLSRMNINILFVIGGDGTLRGAGQIAREAETRGEKIAVVGIPKTIDNDIPYIDQSFGFQTAFGKAAESIRVAHAEATSAPGGLGVVRLMGRHSGFIACYATLAKSNADVVLIPELPFKLEGDGGLLNYVRRRVAERGHAVVVVAEGAGQELVVGQPESTDASGNRKLHDIGPELSRRIKEYFDAEGIELNLKYIDPSYVIRSVPANPYDSVYTIRLAHAAVHAAMSGRTEMVVGRWRRRFIHIPIPLAISQRNQVDPAGDLWMSVLEATGQPPRFE

SEQ ID NO: 16721 - protein, 371 aa, Triticum aestivum
  misc_feature (283)..(283): Xaa can be any naturally occurring amino acid
  misc_feature (296)..(296): Xaa can be any naturally occurring amino acid
  unsure (1)..(371): unsure at all Xaa locations
LLEQVCTKKQARTGPEFPGYRRPTRPRCRCRRRRRAVRLHRLHRLKPRALRRLHHHGRAAVVELTNATTHRSAYKDLFHATNGFKDKHLLGAGGFGMVYKGVLPASGVEIAVKKVSHGSKQGVKEFVAEIVSIGRIKHRNLVQLLGYCRRKDELILVYDYMPNGSLDKYLYGQGDGDGLTLDWAQRLHVIKGVACGLHYLHERWEKVVVHRDVKTSNVLLDKEMNGRLGDFGLAKLYEHGTNPQTTRVVGTTGYLAPELVRTGKATPLTDAFSFGTFMLEVTXCGRRPIKQDEQGXQILVADWVLEHLHRESLVEAADPKLQHKYNSDEVCLILKIGLLCSHPSPSARPTMQQGLQYPDGELPPPKMTRST

SEQ ID NO: 16722 - protein, 107 aa, Triticum aestivum
MAKLMCLCFIILTIGVAVSADECEGDRQAMIKECAMYQKWPANPKIDPSDACCAVWQKANIPCLCAGVTKEKEKIYCMEKVGYVANFCKKPFPHGYKCGSYTFPPLA

SEQ ID NO: 16723 - protein, 394 aa, Crocosphaera watsonii WH 8501
MSLSWMPRADRLNALPPYVFARLDELKAKAREQGLDLIDLGMGNPDGMAPQPVIDGAIAALQKPQTHGYPPFEGTASFREAITAWYRRCYRVDLDPSSEALPLIGSKEGLGHLALAYINPGDVVLVPSPSYPAHFRGPLIAGADLYPLILSAEKDWLIDLNSIPENVAKAAKILYFNYPNNPTTATAPRAFFEEIIKWATHYEIMLVHDLCYAELAFDGYQPTSLLEIPGGREIGVEFHTLSKTYNMAGWRVGFVVGNGEIIQGLRTLKTNLDYGIFSAVQAAAETALNLPDSYIKTVQERYQTRRDFLIKGLGELGWNIKPSQATMYLWVPCPTNTNSTDFALDVLEKTGIVFTPGNAFGEGGEGYVRISLIADCDLLGEALNRLKQAGIYYK

SEQ ID NO: 16724 - protein, 192 aa, Clostridium difficile 630
MRIWKVERNTLETQILVELNIDGSGKAEIDTGIGFLDHMLTLMSFHGKFDLKVICKGDTYVDDHHSVEDIGIAIGEAFKNALGDKKGIRRYSNIYIPMDESLSMVAIDISNRPYLVFNAKFDTQMIGSMSTQCFKEFFRAFVNESRVTLHINLLYGENDHHKIESIFKAFARALKEGSEIVSNEIASSKGVL

SEQ ID NO: 16725 - protein, 147 aa, Nicotiana tabacum
MERVNNYKLCVALLIMSVMMAMAAAQSATNVRSTYHLYNPQNINWDLRAASAFCATWDADKPLAWRQKYGWTAFCGPAGPRGQDSCGRCLRVTNTGTGTQATVRIVDQCSNGGLDLDVNVFNQLDTNGLGYQQGHLIVNYEFVNCND

SEQ ID NO: 16726 - protein, 402 aa, Glycine max
  misc_feature (331)..(331): Xaa can be any naturally occurring amino acid
  unsure (1)..(402): unsure at all Xaa locations
MSRFRRFELIEQPPFFHSCYSFPSFVLQDSLSLDLDLLPLPSHFDAFADLVHAPSFAYRRVERHLENELRLQSLSDRVAELESRFDRVLGGDRKYTWTAEIKGAEKNGFDRKYKWVAEVAEEEDKKKKKNKKKQVKVLKDKSARWTLQLENEDAEEEEEKKKKLLKGVARNVKWTAEITGKGENSGSSRKYTFQVQSGDAEKKEKKNKGNGNGLRIVEIQEPIGHRDVVLRQAFAKRLGAVQNERGKKKDLSPQDAALLIQISFRAYLIRRSKALRALRELAIAKSKLKEIRAQFNNFSYRRHVARDAEERQRFSEKIIVLLLTADAIEGXDIMVRSAKRSMVDELEAMLDVVDPQPGGRSASLYFKRRTFDMPDGVIRKEIEEGVAQVVQMLEEAENSSEA

SEQ ID NO: 16727 - protein, 222 aa, Clostridium difficile 630
MDNKCNNVYSDEVEKFIRSIKFDDKGLVPVVVQEVVSKDVLMLAYMNKDAIKKTLKDKIACYFSRSRQELWVKGETSGNTQKVVKMSYDCDVDTILLFVEQTGVACHTGNYSCFYRDLFDDSSKMELEVQTNILKELYDLINERKNNPVEGSYTNYLFEKGIDKILKKVGEESSEVIIASKNTDKSELIYEISDLVYHTLVLMIEKGVEIDEIKKELLKRRK

SEQ ID NO: 16728 - protein, 355 aa, Burkholderia vietnamiensis G4
MKIAVLPGDGIGPEIVNEAVKVLNALDEKFELEHAPVGGAGYEASGHPLPDATLKLAKDADAILFGAVGDWKYDSLERALRPEQAILGLRKHLELFANFRPAICYPQLVDASPLKPELVAGLDILIVRELNGDIYFGQPRGVRAAPDGPFAGAREGFDTMRYSEPEVRRIAHVAFQAAQKRAKKLLSVDKSNVLETSQFWRDVMIDVSKEYADVELSHMYVDNAAMQLAKAPKQFDVIVTGNMFGDILSDEASMLTGSIGMLPSASLDKNNKGLYEPSHGSAPDIAGKGIANPLATILSAAMLLRYSLNRAEQADRIERAVKTVLEQGYRTGDIATPGCQQVGTAAMGDAVVAAL

SEQ ID NO: 16729 - protein, 247 aa, Ostreococcus tauri
  misc_feature (148)..(154): Xaa can be any naturally occurring amino acid
  unsure (1)..(247): unsure at all Xaa locations
MPTPSVVLATAGYDHTVRFWEATRGVCYRTLQYADSQVNRLEITPDKRYLAAAGNPHVRLYEVNASNPQPVTSYDGHTGNVTAVGFEPRGSWMYTGSEDGTVKIWDLRAGGYQREYESRGAVTSVVLHPNGTELMSADQNGNIRVWDXXXXXXXLDFSGLSPLWNLDGFKLERVLEGHQRWVWDCVFSVDAAYLVTASSDTTARLWDCSTGEAIRVYSGHHKAVVCCALNDSAVSDAVEAETDINSP

SEQ ID NO: 16730 - protein, 482 aa, Ostreococcus tauri
  misc_feature (124)..(130): Xaa can be any naturally occurring amino acid
  unsure (1)..(482): unsure at all Xaa locations
MTTSSSSDGFYAELTNAEGGALRYAVNGAWRASSSDATVESVNPSRANARANAFQACTRAEVDEAFAGARAAQGPWARTPLHERASLLHRAATLMRENAGGMVSALMIEVAKGAKESATEVERXXXXXXXGNDRNKICMASNVPVGVVLCIPPFNYPVNLCVSKVAPALIAGNAVVVKPPTQGCTATLHMIHCFIKAGFPPGLIQAVTGRGGEIGDYLTTHPLVNAISFTGGETGIRVAQKAGMVALQTELGGKDACIVLPDADLELAAKSIVKGGFSYSGQRCTAVKIVAVFEEVADELIGKVNERIAKLSVGLPEDDATITAVVSKSSADFIQSLVVDAESKGATLCQEWKREDNLIWPLLIDNVTHDMKICWEEPFGPVLPVVRVKNENEALELVNKSRFGLQGCVFTRDIDRAIRLSDAMQTGTVQINGPPARGPDHFPFQGVKDSGIGSQGITNSIKVMTKVKSTVINLAKPSYTIA

SEQ ID NO: 16731 - protein, 360 aa, Streptomyces avermitilis MA-4680
MTEAILLVGGRGTRLRPLTVHTPKPMVPAAGVPFLTHQLARARAAGVDHIVLATSYLAEVFEPYFGDGSALGLHLEYVTEEEPLGTGGAIRNVASRLHSGPDEPVLIFNGDILTGLDIRALVHTHETTAADVSLHLTKVTDPRAYGLVPTDETGRVTAFLEKPQTPEEIVTDQINAGAYVFRRSVIDTIPAGRPVSVERETFPGLLSAGAHLQGMVDSTYWLDLGTPAAFVRGSADLVLGRAPSPAVPGRCGDRLVLPTASVASDAKLTGGTVVGEGAFVGEGARIFGSTLLSGAVVEPGAVITDSLLGARSRVGERSILTGAVIGDGAVIGADNELRDGVRVWCDARIPAGAVRFSSDQ

SEQ ID NO: 16732 - protein, 456 aa, Brucella melitensis 16M
MVPHGSCPSGAREVTFEGWRRERGEASMSDVHRTIRVNRSGSKFRRALSFFGPGYLVAVGYMDPGNWATSLAGGSRFGYALLSVVLLSNLMAVLLQALCTRLAVATGRDLAQACRDAYPRFLAWPLWLLAELAICATDLAEVIGTAIGLNLLFGIPLEIGVILTAVDVLLVLYLQNKGFRRVEALIITLLGVIALCFLTQIIMAQPQWGEVIKGFAPTTEIVSNPDMLYIALGIIGATVMPHNLYLHSGIVQTRDYGHTTAEKREAIRYATLDSTIALTFALVINASILILAAASFHATGHTGVEDLDKAHALLNPLLGSAIAPALFAIALLCCGLNSTITATMAGQIVMEGFIDIRLKPWIRRAITRFVAIVPAAIVTILYGSQGTTELLILSQVVLSLQLPFAVIPLVIFTAQKKKMGSLAAAPWVTFLAAITAAIIVVLNLKLIYDFFTGAPI

SEQ ID NO: 16733 - protein, 327 aa, Gibberella zeae PH-1
MSFNPNNDIPDLSGKVIIVTGASSGLGKESALQLAKHNPATIFVTARTEKRGNAAIKEIQDAVPNFKGQIKFLELDLSSFASIQKGATAFLNQSDRLDILMNNAGLMATPAGLTTDGYEVQFGSNYMGPALFTKLLLPTIVRTAQQQGDARVINLSSELFKQAPKEGVLLSRVKTPLEDISSLARYGQSKLADYYHTRSLSKYYPSVKFVAIHPGVVNTGLFDDLRKRRPWLGGLIGVMGSIFLTDVHAGAKAQLWASTAKSESVRSGGFYNQKLKEYKDAVLDDEKAVEELWDWTEKEFAIIITSIQQKRKVIVEVGYAKLPLQLS

SEQ ID NO: 16734 - protein, 158 aa, Zea mays
  misc_feature (70)..(70): Xaa can be any naturally occurring amino acid
  unsure (1)..(158): unsure at all Xaa locations
MPPSVAMPAPGDAAGGGDVRMISSKEIRSHASADDLWISISGDVYDVTPWLPHHPGGDRRGGLTLAGQDXTDAFGAYHPPSGRPLLRRFFRGRLSDYAVSRGCADYRRLLGQVSSRGPSSKRPAPPPRFQLLPRGPGLLLSPGFGLRPSAGGQKARGG

SEQ ID NO: 16735 - protein, 292 aa, Solanum lycopersicum
NHDEAKARLKRIRGIEDVDEEFNDLVIASEASRKIEHPWRNLLQKKYRPHLTMAIMIPFFQQLTGINVIMFYAPVLFKTIGFGTDASLMSAVITGGINVIATIVSIYYVDKLGRRFLFLEGGIQMLFSQIAVAILIAIKFGVNGTPGELPKWYAIVVVIFICVYVAGFAWSWGPLGWLVPSEIFPLEIRSAAQSINVSVNMIFTFAVAQVFLTMLCHLKFGLFLFFAFFVVIMTVFIYFFLPETKNIPIEEMVIVWKEHWFWSKFMTEVDYPGTRNGTAVEMAKGGAGYKIV

SEQ ID NO: 16736 - protein, 97 aa, Avicennia germinans
KWKGPWRWFDENMLDCCEPLEMVKEKGISFGKVICLARCAGANVEAFRTNQSSIDDFRKYVMACSSSDDCHLISSYHRGTFNQTGTGHFSPIGGYNA

SEQ ID NO: 16737 - protein, 228 aa, uncultured cyanobacterium
HEVAGAGQHELGMKFAELIQAVDNVMTYKYVVRNVAKKYGKTATFMPKPVFNDNGTGMHVHQSLWKGGQPLFFGEGTYANLSQTARWYIGGILKHAPSFLAFTNPTTNSYKRLVPGFEAPVNLVYSEDNRSAAVRIPLTGPSPKAKRLEFRSGDALANPYLAFSAMMMAGFDGIKNQIDPGDGVDVDLFELPADELAQIATVPASLNGALEALNADKHYLMEGGVFSE

SEQ ID NO: 16738 - protein, 228 aa, uncultured cyanobacterium
HHEVATAQHELGMKFAELIQAADNVMIYKYVVRNVAKKYGKTATFMPKPIFADNGSGMHVHQSLWKAGQPLFFAPGTYANLSDTARWYIGGILKHAPSFLAFTNPTTNSYKCLVPGFEAPVNLVYSEGNRSAAVRIPLTGPSPKAKRLEFRSGDALANPYLAFSAMMMAGIDGIKNQIDPGAGVDVDLFELPADELAKIATVPASLNGALEALRADHHYLLEGGVFTK

SEQ ID NO: 16739 - protein, 513 aa, Lactococcus lactis subsp. lactis Il1403
MSDTTLEKIIVLDYGSQYNQLIARRIREIGVFSELMSHKVTAKEIREINPIGIILSGGPNSVYDEGSFDIDPEIFELGLPVLGICYGMQLLSYKLGGMVEAAGEREYGVAPLQLTGKSALFAGTPEVQDVLMSHGDRVTAIPEGFHVVGTSPNSPFAAVENTERNLYGIQFHPEVRHSVHGTEMLRNFALNICGAKGNWSMENFIDMQIKNIREKVGDKKVLLGLSGGVDSSVVGVLLQRAIGDQLTSIFVDHGFLRKGEADQVMETLGGKFGLNIIKVDAQKRFMDKLVGLSDPETKRKIIGNEFVYVFDDEANKLEGVDFLAQGTLYTDVIESGTDTAQTIKSHHNVGGLPEDMQFQLIEPLNTLFKDEVRALGTQLGMPDEIVWRQPFPGPGLAIRVLGDLTEEKLETVRESDAILREEIAAAGLERDVWQYFTVNTDVKSVGVMGDQRTYDYTLAIRAITSIDGMTADFAQLPWDLLQKISKRIVNEVDHVNRIVYDITSKPPATVEWQ

SEQ ID NO: 16740 - protein, 1181 aa, Nostoc punctiforme PCC 73102
MTLQNWRRKRGVALTTKGLQKIKAAKHQSEAKENFGNRYTLEEMSARSGLYSATISKVLNREGGVDKQTIEKLFSAFNLKIDKNDYLSSINRLDWGEAIFNSAFYGRTEELTTLEEWILNEHCRLVSLLGIGGIGKTTLSIKLAQQIQDNFEYVIWRSLREAPPITIILSNLIQFLSDEQETESNLPENFSDKVSRLLYYLQNHRCLVILDNAESILRSGSRAGLYREGYEEYGELFRRIGEATHQSCLILTSREKPKEVALLEGQAIPVRSLPLSGLKIAEGQEILKLKGLSAVEDEWKVMIERYGGNPLALKIVATTIKDIFGGNVTEFLQQDTAVFGDIRDVLEQQFERLSDLEKDIMYWLAINRESVTLSELREDIISPVAQSKLLEAVESLGRRSLIEKATPTLIGKTGLLFTLQPVVMEYVTSSLIEQVCEEILTQNIYLFRSKALTKATAKEYVRDTQIRFIIKPVIDGLLTAFRSKKNLENHLAQILTTLREISPLEQSYTAGNVFNLLYHLETDLSSYDFSYLTIWQADLQHIKLHNVNFAYAHLAKCVFIETFGGIFSVAFSPNGKLLATGDTNGEIRLYEVANSQQLMTCKGHTGWVWSVTFSPDGQVLASGSNDQTIKLWDISNGQCLKTLEGHSGGVRSVTFNPDSQLLASGSDDQTVKLWNISTGKCLKTLQENGCSIWSVAFNPKGDVLASGNDDYKVRLWDINSNSCIHTLEGHTQRVYSVCFSPDGNTIASASHDQTVKLWDTSTGKYIKTLQGHTDLVHSVTFSVDGSALVSCGDDQTVRVWDFVSGQCLKTLQGHKSRVWSLAICINQNICASSSDDQTVKLWNMSTGRCIKTFQGYNNGIWSVAVSPTDNNILASGSNDQTVTLWDITAGKCIKTLREHGRRVTSVGFSPDAHLLASGSEDQTVRLWDLSTSKCLKILKGHSNRVTSVTFSADSYFLASGSDDQTIRIWDITTGQCLNALREHSGRTWSVTFSPDSHVLASGSHDQTVKLWDVRTGRCLHTLQGHTEWVWGVAFSPNGGMLASGSGDQTIKLWDVSTGQCIRTLQDHTNTVYSVAFSSDGRILASGSGDQTVKLWDVNTGSCLRTLLGHTRWVWSVTFRSDDQTVVSCSEDETIKIWDVQTGECLKTLKSKNPYEGMNITSISGLTESQKDTLKALGAVEY

SEQ ID NO: 16741 - protein, 304 aa, Triticum aestivum
MQRRQYRGYWFPEWHLSALAAARDHFEPKPTDIFLVSCPKSGTTWLKSLAFATVHRDVHPPSGREHPLLHKNPHDCVKFIHTIYRQPVDVVRDIVEAYPSPRIFGSHFPLSLLPERINGDGCGCRIVYICRDPKDVVVSWWWFMRTYLPNPEQVRFEEVFDLFCEGRTGAGPYWRHALEHWEESRRRPDKVLFLRYEEMLRDPQCNLRRLAEFLGCAFSEAEEKAGVLEAILELCSLGKLKKLEVNQSGNRINDEPMMNDSFFRKGVAGDWINHMTPEMAARLDAIVEQALQGTGFDFGISMPQ

SEQ ID NO: 16742 - protein, 989 aa, Nostoc punctiforme PCC 73102
MVLQVQTSSYEAKTQEIAKQLLAATQENRSFFSSLRDQMRWDDKLLAWAMSNPGLRVQLFRFIDTLPALHSKSEIASHLQEYLGDESVELPAALKGMLNFANPDSMPGQVAATTVGTAVETLAHKYISGENIKQVIKTVERLRKEKMAFTIDLLGEAVITEAEAQSYLERYLELMQQLVEASKNWAAIPAIDEADGEPIPKVQVSVKLTAFYSQFDPLDAKGSEERVSDRIRILLRRAKELGAAVHFDMEQYAYKDITLSILKKLLLEEEFRQRTDIGMTIQAYLRDSEQDAKNVISWLKERGYPLTIRLVKGAYWDQETIKASQKHWKQPVYNDKAATDANFETITQLLLENHQYVYSAIGSHNVRSHSRAIAIAESLNVPRRRFELQVLYGMGDKVAKALVDRGYRVRVYCPYGELLPGMAYLIRRLLENTANSSFLRQNLENRPIEELLAPPIVKEGKSLTPNSHFLGAADTDYAVEEIRTKAAQAFQSVRQQLGKTYLPLINGEYVNTPEFVDSLNPSNFSEVVGKVGLISVEQAEQAMQAAKAAFPGWRKTPAKQRADILRKAGDLMELRRAELSAWIVLEVGKPVKEADGEVSEAIDFCRYYADEIERLDKGVNYDLAGETNRYIYHPRGIVVVISPWNFPLAIACGMTVAALVSGNCTLLKPAETSSVIAAKLTEILIDAGFPKGVFQYVPGKGSQVGAYLVNHPDTHVIAFTGSQEVGCRIYAEAAILKPGQKHMKRVIAEMGGKNAIIVDESADLDQAVVGVVQSAFGYSGQKCSAASRVIVLEPIYEAFVQRLVEATKSLNIGEAELPSTQVGPVIDANARDRIQKYIEIGRQSAEVALELPAPKQGYFIGPVIFSEVSPNAVISQEEIFGPVLAVIRVKDFQEALAVANGTNYALTGGLYSRTPSHIQQAQTEFEVGNLYINRNITGAIVGRQPFGGFKLSGVGSKAGGPDYLLQFLEPRAVTENIQRQGFAPIEGAD

SEQ ID NO: 16743 - protein, 450 aa, Xanthomonas oryzae pv. oryzae KACC10331
MPDHLPRDAADALQAPAQLDAFWMPFTANRQFKARPRLLASAQGMYYRDVDGRQILDGTAGLWCCNAGHSRERIVAAIREQAGTLDFAPTFQMGSPLPFVLAQRLAAIAPPGLCHVFFTNSGSEAVDSAMKIVLAYHRLRGDGQRTRFIGREKAYHGVGFGGMSIGGLPNNRKWFGPLLAGTDHLRHTLDIERNAYTRGLPAHGAELADDLERLITLHDASTIAAVFVEPVSGSAGVILPPEGYLQRLRAICNRHGIVLVFDEVITGFGRVGDTFAAQRFSVTPDIITAAKGLTSGTVPMGAVLVADAIHDAFMHGPQSVIELFHGYTYSGHPLACAAAIATLDTYAEEDLFTRAITRGAQWEDAVHSLRGLPHVIDIRNIGLIGAIELAPRDGAPGARGYEIFERCFHEGGLLVRVTGDVIALSPPLIVTPEQIGQMVETLGNILRSTA

SEQ ID NO: 16744 - protein, 141 aa, Triticum aestivum
FSEEQFAGTFEGRRPCYFNTGVMVLDLARWRRAGYTRRIERWMEIQKSPPGRIYELGSLPPFLLVFAGQVAAIEHRWNQHGLGGDNILGSCRDLHPGPVSLLHWSGSGKPWARLGGGRPCPLDALWAPFDLYGPAAVEPSR

SEQ ID NO: 16745 - protein, 455 aa, Ustilago maydis 521
MSNLPSEPEFEQARNELATTLAPFLEQYPEYNKAFEIVQIPERIIQFRVVWEDDNHVSQVNRGYRVQFNSALGPYKGGLRLHETVNLSVLKFLGFEQIFKNALTGLNIGGGKGGSDFNPKGKSDGEVRRFCKAFATELQRHIGPNTDVPAGDIGFSTREAGFVFGTYKQLRNEWTGVITGKALDWGGSNIRPEATGYGLIYYVEHMINHVEQGTNGFNGKKVVISGSGNVAQYAALKVLELGGTVLSLSDSKGSLIAKDTKGFTAEMISKIAEIKYNRGELESFGTASGALEWHAGARPWKLFSSYDVALPCATQNELNADEAKFSLSAGCRYVAEGSNMGLDQAAIDVYEQSRITDPSKACWYGPGKAANSGGVAVSGLEMAQNSARLTWSPEEVDQKLKDIMKNAYENCFKTGQAFPAKNDKVADKLPSLVGGANIAGFKKVADAMKQHGDWF

SEQ ID NO: 16746 - protein, 523 aa, Solanum lycopersicum
MAGGGFTTSGNGGTHFEAKITPIVIISCIMAATGGLMFGYDVGVSGGVTSMDPFLKKFFPTVYKRTKEPGLDSNYCKYDNQGLQLFTSSLYLAGLTATFFASYTTRKLGRRLTMLIAGCFFIIGVVLNAAAQDLAMLIIGRILLGCGVGFANQAVPLFLSEIAPTRIRGGLNILFQLNVTIGILFANLVNYGTAKISGGWGWRLSLGLAGFPAVLLTLGALFVVETPNSLIERGYLEEGKEVLRKIRGTDNIEPEFLELVEASRVAKQVKHPFRNLLQRKNRPQLIISVALQIFQQFTGINAIMFYAPVLFSTLGFGNSAALYSAVITGAVNVLSTVVSVYSVDKLGRRVLLLEAGVQMLLSQIIIAIILGIKVTDHSDNLSHGWGIFVVVLICTYVSAFAWSWGPLGWLIPSETFPLETRSAGQSVTVCVNLLFTFVMAQAFLSMLCHFKYGIFLFFSGWIFVMSLFVFFLLPETKNVPIEEMTERVWKQHWLWKRFMVDEDDVDMIKKNGHANGYDPTSRL

SEQ ID NO: 16747 - protein, 481 aa, Saccharophagus degradans 2-40
MKIHNMKNFINGEYIASQADGAIDVLSPSTGKKVGDIPAGCVEDAQLALDTANAAQKLWAKKTNRERAKILRVFAANIRAAADDLAKLLVSEQGKLLSVAQMEVEATATFIEYACDNALTIEGDILPSDNPNEKIYIHKVPRGVVVAITAWNFPLALAGRKIGPALVTGNAIVVKPTQETPLATLALGELANAAGIPAGVLNIVNGRGSVVGQHLCESPITRLITMTGSTPAGQRIYRTSADHLTPVMLELGGKAPFIVMEDANLESAVEAAFTTRYANCGQVCTCAERLYVHESIYPAFMDKLLEKVKAIKVGDPMAADTDMGPKVNQSEIENIDALVKKGIEQGATLLHGGKRAHVPGFEGGNWYEPTLLGDVQQSNILVHEETFGPILPVVKINSIEQAIEYTNDSEYGLSTYLFTQNLKYIHQYIAEVEAGEVYVNRGIGEQHQGFHNGWKLSGAGGEDGRYGLEQYLEKKTVYFAE

SEQ ID NO: 16748 - protein, 338 aa, Saccharophagus degradans 2-40
MKAAQYAGNKSFNVVDGAKVPPAEGEVCLQVGYTGICGTDMHIYHGVMDQRVSIPQIIGHEMSGTVVEVGAGVTDYTVGDRVVVRPLDYCGDCPACNAGHSHVCHNLKFMGIDSPGAFQSYWTVKARTLHALPDNVSLKQGALIEPLSVACHDVARTRLQAGEKALVIGGGPIGQLVALVAKSVGAEVMISEVSEARLKFAAERGIKTVNPVTDDIEAVVKEWTGGKGADAVFEVSGVAAAVETMTKVAAVRGRICMVAIHSQKPQVDLFQFFWKELELLGARVYESADFEHAIELVASGKIDVDSFISSVTSLNDIGTAFASMDNNPAGMKALVECN

SEQ ID NO: 16749 - protein, 536 aa, Saccharophagus degradans 2-40
MGVSSRTAFQFAAIVAMGGFIFGLDAALISGTVRFVTAEFGLNDLQLGSVVSAPGFGVLFALIAAGPLCDRIGRKYTLIIIAALYVLSAVFSVIAPSYEALVAARFIGGLAFASLSLASMYIGEIAPADMRGKLVSMNQITIVVGLTAAYFFNYFLLELAGSGAQWVQTVGLQQNLWRWMLGVEILPALVWLLLLLRIPESPRWLIAKNRIDDAKHALQRLVPAEKVEENLASICNAVHGEVLAPSFAKQFSMLFDSRLKRAMIVGLAFAIVQPITGVNAILFYAPMVFEQTGVGTNAAFMQTIIVGLVSLVFTVVALSCIDKFGRRPLVIVGLLWSVLSLFMCFWAFNEATYLLEASHLAELAGTLDQAQLGALQNMIGVQYSSDLEYKAALALNLGAESARAYEGVLIQLAATMNGWLVILGIIGFIAAFHLSIGPIMWVVFSEIVPIHVRGVAIPMFAFVTSLVSFFVQKLFPWQLNVMGAAEIFLFYCLSGAAGLVLLWWFLPETKGKTIEQIADGLAGEQPASSRVSTSAS

SEQ ID NO: 16750 - protein, 488 aa, Methanosarcina barkeri str. Fusaro
MCGIAGAAGTPDTNEEVKRMLAALGHRGPDACGTYQAKGLSIGNTLLKITGDMLQPLVGKGALVLNGEIFNFRELAAEQGIKTNSDTEVLFALIETKIKEGETPTNAIFSVLSRVNGDYALAYVLGNKLVLARDPVGVKPLFYSLEKEGKKPKLAFASEKKAFSSQKDQIKSFPPGRVMAFDIRNGRLEEKSLTIDPPQERISEEHEASSRLKAALEKAVEIRLTKTSGIAFSGGIDSTFLAALAKNIDPSISLYAVGLPDSHDLVQAQRAAEVAGMSDSLKTHTLSPEEIEAAIPNVIYSTESTDPMKIAIGLPLYFVAKTAKEDGKRVLLTGQGADELFGGYNRHKALLEHGPKVLDRAIYTDLKNISTINLERDDMVTMANSVELRVPFLDKEVIKTGLAISPELKVLKRDSLYIRKYILRKAADGLLPSELLWKEKKAIQYGTGVQKVLDRLAREAGFSKREGNHIEKYLKKVAENQGFDFIFR

SEQ ID NO: 16751 - protein, 369 aa, Thermoplasma acidophilum
MVMAEWTEVNFGPQHPSMHGVLRLRVKLDGEIVKEVEPIIGYLHRNAEKIGELQFYCDNMIYFDRMDYVAAMNMEVGYLEAAEKLLDIEVPERAQWIRVMMAELNRIASHLVWLGAFGLDLGMLTPFFYCFKEREKILKIFTEVSGSRQQLNYMSIGGVYQDVTDEALDHIKTFIREFPKELNKIESLFVKNDVFISRTKGIGILSKEMAIDYGVTGPMLRASGVEYDVRKAQPYLVYDKVNFDIPVSFKGDNLARFLVRVEEMRQSVKIVEQTIQKLPAGPYFNQKAKKPLMIRLRGQGEVYARTESPKGEFGVYLIGDGSLRPYRVRVRSPTFKNLSVLPALAKDQMIADLISIGGSIDLVFGEVDR

SEQ ID NO: 16752 - protein, 464 aa, Zea mays
MPPGSATQFRYTQTPSKVLHLRNMPWECTEEELVDLCKPFGRVVNTMCNVGANRNQAFVEFADQNQAISMVSYYASSSEPAQVRGKTVYIQYSNRQEITNNKGTGDSSGNVLLVTFEGVQPNDVTIEVIHLVFSAFGFVHKIATFEKAAGFQALIQYTDAPTALEAKNSLDGRSIPKYLLPEHIGACHMRITFSAHKDLNIKFQSHRSRDYTNPYLPVNQTAIEGIVQPTVGPDGKVKEPESNVLLASIENMQYAVTVDVLHTVFSAFGAVQKIAMFEKNGGMQALIQYPDITTAAVAKQALEGHCIYDGGYCKLHLSYSRHTDLNVKAHDERSRDYTLSDPNVQLQAAAQTPVLRSPGVAWQNTASVPAAPFYASTATSTPIGVGQVAAWNPNMQAGSFASASTAYPNQPLMANSMPHYPAIGSSSGAPPVSFQASQQMTQYSMPPGAPPHAPPAGQSIYFPK

SEQ ID NO: 16753 - protein, 439 aa, Cryptococcus neoformans var. neoformans JEC21
MSSNFYTSSHNRYWLLTRPSLLESRQTDLKYCTSRQLYCLFIFFSQLIQKLGKRLLLRQIPIATACVFFKRFYFKNSLCETNPYLVLAACIYVAAKVEETPVHIKSVVSEAKLVFHEHNIKMFPAETNKLGEMEFYLLEDLDFHLVVFHPYRALLHLTGRESADMGKFEKSRVQEDMEIRKKEGDAKKMREEEAKKASSKGQQPTVGQALEKEGERLEEAEETRIRRLMSRGTGEGMMEVDEGVLQISWFILNDSYRTDAPLLYPPYIIALSAIYIAFCLTSMSNSSARTRASSTQRPELLQSASINEGLNLLPPPKNAAEFLAGFQVSLPMLFGCVQEIIGLYPVWEAFEPTVMRNSQAQAKTGNAAAPVPAATGTKTGQNNDLVQDKKDKFGLEEAESLVRKMIEERMIDLGHPDNAGVEKASGTGPSNVAGKKRAR

SEQ ID NO: 16754 - protein, 436 aa, Vibrio angustum S14
MSKTSKSADLFAKAKQKIPGGVNSPVRAFAGVGGTPLFIERADGAYIFDADGNAYIDFVGSWGPMILGHNHAAIRDAVIDAAQQGLSFGAPTAMEITMADLVSKLVPSMEMVRMVSSGTEATMSAIRLARGFTSRDKILKFEGCYHGHADCLLVKAGSGALTLGQPSSPGVPADFAKHTLTATYNDLDSVREAFATHPEEIACIIVEPVAGNMNCIPPVPGFLEGLRDICDEFGTLLILDEVMTGFRVSEGGAQGYYNIKPDLTTLGKIIGGGMPVGAFGGRREVMEFVAPTGPVYQAGTLSGNPVAMAAGHACLSVLTEDGNEKRLANTTKRLADGFKALADKHGVPLAVNQVGAMFGFFFTEQETVTCYEDVTKCDVERFKRFFNLMLEKGVYLAPSAYEACFTSLAHTDQVIDATLEAADFAFATLAHENSPE

SEQ ID NO: 16755 - protein, 215 aa, Zea mays
MDDNEREKENENEKEKHYGTDVEDEEEDEEGNKRVVVLGPQVPLKEQLELDKDDESLRRWKEQLLGQVDTEQLGETAEPEVKVVDLTILSPGRPDLILPIPFQADEKGYAFALKDGSPYSFRFSFIVSNNIVSGLKYTNTVWKTGVKVETQKMMLGTFSPQLEPYVYEGEEETTPAGIFARGSYSAKLKFVDDDGKCFLEMSYYFEIRKEWPGTQ

SEQ ID NO: 16756 - protein, 572 aa, Debaryomyces hansenii CBS767
MSAKDLEMKPVVSELRGDFSGSVSDSETPANNNDMGKWDRFKDSFKRQEVSHGDEGKKLQKGISKRHLTLMALVTGVGTGLLVGSGKVLHVSGPLFLIVGYAIVGSFLYPTLQAAGELAVNYSSLSGGYNNYPRKFLDESIAFAVTWNYCIQWLSVIAVELVTAAMTIQYWDQNTKYNPDIWVSIFFVVILLINFVGSKGYGEGEFVFGSIKLCMICGFILMAIIVNCGGGPVGFIGGRYWHNPGYYTNFKGLCNVFVTGAFSLGQSEFVALSAAEQPNPRKAIPAACKLIFWRILILFLGSLTMVGLMVPYTSDKLMGSAGGANHASPFVLAAELHSVKVAPDIINAVILLSVTSVASSALYSSSRTLQSLAEQGFAPSYFNYIDKAGRPLRALVVCSIVGLFSFIAAYKKEEEVFTWLLSISGLSQIFTWNIIVVSHVRFRQVLKHNGISLDSLGYVASTGVWGSVYAIVWHWLILIAQFYIALFPVGSSTPDAQNFFENYLGACVLIFFYVGHKLWTRNWKLYIKTSDVDINADRVIFDEEVLNLEKQEYQDQLKRGPFYARVIDFLFK

SEQ ID NO: 16757 - protein, 252 aa, Fusobacterium nucleatum subsp. nucleatum ATCC 25586
MDSKRDEKILELVKILKNTKYLVFFGGAGTSTDSGVKDFRGKDGLYKTLYKDKYRPEEVLSSDFFYSHRDIFMKYVEKELNIKGLKPNKGHMALVELEKIGILKAVITQNIDDLHQVSGNKNVLELHGSLKRWYCLSCGKTADRNFSCECGGVVRPDVTLYGENLNQSVVNEAIYQLEQADTLIVAGTSLTVYPAAYYLRYFRGKNLIIINDMDTQYDGEASLVIKDNFSYVMDRVVKELKKIQFGKTLKNI

SEQ ID NO: 16758 - protein, 785 aa, Ipomoea batatas
MELLHSPSISQYSPKLHSRSSNIRKTGLSFGFPHNYFAEFEKKARPSALAVNAAIDGGGESDTAVVVEKPLPYGLLRRFEVLSGHPAPFGATARDGGINFAVFSSNATSAALCLISLADLPEKKVTEQIPLDPSINKTGDVWHVFLQGDFDNMLYGYSFDGKFAPEEGHYFDSARILLDPYAKAIVSRAEFGALGPEKDCWPPMACMLPTADKFDWEGDLPLKFPQRDLVIYEMHVRGFTNHESSGTEFPGTYRGVVEKLDHLKVLGVNCIELMPCHEFNELEYYSYNPVLGDYKVNFWGYSTVNFFSPMGRYSSAGMHKSGLGAIDEFKYLVREAHRRGIEVIMDVVFNHTAEGNENGPMFSFRGVDNSVFYMLAPKGEFYNYSGCGNTFNCNHPVARQFILEFLRYWVIEMHVDGFRFDLASILTRVAGDMLTTGAPLSSPPLIDMISSDPILSGVKELIAEAWDCGGLYQVGAFPHWGIWSEWNGKYRDIVRQFIKGTDGFSGAFAECLCGSPNLYQEGGRKPWNSINFVCAHDGFTLADLVTYNDKHNMANGEDNKDGENHNNSWNCGQEGGFASISVKKLRKRQMRNFFLCLMVSQGVPMIYMGDEYGHTKGGNNNTYCHDNYINYFRWDKKDESSTDFFRFCCHVTKFRHEAESLGLDDFPTAERLQWHGHTPGMPDWSESSRFVAFTLVDKVKGEIYIAFNASHLPVTVTLPERGGYRWEPLVDTGKQTPFDFLGDDVPEKKTALKQYAHFLDANMYPMLSYSSIILLLCPDEMIENS

SEQ ID NO: 16759 - protein, 510 aa, Ricinus communis
  misc_feature (117)..(117): Xaa can be any naturally occurring amino acid
  misc_feature (122)..(122): Xaa can be any naturally occurring amino acid
  unsure (1)..(510): unsure at all Xaa locations
MAAGLAITSEGGQYNGRMTSFVALSCMMAAMGGVIFGYDIGVSGGVTSMDPFLKKFFPDVYRKMKEDTEISNYCKFDSQLLTSFTSSLYVAGLVASFFASSVTRAFGRKPSILLGGXVFLAXAALGGAAVNVYMLIFGRVLLGVGVGFANQAVPLYLSEMAPPRYRGAINNGFQFSVGIGALSANLINYGTEKIEGGWGWRISLAMAAVPAAILTFGALFLPETPNSLIQRSNDHERAKLMLQRVRGTTDVQAELDDLIKASIISRTIQHPFKNIMRRKYRPQLVMAVAIPFFQQVTGINVIAFYAPILFRTIGLEESASLLSSIVTGLVGSASTFISMLIVDKLGRRALFIFGGVQMFVAQIMVGSIMAAELGDHGGIGKGYAYIVLILICIYVAGFGWSWGPLGWLVPSEIFPLEIRSAGQSIVVAVSFLFTFVVAQTFLSMLCHFKSGIFFFFGGWVVVMTAFVHFLLPETKKVPIEKMDIVWRDHWFWKKIIGEEAAEENNKMEAA

SEQ ID NO: 16760 - protein, 394 aa, Marinobacter sp. ELB17
MDLQLSSRVQSIKPSPTLAVTNKAAELRAAGQDIIGLGAGEPDFDTPDHIKAAAIEAIHNGQTKYTAVDGTPALKKAIIAKFKRDNGLDYEANQILVSSGGKQSFFNLALAVLNAGDEAIIPAPYWVSYPDMVLVAEGKPVILESTAETRFKITPQQLEDAITDRTRLFVINSPSNPSGMAYTLEELQALGQVLKKYPQVMIATDDMYEPILWTGKPFCNILNATPELYDRTFVLNGVSKAYAMTGWRIGYAAGPAKVIGAMKKIQSQSTSNPASISQAAAQAALDGSQDCVQTMVTAFHERHDYLVEALNTLPGVECLKGDGTFYVFPSFQGAIDADSSVSNDVEFAEKLLKEAGVALVPGSAFGMPGHMRLSFATSQKILTNAIERLKKALG

SEQ ID NO: 16761 - protein, 155 aa, Triticum aestivum
LITVVDETTMAARPMLVVALLCAAAAAATAQQATNVRATYHYYRPAQNNWDLGAPAVSAYCATWDASKPLSWRSKYGWTAFCGPAGAHGQASCGKCLQVTNPATGAQITARIVDQCANGGLDLDWDTVFPKIDTNGIGYQQGPLNVNYQFVDCRD

SEQ ID NO: 16762 - protein, 417 aa, Halobacterium salinarum
MPEANPFESLQEQLDDAGEFLDVNADVLERLKHPERVLETTLSVEMDDGTIETFKAFRSQFNGDRGPYKGGIRYHPGVTRDEVKALSGWMVYKTAVADIPYGGGKGGIILDPEEYSDSELERITRAFATELRPFIGEDKDVPAPDVNTGQREMNWIKDTYETLEDTTAPGVITGKALENGGSEGRVNATGRSTMFAAREVFDYLDRDLSDATVAVQGYGNAGSVAAKLIADQGADVVAVSDSSGAVHNPDGLDTRAVKAFKTETGSVSGYEGATEELSNEALLTMDVDLLVPAALENAIDEDLAHDVDADVVVEAANGPLTPDADDVLTERGVTVVPDILANAGGVTVSYFEWVQNRQRFQWTEDRVNEELEAIITDAFDAMTDAHEDAGTPNLRTAAYVVAVQRVVDAYEGSGSWP

SEQ ID NO: 16763 - protein, 433 aa, Lactococcus lactis subsp. lactis Il1403
MRKLSPTFIYFFGALGGLLFGYDTGVISGALLFIEKESWQVSSWAWMEGWITAAVLMGAVIGAVVIGPMSDRFGRKRLLLLSAVIFFVGALGSGLSNSAELLIISRVILGMAVGSASALVPTYLSELSPAKIRGGVSTMFQLMIMTGILLAYISNYALKGVSGNWHWMLGLATVPAALLFIGGLFLPESPRFLVRHDNEAGAREILGMINDDPNSIEAEISDIQLMAKEEKQGGLQELFGQMSRPVLIMAIGLAIFQQVMGCNTVLYFAPSIFVAVGFGASAALLAHIGIGIFNVIVTYIAMRVMDKVNRRWMLNFGAWGMGISLVLMSVGMILAENAHIGFGKYLAVIALTVYIAFFSATWGPVMWVMIGESFPLKIRGLGNSFGAAVNWAANWVVSLTFLPLLSFFGTGKIFLIYAACCFLSIWFTSKKSY

SEQ ID NO: 16764 - protein, 855 aa, Xanthomonas oryzae pv. oryzae KACC10331
MGTFPLHFPARPHPEPALSSPSLAPVTPDLVRLRASARDKDDAIAQAAQLLVAAGCVAPGYDASMRRRECLANTFLGHGLAIPHGVVEDRHLVLRDGIAVLQLPEGVEWNPGQTTRLVVGIAAQSDTHITLLRRLTRLIQDPAQLEALFSTDDPGVIVAALTGDRAPDTSAAPATDLAETFEWTVAYPSGLHARPATRWAETARGFSARAQVRAGDQAADAKSLVGLLQLGLRAGDSITVSAEGSDAAALLKCLRVVMDSLTAQEKADAERAAQRRAAPVAGWTPPQAQPAIVGIGASPGVAIGIVHRLRAAQTEVADQPVGLGDGGAQLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPTAAGAGLTDLPAQPCILLASDLSPSDTANLDTARVLGLATAQGGPTSHTAILSRTLGLPALVAAGGQLLDIEDGVTAIIDGSSGRLYLNPSELDLDAARTHIAEQQAIREREAAQRALPAETTDGHHIDIGANVNLPDQVAMALTQGAEGVGLMRTEFLFLESGRTPSEDEQHATYLAMAQALDGRPLIVRALDIGGDKQVAHLELPHEENPFLGVRGARLLLRRPDLLEPQLRALYRAAKDGARLSIMFPMITSVPELIALRAICARIRAELDAPEVPIGIMIEVPAAAAQADVLARHADFFSIGTNDLTQYVLAIDRQNSELAAEADSLHPAVLRMIRSTIEGARTHERWVGVCGGLAGDAFGASLLAGLGVQELSMTPNDIPAVKARLRGAALRQLQELAEQALACETAEQVRALEAKREDAA

SEQ ID NO: 16765 - protein, 165 aa, Glycine max
YVFPGYIFQMLTSLSWICWLYPNNVLAQQLGSGLNGLGIGAIGLDWSTISSYLGSPLASPWFATANVAVGFVFVMYVLTPLCYWLDLYNAKTFPIFSDELFTEKGQVYNITAIIDSNFHLDLAAYERQGRLYISTFFAMTYGVGFAALTATIMHVALFHGREIWE

SEQ ID NO: 16766 - protein, 304 aa, Zea mays
MASQQVFRAQQQQQQQFPAQQQESQPGKEHAMDPRPEAIVQDYKAANKLKDKVALVTGGDSGIGRAVCLCFAKEGATVAFTFVRGQEEKDAEETLRALRDIGSETGAREPMALPADLGYEANCREVVERVASAYGGRIDVVVNNAAEQYERESIGDVTEADLERVFRTNIFSYFLVSKHAVPRMEPGACIINTSSVNAYKGNKTLLDYTATKGAIVAFTRALSLQLADRGIRVNGVAPGPVWTPLIPASFGKEKVEQFGSQVPMKRAAQPAEIAPSFVFLASNQDSSYMSGQILHVNGGVIVNS

SEQ ID NO: 16767 - protein, 1012 aa, Desulfovibrio desulfuricans
  misc_feature (189)..(189): Xaa can be any naturally occurring amino acid
  unsure (1)..(1012): unsure at all Xaa locations
MKSTRRSFLKGVGAGVLCLTLGHLGFDLGEAQAYAGKLKIEGAKEVSSICPFCSVQCQIIAYVKGGKLVSTEGDPDFPITEGALCAKGAALYSMYTSDHRLMKPMYRAPFSDKWEEKDWDWTLEQIARRVKDARDKDMILKNDKGQTVNRLETIFWMGTSHASNEECAVIHQALRGLGVVHMDHQARVXHSPTVAALAESFGRGAMTNHWIDIKNADAVLIIGSNAAEHHPVAFKWIMKAKDNGAVLMHVDPKFSRTSARCDFHVPLRSGTDIPFLGGMLNYILENGLYHKEYVNNYTNAAFVVGDGYAFEDGLFSGYDAAARKYDKSKWALAKGPDGGPVVDPTHQNPRCVINLMKDHYSRYTLKNVSDVTGVSQDNLLKVYKNFCATGRPDKAGTILYALGWTQHTVGVQNIRLSSLVQLLLGNIGIAGGGINALRGEPNVQGSTDHALLYNNIPGYHGTPQAPWQTLGEYNKANTPVTVVPNSANWWGNRPKYVTSLLKGWFGDAATPENDFCYSLLPKLEPGVDYSYMFVMDRIYNKKIKGGFIMGVNPMNSFPNTNKMRAALDNLDWLVCSEIHNSETTDNWQRPGVGPKTKKTEVFLLPSAHRIEKAGTISNSGRWLQWHYKAVEPAGEARNFADVVVPLFNTIRRMYKTEGGVLPEAVLQMHWTDKYDPEDWARRINGFFWADTKVGDKTYKRGQLVPAFGALKDDGTTSSLNWIYTGSWTEEDGNKSRRRDPSQTPMQAKIGLFPNWSWCWPLNRRILYNRASVDMNGKPFNPNRAVIEWDGSKWVGDVPDGPWPPMADPKGKLPFIMVKDGLAQFYGPGPADGPFPEHYEPAETPLATHPFSKQLSSPVYKYHKTDMDQIAPPADPRYPIVLTTYSLTEHWCGGGETRNVPNLLETEPQLYVEMSHELAKEKGIKNGDGVVLESARGNCEAIAMVTVRIRPFTVMGKTVHLVGMPFAFGWTTPKTGDSTNRLTVGAYDPNTTIPESKACCVNLRKADKLTEIG

SEQ ID NO: 16768 - protein, 470 aa, Vibrio angustum S14
MIQFGTGGWRAFIGEEFTQANVRLVAQALANIMIKESVTENGFIIGYDRRFLSDKAATWFAEVLAGNNIKCSFIDKFVPTPVVMFKAKQTGATYSACITASHNPADYNGIKVFIEGGRDADEIITKKIEQQIAVLTDADVKRVDFEQAQNDKLVEIINPMNEFVDSIIDFIDMEAIKKANLRVLIDPMFGVAKNALQTVLISARCDVDVINDSENPGFGGLMPSPSAATLYRLKHLVAHEGYDIGIGTDGDADRLGIIDEKGNFIHPNEVLLLLYYYMLEYKGWKGSVVRNIATTHLLDKVAEAYGEKSFEVPVGFKHISSQMEADDSLIGGESSGGLTIRGHIKGKDGVFASSLLVEMISVTGKKLSELLGEIYGRFGYAYTAEGDCTFKPAERERLYNKIYVEKALPDFDYEIEKVSYADGAKVYFKNGGWAIARFSGTEPLLRIFVEMEDQPQAEAVLAQLKAFLSV

SEQ ID NO: 16769 - protein, 671 aa, Ehrlichia ruminantium str. Gardel
MSQKYSNMIAMANAVRVLSIDAIQKAASGHPGMPLGMADVGTMLFAKFLKFNPKDPNWFDRDRFVLSNGHGSMLLYSILYFLGCLDIEEIKKFRQIHSLTPGHPEYGCTPGVDATTGPLGQGLASAVGMAIAEKILSEKFGADIVSHNTYVMVGDGCLMEGISHEAASLAGHLQLDKLIVLFDDNNVSIDGPISLSVSDNVKGRFLSYGWDVDEIDGHDFSQIESSIKNAKNSKKPSLICCKTIIGKTIPSKENTCDIHSWPVTEEDIIVMKKRLGWAYKPFEFPEEILQLWQDIACNSEEEYKLWVERVSEYGKTSQDFMDVMADGVSNKVFLNLKSLKEELCSLNLNEATRKSSGRVLDVIMGSTGKLIGGSADLSNSNNTKPKFTSVINKDNFSGSYLHYGVREHAMAACMNGMALHKGVIPYGGTFLIFSDYCRPAIRLSALMKRQVIYIMTHDSIGVGEDGPTHQPVEHLPSLRLIPNLYVFRPADAIEVLECWEIALKLIDAPSVLILSRQNVKCVRSTYVAENMSSKGAYIIREYKNDLDVTIFATGSEVEIALKASDILIGKGLGVRVVSVPCWELFYKQDKKYIISLLNNKSIKAAVEAASSFGWCKYIGEDGIFVGLEDFGISAPFKDLYKYFGITPENLVDKILSKLRINSNYESNVTAD

SEQ ID NO: 16770 - protein, 143 aa, Photobacterium sp. SKA34
MTIERTFSIVKPDAVKRNLIGAIYQRFENAGLNIVAAKMLHLDSAKAQGFYAEHEGKPFFDDLVAFMTSGPVMVQVLEGENAITRYRELMGKTNPEEAACGTIRSDFALSMRHNSVHGSDSPESAAREIAYFFAEDEIYPQGE

SEQ ID NO: 16771 - protein, 373 aa, Photobacterium sp. SKA34
MTTVKINLLDFDRKGLRKYFAEELNEKPFRADQIMKWIYHFGCDDFDQMTNINKKLREKLKRVAEIRAPHVSEAQYSTDGTIKWAMRVGDQDVETVYIPDEDRATLCVSSQVGCALECKFCSTAQQGFNRNLRVSEIIGQVWRAAKEVGIQKDTGRRPITNIVMMGMGEPLLNMKNLIPALEIMLDDLGFGLSKRRVTVSTSGVVSGLEQMIDTIDVALAISLHAPTDELRSQIMPINDRWNIEAFLDVVRRYVNSTNANRGRVTVEYVLLDHVNDDMEHARQLAKVLKDTPAKINLIPFNPYPGSPYKKPSNSRIDRFMKTLMEYDFTVTVRKTRGDDIDAACGQLVGDVIDRTKRTQAKLNAGEQIAVKAV

SEQ ID NO: 16772 - protein, 301 aa, Corynebacterium glutamicum ATCC 13032
MILIVEPYGGSIRQQNPNLPMVFWDDAALTRGDGIFETLLIRDGHACNVRRHGERFKASAALLGLPEPILEDWEKATQMGIESWYSHPNAGEASCTWTLSRGRSSTGLASGWLTITPVSSDKLAQREHGVSVMTSSRGYSIDTGLPGIGKATRGELSKVERTPAPWLTVGAKTLAYAANMAALRYAKSNGFDDVIFTDGDRVLEGATSTVVSFKGDKIRTPSPGGDILPGTTQAALFAHATEKGWRCKEKDLSIDDLFGADSVWLVSSVRGPVRVTRLDGHKLRKPDNEKEIKALITKALG

SEQ ID NO: 16773 - protein, 270 aa, Nocardioides sp. JS614
MGFTTCHAPPEVVMDSKLFALDGRVALVTGGNGGLGRAIALALRDAGATVAVTGRDERKNAAVAADLGSADAVFPGDVRDESAVSATMAQVVERFGRLDILVNNAGNYVGGSVLDLTESGWHAVVDTHLTGSFLCAKHAAQVMVSQRSGGKIINIGSMYSLFGPPAAIGYAAAKTGIIGLTRALAVELAEHDIQVNAILPGWYETDLTRGAPGSEWGERIRHKTPAQRWGDTDDLAGPAVFLASTASDFVTGVALPVDGGYAVADRLLPE

SEQ ID NO: 16774 - protein, 521 aa, Ashbya gossypii ATCC 10895
MSKRSASIEELEDGQGRFVQSKTYPHTVPVAGGEDEDVDMHDEEMGEFEDPYGDDFDSEGEIIQVDDDADGDDDAMDDEEYLEQKQQQAENMVENDKGADTKEGQLYLPHMSQPLGPDEVLQADPTVYEMLHNVNLPWPCMTLDLIPDNLGSERRNYPQSILMTTATQASKKKDNELLVLKLSQLAKTLAKDEDDGAEDDEDDEDEDADPIIENENIKLRDTTNRMQVSPFAAESQEVLAATMSENGEAHIFDLGPQVKAFSSPGYQVPKAAQRPQYTIKNHGNVEGYGLDWSPLIKTGALLTGDCSGRVFLTQRTSSKWITDKQPFTVDNNKSIEDIKWSPSENTVFATCGVDGHVRIWDIRSKKHKPALSVKVSDTDVNVMSWNQKISYLLATGDDNGTWGVWDLRQFSNQQGGVSPVAQYDFHKGAITSISFNPLDESIIAVASEDNTVTLWDLSVEADDEEIKQQAAEVKELQQIPPQLLFVHWQKEVKDVKWHKQIPGCLVSTGTDGLNVWKTISV

SEQ ID NO: 16775 - protein, 121 aa, Brassica napus
  misc_feature (119)..(119): Xaa can be any naturally occurring amino acid
  unsure (1)..(121): unsure at all Xaa locations
MFKRRNAHQLDDGSQHDNKVRELRSAIEPLSGQSLVFCSDASLRRYLAARNWNVEKAKKMLEETLKWRSTYKPQEIRWNQVAHEGETGKVSRASFHDRQGRVVLIMRPALQNSTSAEGXIK

SEQ ID NO: 16776 - protein, 557 aa, Streptococcus pyogenes MGAS315
MVLSDIEIANSVTMEPISKVANQLGIDEEALCLYGKYKAKIDARQLVALKDKPDGKLILVTAISPTPAGEGKTTTSVGLVDALSAIGKKAVIALREPSLGPVFGVKGGAAGGGHAQVVPMEDINLHFTGDFHAIGVANNLLAALIDNHIHHGNSLGIDSRRITWKRVVDMNDRQLRHIVDGLQGKVNGAPREDGYDITVASEIMAILCLSENISDLKARLEKIIIGYNYRGEPVTAKDLKAGGALAALLKDAIHPNLVQTLEHTPALIHGGPFANIAHGCNSVLATKLALKYGDYAVTEAGFGADLGAEKFIDIKCRMSGLRPAAVVLVATIRALKMHGGVPKADLATENVQAVVDGLPNLDKHLANIQDVYGLPVVVAINKFPLDTDAELQAVYDACDKRGVDVVISDVWANGGAGARELAEKVVTLAEQDNQFRFVYEEDDSIETKLTKIVTKVYGGKGITLSPAAKRELADLERLGFGNYPICMAKTQYSFSDDAKKLGAPTDFTVTISNLKVSAGAGFIVALTGAIMTMPGLPKVPASETIDIDEEGNITGLF

SEQ ID NO: 16777 - protein, 523 aa, Cryptococcus neoformans var. neoformans JEC21
MNVFADEATEERGENARLSSFVGAMALGDLVKSTLGPKGMNKILQSASNSTITVTNDGATILKSIHLDNPAAKILVNISKVQDDEVGDGTTSVCVLASELLREAEKLVTVQKIHPQTVAEGYRIASRAALQALEASAVDNKNDNAKFREDLFNIARTTLSSKVLAQDKDYFANLAVDAVLRLKGSTDLEHIQIIKKVGGKLTDSYLDEGFILDKTIATNSPKRIENAKILIANTSMDTDKIKIFGARVRVDGTGKLAELERAEKEKMKAKVQAIASHGITCFVNRQLIYNYPESLLAEAGIMSIEHADFEGVERLALVTGGDIASTFDAPEKVKIGRCDVIEEIMIGEDKLIKFSGVAAGEACTVVLRGATSQMVEEAERSLHDALSVLSQTVKETRVTLGGGCAEMLMSCQVEEAARTVKGKKALAVEGFARALRQMPTIIADNGGYDSSDLVTKLRAAHYEGQSDAGLDMDKGEIGSMRQLGITESFKLKKQVVVSASEAAEMILRVDNILRSAPRRREAH

SEQ ID NO: 16778 - protein, 194 aa, Medicago sativa
MASASASLFKSSIVLDKSEWVKGQTLRQSSVSSVRCNPTAPSSLTIRAGSYADELVKTAKTIASPGRGILAMDESNATCGKRLASIGLENTEVNRQAWRTLLVTVPSLGEYISGAILFEETLYQSTTDGRKIVDVLIEQNIVPGIKVWTRVWCPLLVPMDESWCPGLDGLASRSAAYYQQGARFAKWRTVVSIP

SEQ ID NO: 16779 - protein, 448 aa, Oryza sativa (japonica cultivar-group)
TGINTLLQSLFGTRLPTVIGGSYAFVVPIMAIIQDSSLAAIPDDHERFLQTMRAIQGALIVSSSIQIILGYSQLWGIFSRFFSPLGMAPVVALLGFGLFERGFPVVGRCVEVGLPMLILFVVLSQYLKNVQIRDIPILERFSLFICIALVWAYAQILTAGGAYKHSPEVTQINCRTDRANLISSAPWIKIPFPLQWGAPTFSAGQSFGMVSAVLVSLVESTASYKAAARLASATPPPAHILSRGIGWQGIGILLDGLFGTGTGSTVSVENVGLLGSTRIGSRRVIQISAGFMIFFSMLGKFGALFASIPFTIFAAVYCVLFGLVAAVGLSFLQFTNMNSMRNLFIVGVSIFLGLSVPEYFFRYSMAAQRGPAHTKAGWFNDYINTIFSSPPTVGLIVAVFLDNTLEVKNAAKDRGMPWWVPFRSFKGDARSEEFYSLPFNLNRFFPPS

SEQ ID NO: 16780 - protein, 491 aa, Arabidopsis thaliana
MDRVGSLPDELLSHILSFLTTKEAALTSLLSKRWRYLIAFVPNLAFDDIVFLHPEEGKPERDEIRQSFMDFVDRVLALQAESPIKKFSLKCRIGVDSDRVDGWISNVLNRGVSELDLLIILGMTMEDSYRLSPKGFASKTLVKLEIGCGIDISWVAGSIFLPMLKTLVLDSVWFYVDKFETLLLALPALEELVLVDVNWLDSDVTISNASLKTLTIDSDGHLGTFSFDTPSLVYFCYSDYAAEDYPVVKMENLREARIFLLVTDNEIERVRLPINDGLEDAMDNVVLRFGHVGKLMNGIRNVEYLELSADTLEVLSLCCESMPVFKNLKSLAIKSTEGRGWQAMPVLLRNCPHLEFLLIEGLLHHVTDKCGDACDCVPREDKGRSLTSCPVNMLEIHGFRGTKKEMQMIKHFLDYFPSLKEMDIYADEDGPTNLEAPGMFEQITQLFTLYDEFYTCDVQFMVRGSLYKKLTAQCCVFKEENLPHRLVRTLG

SEQ ID NO: 16781 - protein, 344 aa, Brassica napus
MSTVTNKQVILRDYVSGFPKESDFDITTTTVELKLPEGSNSVLGKNLYLSCDPYMRSRMGKPAASGIAQAYTPGKPILGFGVSRVIESAHPDYKEGDLMWGIVGWEEYSVVTPIPDMHFKIQNTDVPLSYYTGLLGMPGMTAYAGFYEVCSPKKGETVYVSAASGAVGQLVGQFAKMMGCYVVGSAGSKEKVDLLKNKFGFDDAFNYKEEQDLTAALKRCFPKGIDIYFENVGGKMLDAVLLNMNVHGRIAVCGMISQYNLENHEGVHNLSTIIYKRIRIQGFAVFDYYDKYSKFLEFVIPCIKEGKIAYVEDVAEGLEKGPEALVGLFHGKNVGKQVVVIARE

SEQ ID NO: 16782 - protein, 676 aa, Hordeum vulgare subsp. vulgare
MFPLGARQPPPSAMDNHQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQAQSSWTKRAVEIDSPQDMSPDQSADPPEGTCAHVNHPKSEICSNRWLPGTNNKKCQKPKETTNGDGFKGKELEIGAPGNLNTDDQSSPKESSVKPTDGRCEYLPQNNSSDTVMENLEEPIVRAADLIGSMAKNMDAQQAAARAIDAPNCSLQAPEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHAANYGSNSFSNNNTNNGSTAATTAAAATVHAETGGGVDKRSNMMNMKRERRVAAVNKFREKRKERNFGKKVRYQSRKRLAEQRPRVRGQFVRQPPAPAAVER

SEQ ID NO: 16783 - protein, 380 aa, Ashbya gossypii ATCC 10895
MDINHITNPTVTKQVYKGHGAPGAEEVVEITYPATEVVGHGSFGVVFTTVIEQTGEKVAIKKVLQDRRFKNRELEIMKLLQHPNVVDLRYHFYESEPQTNEVYLNLILEYMPQSLYQRLRHFVTGRLLMPRDEIKVYMFQLFKSLNYLHRVARVCHRDIKPQNLLVDAGTLQLKLCDFGSAKQLRPTEPNVSYICSRYYRAPELIFGATNYTTQIDIWSTGCVMAELLLGQPMFPGEFVIVQLAEIIKILGTPTRQEICAMNENYSDHKFPQIKPIPLSKVFKREDAHTVQLLSDVLQYDPTRRFNALMAMCSSYFDEITGHNTEPETVAPGASISELWQGVVHSLQLLHFKPEEFNDLNDLERSLIQNKLIAKQPPNVP

SEQ ID NO: 16784 - protein, 373 aa, Cryptococcus neoformans var. neoformans JEC21
MADKTFKITVLPGDGIGPEVVAEAVRVLETIVNHSDLKLDLKSYDFGGAAIDNHGVPLPDETLKACKEADAVLMGSVGGPKWGVGPVRPEQGILKLRKELGLYANIRPANFASESLLKRSPLKEDTARGTDIIVLRELIGGIYFGERQETNDEGVAWDQCIYSKPEIERITRVAAQIALAAEPPLPITSVDKANVLATSRLWRKTVSELMAKEYPQLKLEHQLVDSAAMIMIANPRKLNGVLLTENMFGDILSDESSVIPGSLGLLPSASLAGAPDAKSTTMGLYEPIHGSAPDIAGQGIANPIGTILSAAMMLRYSLGKGREAALIEQAVQKVLDSAESGGFDYRTKDLGGQRSTKEVGDKVVEVLKGLLGA

SEQ ID NO: 16785 - protein, 558 aa, Geobacter sulfurreducens PCA
MSIVVIGANAAGAKAASKAKRINPTAEITLIDRGTFISYGACGIPYFVSDTVEDVKELMSTPVGVVRDHQFFRKVKGVTVKTATEVIAIDRAAKTVCMRDCQTSRETKLPYDRLVLATGSTPFIPQISNVNLANVLTVKSIEDAELLKSLAVPGTRACIVGGGLIGLETAEALRHKGLQVAVVEMRDQMLPGVLDWEMAALVEKQLRQQGVTVMTGSAVTGLVGDAAVEAVQIGDVRIPADLVVLAPGVAPNVELARGAGLEIGPTGAIAVDTRQCTTDPDIYACGDCCETTHLITGKKVFIPLGSTANKQGRVAGINAAGGEATFAGVIGTSILRVFAVNAGKTGLTEAEAKAHGFEVETVLSPSHDKAHFFPGAKPIILKLVAERGTGRILGLQAVGEGAVDKRLDAAATAITFGATAEQVAQLDLAYAPPYSAAMDNLIVAADILKNKLAGHARGITPREVKRKFDEGDDFILLDVRSPAEHNAVGIEGAKLIPLGMLREKLEELPRDKEIIAFCKISLRGYEAQKILDAAGFRNAKFMDGGILAWPFALRTSDK

SEQ ID NO: 16786 - protein, 173 aa, Medicago sativa
ATAQVASQQGTYLAKCFNRMEEYEKNPEGPIRFRGEGRHRFKPFRYKHSGQFAPLGGEQTAAQLPGDWVSIGSVIGSSPSGTSIEVNLLLWEASRQLHSYLEIGLSIGHSSQWLWYSVYASKQVSWRTRALVVSDWMRRFIFGRDSSQIGRIFNIFQIPALAILKCSSILNIF

SEQ ID NO: 16787 - protein, 475 aa, Arabidopsis thaliana
MNIQKDDWMDRRKIVRRNTQSSASTYVLEKLHIDLVIEILSRLSAKSIAICRCVSKQWNSLLVSQDFVESFLRSSLSRPRIWFTFRFDGKWNFFSSPQPQKFGNNLSVEATEHHMGSYENWYMKSCQSVHGFIFMSYNSKGMTDRTQVIWNPCTRQLITLPKLEPENLDFNSFFAYDPTEKQFKVLCMTVVNKQQTTSYKYQVLTLGTGPLLWRNIECPFMYRLRDKSNRGICINGVLYFIGWIKCSTMIIICFDVSSEKFSFIKIENAFIVTLINYRGKLGVYLVVYGSPRGEVWVLDDTKNDNWSKHNFVCPYSGQENSTWATGTGELVWPSSPWTQPFYVVYYNLERQSFRRVDIKGMENKVSTGKDRYDGFFTFTNHVENLMVLPLHKKTIPIQDTLTNRVMERETLTRSPLTQTAYASSYSTTRSYKSSGKRCSDRSIGEDEQDDIGEKRGDQAAERRERSTKRGKHEVH

SEQ ID NO: 16788 - protein, 383 aa, Corynebacterium glutamicum ATCC 13032
MKPSTRSNVQPFRVMQMLDRVHRRRREGKDTLMFCAGQPSTGAPEAVIEEAEIALRSGPLGYTEVIGDREFRERIADWHSATYDVDTNPDNVIVTTGSSGGFVASFIATLDHGDYVAMPTPGYPAYRNILESLGAKVLNLRCTAETRFQPTAQMLEELPHKPKAVIVTSPGNPTGTIIDPEELERIAKWCDDNDAVLISDEDYHGMSFGRPLATAHQFSKNAIVVGTLSKYFSMTGWRVGWIIVPDELVTPIENLQASLSLCAPAIGQAAGRAAFTLEAGAELDAHVEAYREAREVFVDKLPEIGLGTFADPDGGLYLWVDVSAYTDDSEEWALRLLDEAGVAVAPGVDFDPEEGHKWIRLSLCASKEDTIEGVRKIGEFIKK

SEQ ID NO: 16789 - protein, 533 aa, Ashbya gossypii ATCC 10895
MFARQVVCGGRIAGRRLFANSALRMGPQTAAAATRSVPRRVLGAALKVAGATLLAGTAWVSYELYRESNPAAQEPQSATFPDGSPRKTLVVLGSGWGSVTLLKNLDTTLYNVVVVSPRNYFLFTPLLPSTPVGTVELKSIVEPVRSITRRRPGEVIYYEAEALEVDPQSKKVRIRSVEQGEHKYEMELNYDCLVVGVGAQPTTFGTPGVYEHASFLKEIPDAQDIRVKVMNNIEKAAALSPNDPERKRLLSFVVVGGGPTGVEFAAELQDYVDQDLSKWMPELSKEIKVTLCEALPNILNMFDKSLWQYAQDLFKQEKIDLKVNTMVKNVTATHITTKCGDQLEELPYGVLVWATGNAPRDVSKSLMKKLDQQTSPRGLLINDKLQLLGAEDSIYAMGDCTFYPGLFPTAQVAHQEGEYLAHVLKKQHKIDHLRWQLADAEPSQVPRITARLEKAEAAIQPFKYNHQGALAYIGSEKAIADIAIGESKYRLAGSWTFLFWKSSYLVMCLSFRNRILVALDWLKVSFLGRDSSV

SEQ ID NO: 16790 - protein, 176 aa, Debaryomyces hansenii CBS767
MPAYHSTFLTEQTEDSRLVGNIALLPIHTKFRGPSYPPQQDYDIIEETLDLFRANSFFKNFEIKGPADRLLIYGILFVSDCLSKLNKSVNFKEATRILNNLSLDSFSLPGDMGFPLNSMYQPPANKNEADLLRSYLQQFRQELAERLLKRIYGDDPNTPSKFWLAFTRRRFMNKSL

SEQ ID NO: 16791 - protein, 453 aa, Hypocrea lixii
MLPKDFQWGFATAAYQIEGAIDKDGRGPSIWDTFCAIPGKIADGTSGVTACDSYNRTAEDIALLKSLGAKSYRFSISWSRIIPKGGRDDPVNQLGIDHYAQFVDDLLEAGITPFITLFHWDLPEELHQRYGGLLNRTEFPLDFENYARVMFKALPKVRNWITFNEPLCSAIPGYGSGTFAPGRQSTTEPWIVGHNLLVAHGRAVKVYRDEFKDLNDGQIGIVLNGDFTYPWDSSDPLDREAAERRLEFFTAWYADPIYLGDYPASMRKQLGDRLPEFTPEEKAFVLGSNDFYGMNHYTSNYIRHRTSPATADDTVGNVDVLFYNKEGQCIGPETESSWLRPCPAGFRDFLVWISKRYNYPKIYVTENGTSLKGENDLPKEKILEDDFRVNYYNEYIRAMFTAATLDGVNVKGYFAWSLMDNFEWADGYVTRFGVTYVDYENGQQRFPKKSAKS

SEQ ID NO: 16792 - protein, 411 aa, Triticum aestivum
  misc_feature (189)..(189): Xaa can be any naturally occurring amino acid
  unsure (1)..(411): unsure at all Xaa locations
MGNEMSPLQKHRAEYRPELPPWLQGTAVKVEYGDAAIAADGADAHVIRRAFPHTYGQRLAHFLPKTANAPDATVITEHPAVRVGVVFSGRQSPGGHNVVWGLYNAINSHNPSSELIGFLGGTDGLFAQKTLEITEEVFSSYKNQGGYYMLGRTRDQIRTTEQVKAAMTTCQALKLDTLVIIGGVTSNTXAAQLAETFAESKCSTKVVGVPVTLNGDLKNQFVETTVGFDTICKVNSQLISNVCTDALSAEKYYYFIRLMGRKASHVALECALQSHPNMVLLGEEVAASKLTISDITKQICDAVQARAEKDKYHGVVLIPEGLVESIPELYALLQEIHGLHDKGVSIENISSHLSPWASALFDFLPPFIRKQLLLHPESDDSAQLSQMETEKLLAQLVETEMNKRLEEGLTT

SEQ ID NO: 16793 - protein, 402 aa, Acidovorax sp. JS42
MHNPASPTDTLLPALARPAIQSLGGSLIREVANTDMGRADVLPFWFGESDQPTPQFIRDAAAQSLGSGETFYSQNLGRPYLREAIAQYLSDLHGREVSPQRIGAVASGDAGLMLTCQMLLSPGDRVVAVTPLWPNLLEMPRILGAQVERVPLAVRGGRWTLALDRLLDALTPGTRMLILNSPNNPTGWTIDEESLVAILAHCRRHGIWILSDDVYERLVYDPQLASAPSFLRHYAPGDRIISVNSCSKAWCMTGWRAGWMVVPEALEADLGKVIEYNFSCIFEPVQRAATVALQQGEAHVAQLRAGLVESRRLLVQALRAVPGVEVPDAGGAMYVFFRLAGFDDSLALAKHLVSEVGLGLAPGAAFGPEGEGWLRWCHAVSDGARLREGVERLARFVQRATA

SEQ ID NO: 16794 - protein, 328 aa, Cryptococcus neoformans var. neoformans JEC21
MDIILEYSDEYVLDKVYNFLLPHPPVPSSLTSINATALSESYSGSTTYHPSIEPASLLPRDSIIRQSISLFTVALLGAYALYFIFCSLSYYYVYDRRLEHHPKFLKDQKRKEIISSVVSAPWIALMTVPWFVAEVRGHSMLYESVADYGWGYTALSVFMFLLFTDFGIYWVHRIEHHPAIYKHIHKPHHKWIVPTPYAALAFHPLDGYAQSLPYHIFPFCFPLHKYVYLGLFVFVQFWTILIHDGDMITGHILERYINGPAHHTLHHLYFTCNYGQYFTWADQYFDSYRDPAPHLDPIHDSLKMMRKKGLIDEAGNAIPQAREGKKEQ

SEQ ID NO: 16795 - protein, 326 aa, Mycoplasma genitalium G37
MSKIQVNNIEALNNAMDLALERDQNVVLYGQDAGFEGGVFRATKGLQQKYGSERVWDCPIAENSMAGIGVGAAIGGLKPIVEIQFSGFSFPAMFQIFVHAARIRNRSRGVYTAPLVVRMPMGGGIKALEHHSETLEAIYAQIAGLKTVMPSNPYDTKGLFLAAIESPDPVIFFEPKKLYRAFRQEIPSDYYTVPIGEANLISEGSELTIVSYGPTMFDLINLVYSGELKDKGIELIDLRTISPWDKQTVFNSVKKTGRLLVVTEAVKSFTTSAEIITSVTEELFTYLKKAPQRVTGFDIVVPLARGEKYQFEINARVIDAVNQLLK

SEQ ID NO: 16796 - protein, 398 aa, Triticum aestivum
  misc_feature (77)..(77): Xaa can be any naturally occurring amino acid
  misc_feature (128)..(128): Xaa can be any naturally occurring amino acid
  misc_feature (234)..(234): Xaa can be any naturally occurring amino acid
  unsure (1)..(398): unsure at all Xaa locations
MDKEQQRHDELEAPLLPGDGGKAAATAGSAYALVCSLVASAISVIYGYNRGVMSGAQKFVQDDLGISDAQIEVLIGXTSIYSLVGSLARGLGVRLRGAPPALWALSAAMFFAGSAITSVAGGYAVLMXDSSVAGVACGFGLVVAPVYIAEMAPAASRGFLSSIPEIAGNAGILLSYIADFALAGFPNNVNWRLMIGVGAVPPLFLAVATLLAMPETPRWLVLHGHHDEARRVLXRTTGDAALADRRLKEIVSSAQESSKQAVPGGSDERTRSTSVWRDILIRPTRSVRRVLLAILGLQFFQQASGVAALVLYAPRVFHHAGVTSQSAVLGATILLGVAKIVAIVIPLFLADRLGRRPMLLTSAGGMTGSLLVLGFSLRASPTAHAGASAGWGAAQRAG

SEQ ID NO: 16797 - protein, 206 aa, Zea mays
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRERGSRYERGRDYGGGRAPRGGGGGGGGGGDCFKCGKPGHFARECPSGDGGRGDRYGGRDDRYGGGGGGGGGRYGSDRGGDRYSGRSRDGGSYGGGDRYSRDRSGPY

SEQ ID NO: 16798 - protein, 424 aa, Acinetobacter calcoaceticus subsp. anitratus
MSEATGKKAVLHLDGKEIELPIYSGTLGPDVIDVKDVLASGHFTFDPGFMATASCESKITFIDGDKGILLHRGYPIDQLATQADYLETCYLLLNGELPTAEQKVEFDAKVRAHTMVHDQVSRFFNGFRRDAHPMAIMVGVVGALSAFYHNNLDIEDINHREITAIRLIAKIPTLAAWSYKYTVGQPFIYPRNDLNYAENFLHMMFATPADRDYKVNPVLARAMDRIFTLHADHEQNASTSTVRLAGSTGANPYACISAGISALWGPAHGGANEAVLKMLDEIGSVENVAEFMEKVKRKEVKLMGFGHRVYKNFDPRAKVMKQTCDEVLEALGINDPQLALAMELERIALNDPYFVERKLYPNVDFYSGIILKAIGIPTEMFTVIFALARTVGWISHWLEMHSGPYKIGRPRQLYTGEVQRDIKR

SEQ ID NO: 16799 - protein, 594 aa, Frankia sp. CcI3
MCGLSGELRFDGRGANVDAVVRMTATMVPRGPDGVGVWSAGPVAFGHRRLKIIDLSECGAQPMVDNELGLTTVFNGCIYNYQELRDELIAAGYRFFSTSDTEVIGKAYHRWGRRCVDHFAGMFAFAIAERDSGRLILARDRLGIKPLYLTGNSERLRFASTLPALLAGGGVSSDIDLVAFHHYLSFHSVVPAPHTILAGVRKLPAATVRVVEPDGTSTDDLYWRPSFTRDPAHADWTARDWQDAIAERLRLAVRRRMVADVPVGVLLSGGLDSSLIVALLAEAGQKDLATFSVGFEAVGGEPGDEFVYSDVIARYFDTDHHQIRVPGTRLLPAVDAAVAAMSEPMVSHDCVAFYLLSQEVSRHVKVVQSGQGADEVFAGYSWYPPLAGVGRTDAVDAYLRVFADRPHRDLPAMVEPHHLIEADASRHFVASHFARPGAETAVDAALRIDSTIMLVDDPVKRVDNMTMAAGLEARTPFLDHELVELAAACPPELKLASGGKGVLKNIGRPLMPVDVIDRPKGYFPVPAIRHLDGPFLDRVREALTDPAAKARGLFRPVWVQTMLAAPNDNRTALGANALWQAALLEMWLQTHTVA

SEQ ID NO: 16800 - protein, 373 aa, Bacillus coagulans
MVNTNQFIPGLEGVIASETKISFLDTVNSEIVIKGYDLLALSKTKGYLDIVHLLLEGTIPNEAEKQHLEETLKQEYDVPDEIIQVLSLLPKTAHPMDALRTGVSVLASFDTELLNREHSTNLKRAYQLLGKIPNIVANSYHILHSEEPVQPLQDLSYSANFLYMITGKKPTELEEKIFDRSLVLYSEHELPNSTFTARVIASTLSDLYGALTGAVASLKGHLHGGANEAVMEMLQDAQTVEGFKHLLHDKLSKKEKIMGFGHRVYMKKMDPRAAMMKEALKELSAVNGDDLLLQMCEAGEQIMREEKGLFPNLDYYAAPVYWKLGIPIPLYTPIFFSSRTVGLCAHVMEQHENNRIFRPRVLYTGARNLRVED

SEQ ID NO: 16801 - protein, 515 aa, Bacillus thuringiensis serovar konkukian str. 97-27
MIILKKQHDTIIVLDFGSQYNQLIARRIREFGVYSELHPHTITAEEIKAMNPKGIIFSGGPNSVYGEGALHCDEKIFDLGLPIFGICYGMQLMTQQFGGTVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDAKERFMNKLKGVEDPEQKRKIIGNEFIYVFDDEASKLEGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEITKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 16802 - protein, 469 aa, Pseudomonas aeruginosa UCBPP-PA14
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIIGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVVFILGIMLMIPGINISVYAIPFWLLLMWLCYRVKLSLAERRGLGQQA

SEQ ID NO: 16803 - protein, 637 aa, Arabidopsis thaliana
MFGPTGGLGMNPSMDDMNLIQQAQRHQLVVSNLGEEIDLEIGPGEDDAAFANNSLIGGPPREPSTGEHDETKHMVLVSDLPSEDQDISKGTPAKRKKKVVKRWREEWADTYKWAYVDMKDGTARIFCSICREYGRKHRRNPYGNEGSRNMQMSALEEHNNSLLHKEALRLQTASKDKIVVDKPIYVKTVMSKSAGSIVEGALKRDPNEIEFVQSVQESVHALERVIAKNSHYVNIMERLLEPERMIVFRVPWIDDRGETHVNRGFRVQFNQALGPCRGGIRFHPSMNLSIAKFLGFQQTLKNALSPYKLGGASGGSDFDPKGKSDNEIMRFCQSFMNEMYRYMGPDKDLPSEEVGVGTREMGYLFGQYRRLAGQFQGSFTGPRIYWAASSLRTEASGYGVVYFARLILADMNKEIKGLRCVVSGCGKIAMHVVEKLIACGAHPVTVSDSKGYLVDDDGFDYMKLAFLRDIKSQQRSLRDYSKTYARAKYFDELKPWNERCDVAFPCASQNEVDQADAINLVNAGCRLLVEGSNMPCTAEAVDVFRKANVLIAPAIAAGAGGVAAGEIEVLRESNSMQWSAEDFESRLQEALKQTYEKALKAANDFGYQKESPEALLHGATIAAFLNIAQAMTDQGCV

SEQ ID NO: 16804 - protein, 425 aa, Leifsonia xyli subsp. xyli str. CTCB07
MALPWKLHGDGRAVDAHEIVLPGERLTWPRTIGLGAQHVVAMFGATFLVPLLTGFPPSTTLLFSGVGTILFLLITRNKLPSYLGSSFAFIVPIVAATKGHGMPSALFGIVATGVLLALVGLIVVATGTKWIDALMPPVVAGAIVALIGFNLAPAAKNNFVQAPVTALVTLTAVILCTVLFRGMLGRLSIFLGVAVGYVFAIIVGEVNFGKVASAQWIGLPQFALPANPFAETAATWGVLPAFLPVVLVLIAENVGHIRGVAQLTDPSVNRLTGRALMADGIATTVAGLFGGSGTTTYGENIGVMAATRVYSTAAYWVAGIVAVLLGLSPKVGAVINTIPAGVLGGVTTALYGLIGIIGVKICLDNKVDFSRPVNQFTAATALIIGIGDFTLNLGQLTFNGIALGALAAIVVYHVMNAIARVRETA

SEQ ID NO: 16805 - protein, 539 aa, Burkholderia mallei ATCC 23344
MHDKILILDFGSQVTQLIARRVREAHVYCEIHPNDVSDDFVREFAPKGVILSGSHASTYEDHQLRAPQAVWDLGVPVLGICYGMQTMAVQLGGKVEWSDHREFGYAEVRAHGRTRLLDGIQDFATPEGHGMLKVWMSHGDKVGEMPPGFALMASTPSCPIAGMADEARGYYAVQFHPEVTHTVQGRKLLERFVLDIAGAKPDWIMRDHIEEAVARIREQVGDEEVILGLSGGVDSSVAAALIHRAIGDQLTCVFVDHGLLRLNEGKMVLDMFEGRLHAKVVHVDASEQFLGHLAGVADPEHKRKIIGREFVEVFQAEAKKLTNAKWLAQGTIYPDVIESGGAKTKKATTIKSHHNVGGLPETLGLKLLEPLRDLFKDEVRELGVALGLPAEMVYRHPFPGPGLGVRILGEVKRDYAELLRRADAIFIEELRGTLATEQDAAAGLCEPSQVGKSWYDLTSQAFAVFLPVKSVGVMGDGRTYDYVAALRAVQTTDFMTAHWAHLPYALLGRASNRIINEVRGINRVVYDVSGKPPATIEWE

SEQ ID NO: 16806 - protein, 863 aa, Methanosarcina barkeri str. Fusaro
MESNKTTDLIRRAQRNKVTALRLSYKNLTSLPPEISELKNFTKLYISYNQLTSLPPEISELKNLKQLDISYNQLTSLPPDISKLKNLTQLNIRNNQLTSLPPGISKLKNLKQLDISENQLTSLPSGITELKDLTQLSISKNQLTSLPPEISKLKNLKQLSISRNQLTSLPPEILELKSLTQINIYENQLTSLPHEISELKSLTQLSISGNQLTSLPSEIANLESLTQLDISRNQLTSLPLEITELKNLTQLDISSNKLTSLPPEILKLGIDIEWGNNSAEKGIFLEGNPLEKPPIEIVKQGREAVINYFKSLEGEKKPLNEVKVLLVGDGEAGKTSLLKRLLGEGFDGNEHQTQGINIKKWGFKDKDKEIKVNFWDFGGQEIMHATHQFFLSKRSLYILVLDSRRDEKAEYWLKHIRSFGGDSPVLVALNKIDENPSFELNRKFLQEKYPSIKGFFRISCKEDRGIEGFSQKLKKELLKVEHMQIEWAKSWFEVKTKLEKMSCNFITYEEYRNICLEENVGDKSSQNTLVDFLNDLGVIVHFKDISLLDTHVLEPKWITEGVYKIINSEILAKKKGVLRFSMLDEILEQKKEGDYYYPPERYGYIINLMKKFELCYSIDEETVLLPDLLAVPEPNFDFDSNEALKFFIEYDFLPRSIMPRFIVKMHRDIKDDLQWRTGVVLENKQFNSCAVIKSDNEAKRIYINVNGCQKRDYFSSILFNLREINRSFEKLKAIEKIPLPDESEIAVSYEHLVNLEEMGIDLFVPEGSKKKYRVSDLLGTVNNLSKQEELLKEILNILKKNNEDEKLEEIFKFLKKIADESDNEETLFRKLNKVIMLKPSVAGCGVDFNEAINLFFKRKRQKY

SEQ ID NO: 16807 - protein, 828 aa, Oryza sativa (japonica cultivar-group)
MAEHKPLPGRPKREGEGASKRKAKSGGFESMGLCEEVYRGVRHKGYRVPTPIQRKAMPLILAGHDIAAMARTGSGKTAAFLVPMIQRLRRHDAGAGIRALILSPTRDLATQTLKFAQQLGKFTDLKISLIVGGDSMESQFEELAENPDIIIATPGRLVHHLAEVEDLNLRTVEYVVFDEADSLFSLGLIQQLHDILHKLSDTRQTLLFSATLPQALADFAKAGLRDPQIVRLDLDKKISPDLKLAFFTLRQEEKLAALLYLVRERISSEEQTIIFVSTKHHVEFLNILFREEGLEPSLSYGAMDQEARNIHISKFRARKTMILIVTDVAARGLDIPLLDNVVNWDFPAKPKLFVHRVGRVARQGRSGTAYTFVTSEDMAYLLDLHLFLSKPLRPAPTEEELLKDMEGMNLKIDRALANGETVYGRFPQTIIDLVSDGIKEVINGCTDLIALEKPCTNAFHLYLKTRPMPSTESIRRVKDLPREGLHPIFRDVLGSDELSALAFSERLKSFRPKQTILEAEGEAARGSNQWLDVMKKKREVHEGIINLVHQKNNVDHEPKEELVENISNWERKDVCGNKRKLQSFRDEEYYISSVPQNQHLEAGLSVRANEGFVENRLDAAVLDLVDDETSGMQAQKTRYHWKKNKFVKLNSGDRVTATGKIKTESGAKLKPTKTGIYKKWQQKTHRSIDTGRKFGGFAEEGASTTGSHQRGNRKHTAVGRGRRYIPNADVPSEIRNPEQIQKSRQQKAMDIARMKNRSTKESKFQKFQKNNRRHDGPLKDGKFQKNRRPDGNGKNRRPDGNGKGRGKGKGNANGFGKGKGKMKGKGTR

SEQ ID NO: 16808 - protein, 676 aa, Hordeum vulgare subsp. vulgare
MFPLGARQPPPSAMDNQQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQAQSSWTKRAVEIDSPQDMSPDQSADPPEGTCAHVNHPKSEICSNRWLPGTNNKKCQKPKETTNGDGFKGKELEIGAPGNLNTDDQSSPNESSVKPTDGRCEYLPQNNSSDTVMENLEEPIVRAADLIGSMAKNMDAQQAAARAIDAPNCSLQASEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHTANYGSNSFSNNNTNNGSTAATTAAAAAVHAETGGGVDKRSNMMNMKRERRVAAVNKFREKRKERNFGKKVRYQSRKRLAEQRPRVRWQFVRQPPAPATVER

SEQ ID NO: 16809 - protein, 451 aa, Silicibacter sp. TM1040
MSFDYDLFVIGGGSGGVRAARVAAAGGASVALAEEDRYGGTCVIRGCVPKKLMVFASEYSGMVEDGRAYGWDLENKGFDWDHFKQKLNTELDRLEGIYRNLLKNSGVESFDARAKLADAHTVELSDGTRKTAKHILIATGGRPWVPEFPGSELAITSNEMFHLEKLPESILIVGGGYIASEFAGIMNGLGVKTTQYYRGAQILRGFDDEARGLVAQEMIQSGIDLKLGTNVLEMRREGDKIWVKATNGDEGLFDQVMFATGRKPNADNLGLEELGIARGRGGEIEVDQYSQTAVPSVYAIGDVTDRVNLTPVAIREGMAFVETVFNGNPTSPDHDLIPTAIFTQPEMGTVGLSEEEAAKQETIEVYATSFKPMQQSFAGRAQRVLMKLIVSQATRKVLGCHIVAPGAGEMIQLAGIAVKMGATKEDFDRTVAVHPTMSEELVTLKTPVRTI

SEQ ID NO: 16810 - protein, 735 aa, Arabidopsis thaliana
  misc_feature (636)..(636): Xaa can be any naturally occurring amino acid
  unsure (1)..(735): unsure at all Xaa locations
MKGATLVALAATIGNFLQGWDNATIAGAMVYINKDLNLPTSVQGLVVAMSLIGATVITTCSGPISDWLGRRPMLILSSVMYFVCGLIMLWSPNVYVLCFARLLNGFGAGLAVTLVPVYISETAPPEIRGQLNTLPQFLGSGGMFLSYCMVFTMSLSDSPSWRAMLGVLSIPSLLYLFLTVFYLPESPRWLVSKGRMDEAKRVLQQLCGREDVTDEMALLVEGLDIGGEKTMEDLLVTLEDHEGDDTLETVDEDGQMRLYGTHENQSYLARPVPEQNSSLGLRSRHGSLANQSMILKDPLVNLFGSLHEKMPEAGGNTRSGIFPHFGSMFSTTADAPHGKPAHWEKDIESHYNKDNDDYATDDGAGDDDDSDNDLRSPLMSRQTTSMDKDMIPHPTSGSTLSMRRHSTLMQGNGESSMGIGGGWHMGYRYENDEYKRYYLKEDGAESRRGSIISIPGGPDGGGSYIHASALVSRSVLGPKSVHGSAMVPPEKIAASGPLWSALLEPGVKRALVVGVGIQILQQFSGINGVLYYTPQILERAGVDILLSSLGLSSISASFLISGLTTLLMLPAIVVAMRLMDVSGRRSLLLWTIPVLIVSLVVLVISELIHISKVVNAALSTGCVVLYFCFFVMGYGXPFQTSSVLKSSQQADRGLCIAICAMVFWIGDIIVTYSLPVLLSSIGLVGVFSIYAAVCVISWIFVYMKVPETKGMPLEVITDYFAFGAQAQASAPSKDI

SEQ ID NO: 16811 - protein, 358 aa, Mycoplasma genitalium G37
MAILIKNKVPTTLYQVYDNEGKLIDPNHKITLTDEQLKHAYYLMNLSRMMDKKMLVWQRAGKMLNFAPNLGEEALQVGMGLGLNENDWVCPTFRSGALMLYRGVKPEQLLLYWNGNEKGSQIDAKYKTLPINITIGAQYSHAAGLGYMLHYKKQPNVAVTMIGDGGTAEGEFYEAMNIASIHKWNTVFCINNNQFAISTRTKLESAVSDLSVKAIACGIPRVRVDGNDLIASYEAMQDAANYARGGNGPVLIEFFSYRQGPHTTSDDPSIYRTKQEEEEGMKSDPVKRLRNFLFDRSILNQAQEEEMFSKIEQEIQAAYEKMVLDTPVSVDEVFDYNYQELTPELVEQKQIAKKYFKD

SEQ ID NO: 16812 - protein, 261 aa, Triticum aestivum
  misc_feature (226)..(226): Xaa can be any naturally occurring amino acid
  misc_feature (231)..(231): Xaa can be any naturally occurring amino acid
  unsure (1)..(261): unsure at all Xaa locations
NKFVQKSRLVPVRNSRDIVDPRVRAEQARIAEEAGACAVMALERVPADIRAQGGVARMSDPGLIREIKRAVTIPVMAKARIGHFVEAQILESIGVDYVDESEVLTLADDAHHINKHNFRVPFVCGCRNLGEALRRIREGAAMIRTKGEAGTGNVIEAVRHVRSVMGDVRALRSMDDDEVFTYAKSIAAPYDLVMQTKQLGRLPVVQFAARGVATPGDAALLMQLGXNGVFXGSGVFQKGGYPCGPGAAPCWKGVLPSQEDP

SEQ ID NO: 16813 - protein, 576 aa, Cryptococcus neoformans var. neoformans JEC21
MTTASPFLFQSSLHDTGLIHEMLSNPLKFGAPVNKKSLGFEAGLFPSTFDLSWPEAIATAKRAAGLHNPSMACYANATLQVLLHTPPVLRIALTHDEGSCSQIKKKNFCMLCSLKHMAEGSHWSGRKAYAPGIHRSLSQIKKGFSKNRQEDTHEFFRFVTDALQNTALAKLPKCVLPYNHRKFAHTTSRDTPEKIKHTSWVYRIWGGRVRSRVVCSRCNNPSDTFDSFLDLSLDVNKQGKKSVLGMLAGFTKEDRLEGDNKYHCERCKRKANATKSFKIDQAPPILTLHLKRFSVNYNPYSGRARAEKFNQPIKFEQTLDIAPYMVDPASPGTKYRLFGVTCHRGTELRFGHYTSYVRGPSGQWFHADDDEVSPVQLEQVLNDKTAYLLSYIRVDNGNEGLCESPAVRDRVKGLVNGSAKGMRDDESESQSEAESSSHKSSSPIKRKSTYDPEDPPRMKIGAFVNNKAYAPSTNKSESPFSDGENKMPPELPKFGYKPKPTIRAPAPVEASSFYTSPVARPSNSLAGMSKKEKKKFKHKEKGKPRHSATPMPFAQGRVGNGRNRQPGVLSRMKGRA

SEQ ID NO: 16814 - protein, 180 aa, Mycoplasma genitalium G37
MDQNFKLLDQAIKRFENFPNQGTLFYDITPVFSNPQLFNFVLTQMAQFIKAINAEAIVCPEARGFIFGGALASKTQLPLVLVRKANKLPGQLISASYDLEYRKHAVLEMSTTSLIQANNAKRCVIVDDVLATAGTVAAIDQLLKQLNGETVGYCFLIELKKLNGKAKLQPNVVSKILLHY

SEQ ID NO: 16815 - protein, 720 aa, Mycoplasma genitalium G37
MATIQEIECDFLAKIAQKFTNAEIELINKAFYHAKTWHENQKRLSGEPFFIHPLRTALSLVEWNMDPITICAGLLHDIIEDTDQTEANIAMIFSKEIAELVTKVTKITNESKKQRHLKNKKENLNLKSFVNIAINSQQEINVMVLKLADRLDNIASIEFLPIEKQKVIAKETLELYAKIAGRIGMYPVKTKLADLSFKVLDLKNYDNTLSKINKQKVFYDNEWDNFKQQLKKILAQNQIEYQLESRIKGIYSTYKKLTVHEQNISKIHDLFAIRLITKSELDCYHILGLIHLNFLIDSKYFKDYIASPKQNLYQSIHTTVRLKGLNVEIQIRTQQMDNVSKFGLASHWIYKEQKEGLLAPALQLNYLVTKQKHSHDFLKRIFGTDIIKINVSASHEPNVIKQINVDSNNKLLDIAFENYPKQFAKLTKIEIDGVEINSFDTSVENEMLIEFYFGKNNNLKSKWIRYMNNPIYREKVKKSLAKLAKSGRYSELAFYEKELGEKQLKLASETEIQKRLNTLRIKKMSDYLALIECTNFTNDEHLLFLAKNNDKWNKLTKPLKFAFSKVVFHNSYFEQIEGIFITKIVIEPCCSKIPDMPEQVTGILTKNILSVHRYGCKNLQNKKQLKIIPLYWNIQQLKLKPRKFRSYININGVWSEKTINKICQTIINGDGYIEKIIPKINKQKDEFDLNITLFVNNYQQLLTLMDQITTKNISFSWKYL

SEQ ID NO: 16816 - protein, 297 aa, Rhodopseudomonas palustris CGA009
MMAAKTKFRGSFTALVTPFKNGALDEQAFRSLVNWQIEQGTHGLVPVGTTGESPTLSHEEHHKVVEWCIAEAKGRVPVIAGAGSNSTREAVELARHAEKAGADAVLVVTPYYNKPTQEGMYQHFKAVNDAIGIPIIIYNIPPRSVVDMSVDTMSRLYELDNIVGVKDATANLGRVSQQRHAMGPDFIQLSGEDMTALAYMAAGGHGCISVVSNIAPKLCSDLMGAVFAGDYPGALKIQDRLVPLHDAVFKEPGVAGAKHGLTLLGRIQEDVRLPLMTVTEPTGKAIRAAMVHAGVIN

SEQ ID NO: 16817 - protein, 414 aa, Arabidopsis thaliana
MATGPVVHPQPVRGDPIDLKNAAAKNRRALGDIGNVDSLIGVEGGKLNRPITRNFRAQLLENAQVAAAANKKAPILDGVTKKQEVVRAVQKKARGDKREPSKPIEVIVISPDTNEVAKAKENKKKVTYSSVLDARSKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLMDCSKLLAFIHSKAGESKLRGVLKKYSKLGRGAVALISPAKSLMSSAP

SEQ ID NO: 16818 - protein, 324 aa, Oryza sativa (japonica cultivar-group)
MVEAEATKGPHRDRLDDAAISRRRWRRAAVAGGGSGRADTADTPHASSVVPLLCYVLPSLSDPKLARVASSFLSTSDSARRAALALIVATASSPLEQWMKRFEEAERLVADVVERIAERESVSPSLPQELQRRTAEIRRKVAILETRLDMMQEDLSQLPNKQRISLKELNKLAAKHSTLSSKVKEVGAPFTRKRFSNRSDLLGPDDNHAKIDVSSIANMDNREIIELQRNVIKEQDDELDKLEETIVSTKHIALAINEELDLHTRLIDDLDEKTEETSNQLQRAQKKLKSVTTRMRKSASCSCLLLSVIAVVILVALLWALIMY

SEQ ID NO: 16819 - protein, 203 aa, Helianthus annuus
PYGFSVIEKFLAGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16820 - protein, 203 aa, Helianthus annuus
PYGFSVIEKFLTGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16821 - protein, 504 aa, Yersinia pestis CO92
MTDHSKKQTRVSLPHSVFSADWVRQNEAAAAAHFSLTLFDLMVRAGNAAFELAHKQYPIARHWLILCGHGNNGGDGYIVANRALAAGIDVTLIACPGNRPLPAEAKEAQSQWLAIGGVIHQPDTQWPQDIDLIIDGLLGIGLRAAPQGIYETLIDMANRHRAAKVALDIPSGLCADNGAALGSVLRADHTLTFVALKPGLLTGQARDWVGQLHYDDLGLATWLDTQSAQIERITADHLPQWLKPRRPCAHKGDYGRLLLVGGDRGFGGAIRMAGEAALRSGAGLVRVLTHFEHVAPILAARPELMVQALTAETLEQSMQWADVLVVGPGLGQSDWSRNALKRLQQSDKPTLWDADALNLLALNPHRRQNWVLTPHPGEAARLLGCRVVDIESDRLLSARNIVKQYGGVVVLKGAGTLIANEQGEMAIADVGNAGMASGGMGDILSGIIGGLIAQKLALYDAACAGCVVHGVAADKLAEVQGTRGLLATDLLPVIPKYINPELAK

SEQ ID NO: 16822 - protein, 180 aa, Brassica napus
SNPEIQSRLYDEIKSTVGDRAVEEKDVEKMVFLQAFVKEILRKHPPTYFTLTHTVTEPTTVAGYDVPAGINVEFYLPGINEDPKIWSNPKKFDPDRFVSGKEDADITGVTGVKMMPFGVGRRICPGLSMATVHVHLMLAKMVQEFEWSAYPAGSEIDFAGKLEFTVVMMKPLRAMVKPRV

SEQ ID NO: 16823 - protein, 418 aa, Ashbya gossypii ATCC 10895
MSIEEARKLAGRKDYAAAEAEYLALLNDAENQDKKRAQLQEQCILELGRMYAEAHDADKLAAFIPRSRDFMMQFAKSKTAKVLKTLIDQFDRIPDTLEKQIEVCKESIAFAQAEKRVFLKHSLSVRLATLYYQKGQYHDSLQLINELLKEFKKLDDKSSLVEVHLLESKVYHKLRNLAKSKAALTSARTSANSIYCPTLTMAELDLTSGILHCEDKDYKTAFSYFYESFEGFHNSADTSGKACQALKYMLLSKIMLSLIDEVNTILNAKYTKETYQSRGIDAMRAVADAYSHRSLLEFNTALKHYDRELMGDDLIRSHFNALYDTLLESNLCKIIEPFECVEVSHISKMIGLDPQQVEGKLSQMILDKVFYGVLDQGNGWLYVYTTPDQDATYDSSLELIVKLNTVVEQLFDKASVLN

SEQ ID NO: 16824 - protein, 832 aa, Thermococcus kodakarensis KOD1
MLFVVRPGRKKNELEAFFIENEPEKLSQMQNLKADRIYRFIMREGRLFKVLEGSQYRNPKEIEKLLRQSRIVLVNADEWEDYFKRRLQNKRVEKAELCRLCLLEGRITVLTEGNRIKYHNEYICERCAEDELKRELRFRFKSIAMFDQAKKLLERFRDLDKVLYAFDPRFDPTKHPEITKWDELKAKHVKVEKIKVDELPVPEKFKEVLKSEGVRELLPVQSLAVKNGLLDGENLLVVSATASGKTLIGELAGVPKAMQGKKLLFLVPLVALANQKYEDFKRRYSKLGLRVAIRVGMSRIKTKDELVVVDTGIDADIIVGTYEGIDYLLRAGRKIGNVGTIVIDEIHTLDDEERGPRLDGLIARLRKLYPKAQFIGLSATVGNPDELAKELGLKLVLYDERPVDLERHIIIVRNESEKWRHIANLCRAEAMRKSKQGYKGQSIVFTFSRKRTHELAAYLTSKGLKAKPYHSGLPYKQRKLTEMEFLAQRLDVVVTTAALGAGVDFPASQVIFESLAMGNKWLSVREFHQMLGRAGRPLYHEKGKVYLLVEPGRKYSAQMEGTEDEVAFKLLTAPIEPVQVEWSDELEQDNVLAHSCVFNRLDVIEEVQSMCLGANQSAEKVLEKLEEFDFVKMKRPIVEVTPYGRAVSMSFLLPKEATFIRGNLGKREARWIAVKLLPFENIYLSGTLQRELEGAVRGRLSANVFSPSFASILEELDKVIPELSPNAAERLFTIYQEFFMCPEEDCTEYAMERVSNLIIELRRSGKHPTQIAEHFRKVYGLIVYPGDVFTWLDGIVRKLEAIERIARVFRVRKTEEGAKILKREIEEGRMIR

SEQ ID NO: 16825 - protein, 312 aa, Oryza sativa (japonica cultivar-group)
MAIPKVDLRGLEPGTPGWEAARATVTASMVSHGCVVVAHGELGADLREALFGRAVREAFALPAEAKRRNVSTVGPYRGYIANIPGMDWESLRVHDADDAARVREFAGLLWPEGNPEFCETIVSFATKMRDLERTVERMTLEGLGVGEDHIASHLAAQDYGVRLSHYGPPPDASTAISLQAHRDDSMTTIIVQHEVEGLEVQAGDGSWHAIPPEPDTIAIVAGELFRVVTNGRVPASVHRVRTPSGRERYCVLVGSRSKDGAVLSAMDELVDGEHPLAYRPCKAEEFIQFRYSEEGRKFSDPLKAFCGVNATE

SEQ ID NO: 16826 - protein, 530 aa, Oryza sativa (japonica cultivar-group)
MAETKIEGPTIAVKLFVDKERSRVLFAESDKDFVDVLFGFLTLPLGTVVRLLGRQSQVGCLDELYKSVEDLSADYFHTKACKAMLMKPHNTAAEQCCLLKVKVDDTDQSAVYVCRDANCSANGDCGVTSVAGSVCKCGKVMEYIGEWPQDGGSTAAAGSDGGVFVKGCYKFIVTDDLHVAPASTSLMMSIFDKYGVRDPANLEQKILQLNAEKITCLLKRSLTSKQTLTGYYFDVPNPNDEANLYVLPESLYSEQDAEVDHKLNNMKIKVLQRKNNTSLLYAEVGEDFVDLLFGLLSIPLGSILKTYVPSGGSHKGEGYVKPGVQKFMVTDDLHILPLSLTSTLQVVSESKVQAKDLVEKEFTLTKIQVMELLRAVLVTRNTLSSVLLPPKKKKRLHLQSNSLGIPRGSEQGPAPPPPRHGAGADGACITLQYVPNVIIHNIHVHDCVPAGNANMRASPTHYGWRTRSDSDGISLYSARDVWVDHCALSRCADGLIDAIMGSTAITVSNSYFSHHNEVMLLGHSDEYLSD

SEQ ID NO: 16827 - protein, 360 aa, Oryza sativa (indica cultivar-group)
MAQPQRPLQVPDITKSTHSGGNTVLAYASSAMQGYRSTMEDAHATIENLDAPTNTSFFGVYDGHGGSAVARYCANHLHNKVLEQEDFSSNLANALRQSFFRMDEMLRNQAASKELTEYGSGNEYWRTAGRSWLRCAPCVQGPVYCGPLAEGCTACVVLIRNTQIVVGNAGDARCVISRNGQAIALSNDHKPNFPEETQRIVAAGGSVSFSRGSHRVNNGIAVSRAIGIAYMFVGGDLSYKNNKKLRPEQQLLTCSPEIRADQLTDDTEFLVIACDGVWDVLANQAVVDFVRLHLNNGVELSVICESLLQEAITRDPPSTDNMSVILVRFLHPEGNRGARAATSSTSTGTVPSRHSKSISL

SEQ ID NO: 16828 - protein, 548 aa, Marchantia polymorpha
MGNCVGGHSDRKNALNPNEPAATNVQRGTGAPQGSHGGSGAAGVSAQASHPAPLGGISAKQKPTLTGNVLGRPLEDVRSIYTLGRELGRGQFGVTHLCTHKVTGELLACKSIAKRKLTNKDDVEDVRREVQIMHHLEGQKNIVELKGAYEDKHNVHLVMELCAGGELFDRIIQRGHYSERAAAALCRTIVQVVQTCHSLGVMHRDLKPENFLLANKKEDAPLKATDFGLSVFFKPGEVFTDIVGSAYYVAPEVLRRNYGPEADVWSAGVILYILLCGVPPFWAETEQGIFDAVMHGHIDFTSDPWPSISQKAKDLVKRMLKQNPKERLTAHEVLSHPWISVDGEAPDKPLDNAVLSRLKQFTAMNKLKKLALKVIAESLSEEEIMGLKEMFKSMDTDNSGTITFEELKDGLQKQGSNLAESEVRQLMAAADVDGDGTIDYLEFITATMHLNKIDKEDHLYAAFQHFDGDNSGFITMEELEQALIKHGMGDPDTLKEIIREVDTDHDGRINYDEFVAMMRKGTPGHQEGHRRSISNMAPVGAPRQHHHK

SEQ ID NO: 16829 - protein, 548 aa, Marchantia polymorpha
MGNCVGGHSDRKNALNPNEPAATNVQRGTGAPQGSHGGSGAAGVSAQASHPAPLGGISAKQKPTLTGNVLGRPLEDVRSIYTLGRELGRGQFGVTHLCTHKVTGELLACKSIAKRKLTNKDDVEDVRREVQIMHHLEGQKNIVELKGAYEDKHNVHLVMELCAGGELFDRIIQRGHYSERAAAALCRTIVQVVQTCHSLGVMHRDLKPENFLLANKKEDAPLKATDFGLSVFFKPGEVFTDIVGSAYYVAPEVLRRNYGPEADVWSAGVILYILLCGVPPFWAETEQGIFDAVMHGHIDFTSDPWPSISQKAKDLVKRMLKQNPKERLTAHEVLSHPWISVDGEAPDKPLDNAVLSRLKQFTAMNKLKKLALKVIAESLSEEEIMGLKEMFKSMDTDNSGTITFEELKDGLQKQGSNLAESEVRQLMAAADVDGNGTIDYLEFITATMHLNKIEKEDHLYAAFQHFDEDSSGFITMEELEQALIKHGMGDPDTLKEIIREVDTDHDGRINYDEFVAMMRKGTPGHQEGHRRSISNMAPVGAPRQHHHK

SEQ ID NO: 16830 - protein, 42 aa, Petunia x hybrida
MTFMEVAKPKWYERALVIAVQGVFFNAYFAAYLISPKLAHRI

SEQ ID NO: 16831 - protein, 78 aa, Glycine max
  misc_feature (31)..(31): Xaa can be any naturally occurring amino acid
  unsure (1)..(78): unsure at all Xaa locations
MGELYALDFYGIIFDICIESFLFAMKASKVXWPDLFDVVDVTSENWVIDHMHTLRPVLDTWYGHCLLVRLVLESIAPT

SEQ ID NO: 16832 - protein, 101 aa, Bacillus anthracis str. Sterne
MKPNFSKGLLPAVVIEEGTKEVLMLAYMNEEAYEKTLKTKRTWFYSRSRRSLWNKGETSGHVQHVQSLYLDCDQDAIVVFVKQVGPACHTGEKTCFHYKII

SEQ ID NO: 16833 - protein, 42 aa, Petunia x hybrida
MTMVELVQPKWYERLLVLAVQGVFFNLYFVLYLVSPKLAHRI

SEQ ID NO: 16834 - protein, 220 aa, Arabidopsis thaliana
MATVKGLLKGLRYITQIFDEEKDKDMQIGFPTDVKHVAHIGSDGPATNVPSWMGDFKPQENENGQVVSRADANNNQIGEGVGLQELLPPTDKPKHKKTRRKSETVSQNGSLPRRNSSASASDMQPKNTRRHHRSRHGSIDSSNDPSVRRRRVVSVTTHDMEGSYPLSDSSTHSRKSTSRHRKPKGSGGGELSMKKTKGKTENPIVESVDTCNDNNISDKE

SEQ ID NO: 16835 - protein, 243 aa, Burkholderia mallei ATCC 23344
MNTRLAGAVLAALALIGPAAAQPLPLPAGLIDLGSLAGEQMLAESGARSAYASLGSHFVTQKTQSYCGVASLVMVLNALRVPAPAAAQYPPFHYFTQDNVLGDATERIRPRALIERHGMTLDQLGALANALGASGDVRHASDVSVDVFRADAIAHLGRPGRYVLVNYLRSRLGQQTGGHISPLGAYDAAADRFLILDVSRYKYPPVWVTTADLYAAMNTPDADSGGRSRGYVLIDGVVAGADS

SEQ ID NO: 16836 - protein, 282 aa, Aspergillus oryzae
MAPPERAGKSVFLGNIPYNLTEEQVKDILSSAGTVTKFRLMMNPETGKPKGYGFADFADADAAASAVRNLNDYEVMGRKIRVDWPHNNEKDSIPPDYSQTTQVPGQDGQMGAQQSSAPLPPLPPGVDLPPHLDCPNAISQTLSSLPPNQLLDVLSQMKSLVMADPARATELLRQAPQLAYAIFQALLLMNLVDYSTLGTVVEQAAQPQSAAAAPPAAQPFQPFSAVPGPVSTPPQPQQQMPGQDELLQQVLSMPQSAIDALPPMERSQIMLLRQQLMQGAMR

SEQ ID NO: 16837 - protein, 310 aa, Aspergillus oryzae
MARNPREQWERLQVILQNRGSRGGFGFGGFPSGGGRGGLGLSGALILLGVGGWAISNSLFNVDGGHRAIKYSRIGGVQKEIYSEGTHIRIPWIETPVIYDVRAKPRNIASLTGTKDLQMVNITCRVLSRPRVDALPQIYRTLGQDFDERVLPSIVNEVLKSVVAQFNASQLITQRENVARMVRDSLARRAARFNIALDDVSLTHLTFSPEFTAAVEAKQVAQQEAQRAAFLVDKARQEKQAFIVRAQGEARSAELIGDAIKKSKSYIELRKIENARQIAQILQENGGKNKLYLDSQGLGLNVNANVEDSK

SEQ ID NO: 16838 - protein, 203 aa, Helianthus annuus
PYGFSVIEKFLAGARSIDQHFHSASFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16839 - protein, 404 aa, Corynebacterium glutamicum
MSRQPLPWLLGPAFVAAVAYVDPGNVAANITAGAQYGYLLVWVLVVANVMAMLVQYLSAKLGLVTGYSLPELLGQRLPRGRRLMFWAQAETVAAATDLAEVIGGAIALHILFGLPLLIGGLLIGLVSMLLLAIQSRHGQHPFEFVIVGLLVIITAGFLTGMFIGTVSWGEALAGVIPRFEGTPTVVLAASMLGATVMPHAIYAHSSLARDRHGDTIAPEALPRLLRVTRWDVLLSLLVAGSVNIAMLLLAAGNLNGIPGTDSIEGAHAVITDTLGPVVGVAFGVGLLASGLASTSVGCYAGSTIMGGLLHRQIPQVVRRAVTLIPALIVIAAGVEPTWALVLSQVVLSLGIPFALIPLVVLSSDQTLMGGFAIRVPLQVASWVVVALIVSLNLALIGLLVTGRG

SEQ ID NO: 16840 - protein, 898 aa, Medicago truncatula
MGGSSADLHHHESDIELIAPENSTKLSTTESKSVTDVDHNIEEDADYVEVTMDIQGDSVALHSVKTVTESDMGEGEHEKQSLTGNKLEKKKSFGASVVQNATIRIKQLKRLASFSKPEPAKRLERTKSAVAHALTGLKFISKTDVGAGWSEVEKVFDKLTVTTDGYLPRTLFAKCIGLNEESKAYAEMLFDTLARQRGIQGGSINKIQFREFWDCISDQSFDTRLKIFFDMVDKDADGRITEEEIKNIICLSATANKLSNIQKQAEEYAALIMEELDPDDTGYILIGNLETLLLHGPEETTRGESKYLSQMLSQKLRPTFEGNPIKRWYRDTKYFFQDNWRRSWVFALWIGVMLGLFAFKFVQYRRRSAYKVMGHCVCMAKGAAETLKLNMAIILLPVCRNTITWLRNKTKLGAFVPFDDGLNFHKMIALAIAIGVGIHAIYHLACDFPRILHASNEKYKLIEPFFGEKPTNYWHFVKSWEGVTGILMVVLMAIAFTLANTRFRRNRTKLPKPFNKLTGFNAFWYSHHLFIIVYAMLIIHGTKLYLTKEWNHKTTWMYLAIPITIYGLERLIRALRSSIKSVRILKVAVYPGNVLAINMSKPQGFSYKSGQYMLVNCAAVSPLEWHPFSITSAPNDDYLSVHIKILGDWTRSLKTKFSQACQPAINGQSGLLRAECLKGDNSPSTFPKVLIDGPYGAPAQDYREYEVVLLVGLGIGATPMISILKDMVNNFKAMEEEDGFAMEEGSPMTPNQKDSRFSDFKTRRAYFYWVTREQGSFDWFKGVMNDVPEEDRRGLIELHSYCTSVYEQGDARSALIAMVQSINHAKHGVDVVSGTRVMSHFAKPNWRTVYKRIALNHPEAQVGVFYCGPSTLTHELRQLSLDFSHNTSTKFDFHKENF

SEQ ID NO: 16841 - protein, 179 aa, Ashbya gossypii ATCC 10895
MSEQNQTVVLVSVEGERFTVERKIAERSLLLKNYLNDMHDNAFRDESDDEADAADDDDRIVMPVPNVRSSVLQKVIEWAEHHRDSNFPDEEDDDSRKSAPVDAWDREFLKVDQEMLYEIILAANYLNIKPLLDAGCKVVAEMIRNRSPEEIRRTFNIVNDFTPEEEAAIRRENEWAEDR

SEQ ID NO: 16842 - protein, 408 aa, Oryza sativa (indica cultivar-group)
MASMAARSSRKRRSPPPRGLGDLHNDVLERVLARLPPATFFRLRAVCRRWSAAAASPTFLRACARVPSRDPWFLMLSGARPRPPLAFDAAGRSWIPCRAAPGGSCGGADAAVPVASSGGLVLYRAPGTGELLVANPLTGASRALPSPPGAHGGAPRLHAIAMYGSPYRVALFAGELPDLSMSVFDSSRGSWEGPVALSRRPDAAALLPDDAPSQGGADDTVYFLSKSGDVVATNMQRSASKQYSSVVFASSSDGGDAVAYFLSHSGTVVACDTARRTFAELPRILPVYFEYSIDVVACDGAAYAVVLAEYLDTASLRVWGFAGGAWRQVAAMPPAMSHAFHGKKADINCVGHGGRLMVCVSSGEANGCFMCDVGSNQWEELPKCVNGDGEVNDFLAAFSFEPRLEISV

SEQ ID NO: 16843 - protein, 504 aa, Acidovorax sp. JS42
MAERIHHLLDRWLAEAPARPFIHLPDGRSLSFADLGALTDTAEAELRALDVRPGDRVLVVAENCPEHAALILACSRVGAWSCGVNARMAPAEIDAFVGKADARVVFFTAAASRSAAAHAQRFAAVDSALPGMQHGAVLQDAQPEAGALRDTVASLIFTSGTTGQPKGVMLTHDALIHFARVSGASRALGPQDRSYAFVPMTHIFGLGTVLISSLLAAAQLVMRPQFDPDDLLDALVHHGVSQLQGPPALFSRLLAHLQERGIQRPEAPALRYLYTGAGPLDLALKQRVEAAFGQALHHGYGLSEYAGSVHLTRLGEQRPDTSAGYAVAEAEVRVTDPATGEPLPLGERGELWIRGRGLMPGYFRDPSATAAVMREGGWYASGDLGEMHADGALFVVGRLKEMIIRSGFNVYPAEVETALNTHPSVQRSAVVGRTVEDGNEEIVAFVELRPGAALDADAMQSHLRELLAPYKRPSYIVALSELPTNTNGKVLKRTLKDQALGLTT

SEQ ID NO: 16844 - protein, 531 aa, Xanthomonas oryzae pv. oryzae KACC10331
MFATSVKRFADRPAYHSFGKTITYREADQLVEQFAAYLLGELQLKKGDRVALMMPNCLQYPIATFGVLRAGLTVVNVNPLYTPRELKHQLIDSGASVLVVIDNFGTTVQQVIADTPVKQVITTGLGDMLGFPKAAVVNFVVNYVKKLVPDYRINGAIRFREALAQGRKHSMPTLQIEPDDIAFLQYTGGTTGVAKGAMLTHRNLVANMQQAHQWVGGTGQLLEGQEVVITALPLYHIFALTANGLVFMKVGGCNHLISNPRDMPGFVKELKKTRFTAFTGVNTLFNGLLNTPGFDQIDFSSLKMTLGGGMAVQRSVAERWKKVTGLTLVEAYGLTETSPAACINPMTLKDYNGSIGLPIPSTDACIKDDAGTALAIGEIGELCIKGPQVMKGYWKKADETAKVMDAEGWLHTGDIARMDEQGFVYIVDRKKDMILVSGFNVYPNEIEDVIATMPGVLEVAAVGMPDEKSGEIVKAVIVKKDPALTADDVKAHCRANLTGYKQPRVIEFRKELPKTNVGKILRRELRDAPKT

SEQ ID NO: 16845 - protein, 107 aa, Bacillus anthracis str. Sterne
MENTFKLLFETIEERKRNPLPESYTNYLFSKGEDKILKKIGEECTEVIIASKNNDKEELVKEMVDVLYHCFVLLAEKNIPLEDIMEEVTERNGKLSRVGDRREIDTL

SEQ ID NO: 16846 - protein, 42 aa, Petunia x hybrida
MTFMEVAKPKWYERALVFTVQGVFFNAYFATYLVSPKLAHRI

SEQ ID NO: 16847 - protein, 114 aa, Zea mays
MGDWVPRGRPGGRLRGRATRRTGRGKRGGRSRRRRFAAVWRSLHGRRSVAMETAHEVAIYIDRFHNLDLFQQGWYRVKISALWEDDENRAPISPARVTQYEGANSPFLMQIYKK

SEQ ID NO: 16848 - protein, 42 aa, Petunia x hybrida
MTFMEVAKPKWYERALVFTVQGVFFNAYFATYLLSPKLAHRI

SEQ ID NO: 16849 - protein, 294 aa, Petroselinum crispum
MDQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFAKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRITGTPNEDTWPGVTSLPDFKSAFPKWPSKELETVVPNLDSAGLNLLKKMLCLDPSRRITARIALEHEYFKDIGIVP

SEQ ID NO: 16850 - protein, 701 aa, Candidatus Pelagibacter ubique HTCC1002
MNSLIETILLFTIAAGSLSIVYGFFTGMNILNSSAGNAKMQEIASAIQIGAKAYLARQYKTIAVVGVVVLVIIFFVFSPLVGLGYFIGATLSGIAGYVGMLVSVQANVRTAEASRKGLASGLAVAFKSGAVTGMLVAGLALLAIAVYYYFLLKAGIDDREVINALVALGFGASLISIFARLGGGIFTKGADVGADLVGKVEAGIPEDDPRNPAVIADNVGDNVGDCAGMAADLFETYAVTIVATMVLSSIFFYGDINMMIYPLTIGGACILTSILGTFFVKLGKSKNVMNALYKGFVVSAVSSLIILYPVTDYVIGFASKYTVNGKSFTGMSLYYCGIIGLVITGLLIWITEYYTGTEYRPVRSIAKSSTTGHGTNVIQGLAVSMEATAVPALIIVAGILATNSIAGLYGIAISVTTMLALAGMVVALDAYGPVTDNAGGIAEMAKLPNSVRKTTDALDAVGNTTKAVTKGYAIGSAGLGALVLFAAYVEDIKHFSGVAGSKLEGIVVTFDLSNPYVVVGLLIGGMLPYLFGSMGMQAVGRAGGAVVVEVRRQFKKYPGIMKGKQKPDYAKLVDLLTLAAIREMIIPSLLPVLSPIILYFVILAIGGQVAALAAVGAMLLGVIITGLFVAVSMTAGGGAWDNAKKYIEDGNHGGKGSEAHKAAVTGDTVGDPYKDTAGPAVNPMIKITNIVALLLLAVIAG

SEQ ID NO: 16851 - protein, 42 aa, Petunia x hybrida
MTFIELSNPKWYERALVFAVQGVFFNAYFLAYLASPKLAHRI

SEQ ID NO: 16852 - protein, 444 aa, Glycine max
MATIVSIKARQIFDSRGNPTVEVDLTCSDGTFARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAASEFYKEDKTYDLNFKEDNNDGSQKISGDALKDLYKSFVTEYPIVSIEDPFDQDDWEHYAKLTAEVGTNVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 16853 - protein, 443 aa, Petroselinum crispum
MASIPVVQQNRVEAAGGGAVKQKNMAAVEGRNRRALGDIGNLVTGHGIEGKQQQIPQVSRPVTRGFCAQLLANAQAGVVENNKKQRAIVGDGVVAVRQKKVSVKPKPEDIIVISPDTEEADRVNKHLNRKKATEGSLKKKGQTFTSTLTARSKAAAFGLTRKPKEQIVDIDAADANNELAAVEYVEDMYKFYKLAEHESRVFDYIDFQPEINQKMRAILVDWLIEVHNKFELMPETLYLAINILDRYLSTESVARKELQLVGISSMLTASKYEEIWPPEVNDLTKISDNAYTNQQVLIMEKKILGQLEWNLTVPTPYVFLVRFIKASIPNEPAVENMACFLTELGMMNYATVTYCPSMVAASAVYGARCTLDKAPFWNETLKSHTGFSEEQLMECGRTLVRFHSCATENKLRVIYRKYSLDERGCVAMLPPAKALLTVAKPQT

SEQ ID NO: 16854 - protein, 457 aa, Rhodopseudomonas palustris CGA009
MDARSPQMTADPSPAPEQTTGWRLARGEPSLAGMFGSVPTRAKGPFWRKLIAFLGPGYLVAVGYMDPGNWATSLAGGSKYGYALLTVALVSNIMAVVLQSLCTRLGVGAGRDLAQACRDAYPKWVSWPLWLSAEIAITATDLAEVIGTAIGLNLLFGIPLEIGVLITAADVFLVLALQAFGFRWIEAFVVALLGVIAACFAIQIAMADPDWGAVIRGFAPTTRVLTEPGMLYLALGILGATVMPHNLYLHSGLVQTRGFGHSPAEKHEAIKLATFDSTIALTFALTINASILILAAATFHHAGKTDIAELDQAHAFLAPLLGSTLAPTLFGIALLACGLNSTITATLAGQIVMEGFIQIRIKPWLRRMVTRLIAIVPAVAVTIIAGEKGTGQLLILSQVVLSLQLPFAVVPLVVFTASRAKMGEFVAPRWLTAIASLIAAIIVALNIKLVFDYATGG

SEQ ID NO: 16855 - protein, 203 aa, Helianthus annuus
PYGFSVIEKFLTGARSIDQHFHSASFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16856 - protein, 313 aa, Pseudoalteromonas tunicata D2
MTIRTIPTLDISRFNSDKANFVAELGKGYREFGFCGIVGHGIDTELVAKAYDAIRTFFALPTDVKQQYSAANIGGARGYTGMGVEKAKDNPHPDLKEFWHVGRELAPEQLVEGLFPNVWPTEVPQFKADVYPLYQALDDLGRQVLSALALFLGQDEHYFDDKIDHGNSILRPLHYPPILQGETPAVRAGAHEDINFITLLVGSEEAGLEVLTRDGEYIPVTTIPGTIVVNIGDMLQRLTNNVLPSTTHRVVNPPGDGAKHSRFSVPFFLHPNPEFMIETLATCVTEDNPNRYPESISSNDYLTERLIEIGLIK

SEQ ID NO: 16857 - protein, 168 aa, Triticum aestivum
NQEEKFAANPPRPVHDDIVIAKLRPGQEMEMELHCQKGVGREHAKWSPVATASYRLLPEITILEPIIGEDAEEFKNCFVEGVIEVVEENGVKTAKVVNPRKDTVSREVLRHDKFANKVRLTRVRDHFIFKVETSGVIPAEQIFLSALDVFMEKIKDIQPLVDRVISNE

SEQ ID NO: 16858 - protein, 203 aa, Helianthus annuus
PYGFSFIEKFLAGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16859 - protein, 510 aa, Arabidopsis thaliana
MFEAGGLFGFTGTTMASLMFFWSVYRQFVPYQIRDYLEKCFYKMFGLVSNSVHIKFTEYTEDKGLKKSQAYDLIRNYLSSKSTARAQRLKANESKNSKSLVLSLDNHEAVEDVFQGVKVVWSLSVWKSNDQADSSEKRYLTLSFHNRYREMITTTYLDHVLREGKEIGLKNRERKLYTNNSSQDYSAWREGRWSNVPFDHPATFETLAMDLEKKEGMKKDLIKFTKGKDYYRKVGKPWKRGYLLFGPPGTGKSTMISAMANFLEYDVYDLELTTVKDNSELKKLMLDTKGKSIVVIEDIDCSLDLTGQRKKKKEEDEDEEEEEKKKEAEKLLKRERGERESKVTLSGLLNAIDGLWSACSGEKIIVFTTNYLDKLDPALIRRGRMDNHIEMSYCRFEAFKVLAKNYLEIESHDLFGEIKRLVEETDMSPADVAENLMPKSDEDDADICLTRLVKSLEEEKEKAKKLAEEEKMKKAARDARRIKKKAEEEHKKKNKVEENGDVSHDNGNHI

SEQ ID NO: 16860 - protein, 454 aa, Bacillus thuringiensis serovar konkukian str. 97-27
MNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFMIEEFKNFFISEVAPEMIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKTPDKTLTANLCTEANKRGLLLLSAGTYGNVIRVLMPLVITDEQLEEGLTIIEESLQICYEKANTAHV

SEQ ID NO: 16861 - protein, 203 aa, Helianthus annuus
PYGFSVIEKFLAGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIMKSQQPVYLKDEVVNNHDELMSNFFAQPDALAYGKTPEQLQSENVAPHLTFTGNRPSLSLLLPSLDAYRIGQLLAIYEHRI

SEQ ID NO: 16862 - protein, 350 aa, Corynebacterium glutamicum ATCC 13032
MSSGRTVPTRSHGLGKEGVSTTGASQVEFGDPELTARINDAMVQVEELLHTELSSGEDFLVDIVMHLTRAGGKRFRPMFALLASEFGEKPLSENVIKAAVVVEITHLATLYHDDVMDEASMRRGVPSANARWDNSVAILAGDILLAHASGLMSQLGTDTVAHFAETFGELVTGQMRETVGPRDTDPIEHYTNVIREKTGVLIASAGYLGAMHAGAAPEHIDALKNFGAAVGMIFQIVDDIIDIFSETHESGKTPGTDLREGVFTLPVLYALREDTPVGAELRDILTGPLEDDETVNHVLELLSQSGGRQAALDEVYRYMDIANAELDRLPDSTVKEALRNLATFTVKRVG

SEQ ID NO: 16863 - protein, 460 aa, Oryza sativa
MDGVPHQIRSDQISRSPSLLHTPTPAAAEQRAPPPPATMSSHHRYAHLLDDPFFPFPPPSSSSCPFLSPPAASSTCPFFALDSPFAADPFHLHPFLPTPPTSSLLDPFLLHTLTDRVSQLELALAARAPHPRPTSRKCTYVTESTGRKVKWTTEDKPRAGERVLKWEAELDSPYDDGFDRKWKWEAKAKTASAAATKLKWATHLKGKGCLEPWSHSYTWEEDFSATDDDDDEEIEDQLHHKALQDHSKLKTKAKDDKKKKKKDNNTVVVNKEQKKCPFSVKIEEIPPEEDNTAGCVAIRKAFALGNGKAKKKELSPQDAALLIQLNYRAHLAHRSQVLRCLRDLAVAKAKLKEIRSLFYNISYRHRMAHDHEERQRFTEKIIVLLLTVDALEGPDYMVRTAKKSMLDELEGMLEIVDPQPPGKQRSLTRRKFDLPEGGPITDEKMAGVNNAVKVIQKGKK

SEQ ID NO: 16864 - protein, 445 aa, Campylobacter jejuni RM1221
MRLFGTDGVRGKAGEFLDSFLAMRLAMAAGIYFKDKSITNNILVGKDTRRSGYMIENAIVSGLTSIGYNVIQIGPMPTPAIAFLTEDMRCDAGIMISASHNPYYDNGIKFFDAHGNKLSEDIEKKIEEIYFDDKLIQASKVDMEKIGQAKRIDDVIGRYIVSIKNSFPKDLTLKSLRVVLDVAHGAAYKVAPTVFKELGAEVIVMSDKPNGLNINENCGALHPVNLAAEVKRLRADVGFAFDGDADRLVVVDEKGEVANGDSLLGVLALYLKEQGKLQSSVVATIMSNGALKEFLNKHGIELDTCNVGDKYVLEKLKANGGNFGGEQSGHIIFSDYAKTGDGLIAALQFSALMLSKKKSASSILGQVKPYPQLLINLKIAEKKDLDKIKGLKELKKDLENKNINTLFRYSGTENLIRLLLEARDIKLLEKEMKNVVEFFKKALNG

SEQ ID NO: 16865 - protein, 910 aa, Aspergillus oryzae
MPRSVPSNFTSLSQEGGQAPSEDDRQRSLSRTAPPSPSAVRRQHSYLSEAHTGYQSLQPPLEIGETTSLLGKDRGNSRGVRRSYTNLSNGSGPDTSFRHNLLAGSFRRSRHHSRAHSQALRVSRRESIDTDRPESLAASAKDGLSSSFMDDRTWYDQFTSTDWVHDSIADGERLRQLRARKDVRGRLLAWFDGAQGWVLVALIGCITAAIAYFVDITEDFVFDLKEGFCTTRWFSSRQECCVDNPVCSAWWSWSKMLTFSSTDNQWTDFGMYVAWVVILSVISCFLTLLTKTVVPSSVSLTTLDENLGAASSQGTRHTDAAADSPNSDASPRTPFSAIPTRPDMVYYSAAGSGVAEVKVINSGFVLHGYLGFKTLVIKTVALIFSVSSGLSLGKEGPYVHIATCVGNICCRLFAKYNRNDGKRREVLSASAASGVAVAFGAPIGGVLFSLEEVSYYFPPKTLFRTFFCCIAATLSLKFLNPYGTGKIVLFEVRYLNDWEIFELVIFILLGVLGGALGALFIKASSLWARSFRRIPIIKRWPMLEVVLVAVVTGLVSFWNRYTKLAVSELLFELASPCDHESSSPTSLCPNEDGIVDIIRYLLVAFVIKSLLTIVTFGIKVPAGIYVPSMVVGGLLGRIVGHVAQYFVVKYPSFPLFGSSCPAVSGMESCVTPGVYAMIAAGATMCGVTRLSVTLAVILFELTGSLAHVLPFSLAILCAKWTADAIEPRSIYDLLTDMNSYPFLDNKIQVVSDAELGDLVRPVRKSRIIDISDSPFVPATELRSKLQTLLMAGELDSGLPILRHDVLSGLIPAPDLEYALDNLEDEENTLCLMTLDTMSVVSDSDDEEAIRVDFNRYIDPAPIALDIHSPVDLVYQCFAKLGLRYLCVLQNGQYAGLVHKKAFVKFMKENE

SEQ ID NO: 16866 - protein, 544 aa, Glycine max
  misc_feature (308)..(308): Xaa can be any naturally occurring amino acid
  unsure (1)..(544): unsure at all Xaa locations
IFPLLLVGYGFGASFVALFAQLGGGIYTKAADVGADLVGKVEQGIPEDDPRNPAVIADLVGDNVGDCAARGADLFESIAAEIISAMILGGTMAQRCKIADPSGFILFPLVVHSFDLIVSSAGIFSIRGTRETGIIVPMEDPMTILQKGYSFTIVLAVLAFGLSTRWLLYTEQAPSAWFNFALCGLIGIITAYIFVWIAKYYTDYKHEPVRILALSSSTGHGTNIIAGVSLGLESTALPVLVISVSIISAFWLGHTCGLVDETGNPTGGLFGTAVATMGMLSTAAYILTMDMFGPIADNAGGIVEMSQXGNTTKATTKGFAIGSAALASFLLFSAYMDEVSAFAHEPFKQVDIAIPEVFVGGLLGSMLIFVFSAWACSAVGRTAQEVVNEVRRQFIERPGIMDYKEKPDYGRCVAIVASASLREMIKPGALAIISPILVGIVFRILGYYTGQPLLGAKVVAALLMFATVTGILMALFLNTAGGAWDNAKKYIETGALGGKGSEAHKAAITGDTVGDPFKDTAGPSIHVLIKMLATITLVMAPVFL

SEQ ID NO: 16867 - protein, 434 aa, Acidovorax sp. JS42
MSNTPNPPLPTHALPSYLDPNHLGPWGVYLQQIDRVTPYLGSLARWVETLKRPKRALIVDVPIELDNGTIAHFEGYRVQHNVSRGPGKGGVRFHQDVTLSEVMALSAWMSIKNAAVNVPYGGAKGGIRVDPKTLSKAELERLTRRYTSEIGIIIGPSKDIPAPDVNTNAQVMAWMMDTYSMNVGTTATGVVTGKPVDLGGSLGRVEATGRGVFTVGVEAARLTGMAIEGARVAVQGFGNVGGTAGKLFAEAGAKVVAVQDHTGSIHNDKGLDVPALLAHVQRTGGVGGFAGAEPMANDAFWGVACDILIPAALESQITKDNAGRIQAKMVIEGANGPTTPEADDILNDKGVLVLPDVISNAGGVTVSYFEWVQDFSSFFWTEDEINARLVRIMKEAFAGVWQVAQENKVTLRTATFIVACKRILHAREMRGLYP

SEQ ID NO: 16868 - protein, 460 aa, Olea europaea
MAANVQTSSLLFLVFLLLQNFYSANSQSFLGVNYGQLSDNLPSLQATVNLLKSTTIQKVRLFGAEPAVIKAFANTGVEIVIGFDNGDIPTLASNPNVASQFVKSNVMSFYPASNIIAITVGNEVLTSGDQKLISQLLPAMQNVQNALNAASLGGKVKVSTVHAMAVLSQSYPPSSGVFNPGLGDTMKALLQFQSANDAPFMISPYPYFAYKNQPTPDTLAFCLFQPNAGQVDSGNGHKYTNMFDAQVDAVHSALNAMGFKDIEIVVAETGWPHGGDSNEVGPSLDNAKAYVGNLINHLKSKVGTPLMPGKSIDTYLFSLYDEDKKTGASSEKYFGLFKPDGSTTYDVGLLKNTQNPTTPATPTPTPKAAGSWCVPKPGVSDDQLTGNINYACGQGIDCGPIQPGGACFEPNTVKAHAAYVMNLYYQSAGRNSWNCDFSQTATLTNTNPSYGACNFPSGSN

SEQ ID NO: 16869 - protein, 597 aa, Aspergillus nidulans FGSC A4
MNCPSRTDDTLGHPGWNQNPPPLNADATTREDFNGMANSKVRRGHISGLGEGGGISVLESPVPVPNSRDESALKAGAAGGAVSAYSRHQPERNSDSPRRSFPAFPHISSIPARVSQSLLKFARFVGPGFLVAVAYIDPGNYATDVAAGADFRYALLFIVLLSNLFAIFLQSLCIKLGTVTGLNLAENCREHLPKWLTIILYIFAEAAIVATDIAEVVGSAISLNLLLNIPLVAGCAITLADVLFILIFYRPNGSMWGLRLFEFFVMALVLGVVICFCIQLSLIKEQSIGDVFRGYLPSPAVVQSNGLYQSCGILGATVMPHSMFLGSGIVQARLKEFDVISGYADPTVCIGSTNGEVEYRPSLRAIRGCMKYSIIELALSLFTFALFVNSSILIVAGASLYNTPSATDDADLFGIYNLLSSSISKAAGTVFALALLLSGLSAGIVCTMAGQMVSEGMLNWSIRPWLRRLITRSISIIPSIVIAGAVGKEGLNKTLTASQVVLSVILPFVSAPLVYFTCRNRYMTVPMERVHDADADIDTDEQTQPQNAAEGDDNGGSATDGVKMGNGLLVSAIAVLVWVIIAVMNVALLVLVGMGKA

SEQ ID NO: 16870 - protein, 350 aa, Glycine max
MSRAQDANRSFFPFGNPFRMISPKGPKISSQLLLILHAFEATLEERLKKLIPKSKDEILSLSWMTLAMQALCESHNDIKTLITELELPVHDWDEKWIDVYLDISVKLLDICIAFSSELSRLNQGHLLLHCALHNLGSSSSEQYVRACSSLDGWKQHIGSGNPRVEKCGSILDDLLRSLDLPKVKKSAKGKVLMQAMYGVKVQTVFLCSVFAAAFSGSTKNMSDLDVADVYSWAPTFKSLQDLVNGEIRVRSGRFTILNELEVVDSSVKELYPIIQGVSDAIETESLAKIVGELGRATEKLSQGLDLLTKEVDSFFQVVLTGRDALLSSLRSGATFIDSIQAGNRDAQIVN

SEQ ID NO: 16871 - protein, 379 aa, Pseudoalteromonas sp. SM9913
MSKRDYYEVLGVSKDASERDIKKAYKRLAMKYHPDRTAGDKDLETKFKEVKEAYEILTDAQKRQMYDQYGHAAFEQGGGGGHGGFGGGQGDFGDIFGDVFGDIFGGGGGRRQSRQQRGSDLRYNMDLSLEEAVRGKDVEIKVPTWVSCEPCDGSGAKAGSKPKTCTTCHGAGQVQMRQGFFAVQQTCPTCHGQGQIISDPCNKCHGQGRVEKTKTLSVKIPAGVDTGDRIRLSGEGEAGMHGAPAGDLYVQVSVREHKIFVREANNLYCEVPISFTTAGLGGEIEVPTLDGRAKLKIPSETQTGKMFRMRGKGVKSVRSGAQGDLICKVVIETPVNLNERQRDLLKELDESMGKDSSKNRPKEQGFFDGVKKFFDDLTK

SEQ ID NO: 16872 - protein, 539 aa, Zea mays
  misc_feature (78)..(78): Xaa can be any naturally occurring amino acid
  unsure (1)..(539): unsure at all Xaa locations
MPWTRTEGARVCYVVVAPASGGVSCSGWGNMMKQIFGRRKASKTADKEFTGGRTFSQLSGSGVADLSGQPPILSSTGXPYGSGNRTGFQDSRINDNLFSSNFRPLPSFKDVPNTEKQNLLIKKLDVCCTLFDFTDASKNMKEKEIKTLMLLEIDEYVRTANVKFPEIVVEAITKMISVNLFRTLISPPREKKALQAFDLEEDEPLMDPAWPHLYHVYELLLTFVQSPQNDAKLAKRYIDYSFILRLLDLFDSEDARERDRLKMVLHRIYGKFMVYRPFIRKAINNIFYQFIYETEKHNGIAELLEIFGSIINGFALPLKEEHKLFLVRTLIPLHKPRCTTMYHQQLSYCITQFVEKDCKLADSVIRGLIKYWPITNSTKEVLFLGELEEVLDATQPGEFQKCMVPLSHQIARCSNSPHFQVAERVLFFWNNTHFENLVKQNSKVILPIVFPALEKNINGHWNQVVRSLSLNVRKLFSDRDPQMFNECLRGYEEDKDREKEFRLKQELAWKRLDEIASAKVTSGEAVLVSPTLHRQPSVL

SEQ ID NO: 16873 - protein, 481 aa, Salmonella enterica subsp. enterica serovar Paratyphi A str.
MTIWENAMQYQLLINGVLVDGEGERQSVYNPATGEVILEIAEASPAQIDAAVQAAVNTFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWGNDSRYGLASSVWTQDVGRAHRLSARLQYGCTWINTHFMLVSEMPHGGQKQSGYGKDMSLYGLEDYTLVRHIMVKH

SEQ ID NO: 16874 - protein, 203 aa, Helianthus annuus
PYGFSVMKKFLTGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16875 - protein, 203 aa, Helianthus annuus
PYGFSVIEKFLAGARSIDQHFHSAPFESNISVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYKHRI

SEQ ID NO: 16876 - protein, 448 aa, Corynebacterium glutamicum ATCC 13032
MEDLSYRIPQSRTVAEQVPGPKSKALDERRQAAVARALAPGLPGYVVDADGGILADADGNRFIDLASGIAVTTVGGSNAAVAKAVGAAAARFTHTCFMVSPYETYVAMAERLNALTPGDHDKKSALFNSGAEAVENAVKVARAYTGKGAVVVFDNAYHGRTNLTMAMTAKNRPYKSGFGPLAADVYRAPMSYPLRDGLSGPEAAERAISVIESQVGAENLACVVIEPIQGEGGFIVPAPGFLAAISTWCRENDVVFIADEIQSGFLRTGDWFASDAEGVIPDVITTAKGIAGGMPLSAVTGRAEIMDAPGPGALGGTYGGNPVACAAALAAIEVMEQADLKTRAQEIETIIRDEFAQLSAFPEVAEIRGRGAMMAIELIDATGRPNAALTAAVAARAKAEGVLLLTCGTDGNVIRLLPPLVIAEDTLRDGLQVLVAALERETAHQKVG

SEQ ID NO: 16877 - protein, 444 aa, Geobacter sulfurreducens PCA
MIEELLVIFVLILGNGFFAGSELAIISARKGRIAQLVEAGDSRAQIVERLQNDPHRFLATVQVGVTVVGSLASAVGGAAAVQSVKPLLEAVPVDFIRHAAEPLAIGLAVVFISYLSLIFGELVPKTVGLQYADQMALRVAKPISSLAKVAGVVVSFLTISNKAVLAMMGIKAEGSQAFVTREEVQHIVAEGHEAGVFSATEQEYIRNIFDFTHTCVREVMVPRTRMVALDLARPRMELVREVLDNMYSRYPVYRESIENVVGFIHGKDLLGRTVTDPEFAMESIVRPPFYVPEGKKVNELLKEMQRLRIHMALVVDEYGGISGLVTTEDLLEELVGEIEDEHDIGEPGTVQRLPDGSLLVDALMSIGDLADLLKIKLEEDVPYDTLAGLILDQLGRFPERGETVEWDRFSLICEEVKQTAIVKVRIVENLPPQAGDEQYGTEHE

SEQ ID NO: 16878 - protein, 453 aa, Corynebacterium glutamicum ATCC 13032
MSLTFPVINPSDGSTITELENHDSTQWMSALSDAVAAGPSWAAKTPRERSVVLTAIFEALTERAQELAEIIHLEAGKSVAEALGEVAYGAEYFRWFAEEAVRLPGRYGQSPSGIGHIAVTRAPVGPVLAITPWNFPIAMATRKIAPALAAGCPVLVKPASETPLTMVKVGEIIASVFDTFNIPQGLVSIITTTRDAELSAELMADPRLAKVTFTGSTNVGRILVRQSADRLLRTSMELGGNAAFVIDEAADLDEAVSGAIAAKLRNAGQVCIAANRFLVHESRAAEFTSKLATAMQNTPIGPVISARQRDRIAALVDEAITDGARLIIGGEVPDGSGFFYPATILADVPAQSRIVHEEIFGPVATIATFTDLAEGVAQANSTEFGLAAYGFSNNVKATQYMAEHLEAGMVGINRGAISDPAAPFGGIGQSGFGREGGTEGIEEYLSVRYLALP

SEQ ID NO: 16879 - protein, 203 aa, Helianthus annuus
PYGFSVIEKFLSGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16880 - protein, 469 aa, Corynebacterium glutamicum
MTEHYDVVVLGAGPGGYVSAIRAAQLGKKVAVIEKQYWGGICLNVGCIPSKSLIKNAEVAHTFTHEKKTFGINGEVTFNYEDAHKRSRGVSDKIVGGVHYLMKKNKITEIHGLGNFKDAKTIEVTDGKDAGKTVTFDDCIIATGSVVNTLRGVEFSKNVVSFEEQILDPVAPKKMVIVGAGAIGMEFAYVLGNYGVDVTVIEFMDRVLPNEDAEVSKVIAKAYKKMGVKLLPGHATTAVRDNGDSVEVDYQKKGSDKTETLTVDRVMVSVGFRPRVEGFGLENTGVKLTERGAIDIDDYMRTNVPGIYAIGDVTAKLQLAHVAEAQGIVAAETIAGAETQALGDYMMMPRATFCNPQVASFGYTEEQAKQKWPDREIKVASFPFSANGKAVGLAETDGFAKIVADAEFGELLGGHLVGANASELINELVLAQNWDLTTEEISRSVHIHPTLSEAVKEAAHGISGHMINF

SEQ ID NO: 16881 - protein, 402 aa, Oryza sativa (japonica cultivar-group)
MPEPEVGVLGGRGLHRDGLKGWPDLRSLSGKKMTTPPPPPVEKQQQQARPAAVAPPDQTLEFSDGLLLRVLACLPEPHLTGAASLVCRRWMRLAGRLRRRLVVRDWAFVTHRLHHRFPELADLDLFPASIVAPAVPSPTSPLLTCAEVSLTLDTGADPPLVACRFLADDVLDRGLVAVAASFPNLRRLSATAASESGGLMDIAGGCATLQELELHRCTDLALRPVSAFAHLQILRLVAASSALYGTSEDGGVTDIGLTILAHGCKRLVKLELVGCEGSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCRYSNHQSHFSI

SEQ ID NO: 16882 - protein, 660 aa, Ashbya gossypii ATCC 10895
MRRSQDRSARRAGVLGVLARVPTLAAALPVAGRRAEVPSGEGQFWTFMAVSAVLVLLGGMFRGLPLGLMGQDKMYLKVTSTSGSRAERQHARKVLRLIGHGKHWVLVTLLLSNVITNETLPIVLDRCLGGGWQAVVMSTGLIVVFGEIIPQSVCVRYGLEVGAWCSPFVLCLMYLTYPVAYPIALLLDYLLGEDHGTVYKKSGLKTLVTLHKTMGVERLTQDEVTIISAVLDLKDKQVQEIMTPIENVFTISADRILDEKVVEEIFNSGFSRIPIYLPGQPTNFIGMLLVRVLISYDPADALPVSHFPLATLPETSPNTSCLNILNYFQEGKSHMCIVSRDPGSSSGALGVVTLEDVIEELIGEEIVDESDVFVNIHQRIVREQPGPLSRRHVTSYLHSLYTSTSRASAVAAAGARSEQAGPAEKQALLGAGPAEGRLHPAQDVIQPLNPAANPLNISNPHVTIKRQAAILQHADCPNRATADNSDENHALQSAHGSPQERGASCDYGGTSTTPSREHAAREVMVNEHSALATKALEHTYATGSTTHVVTTMEGGHSPSSGHLRGGLPRRVDALAPRPGAAKELPYRNAISSSYRSTKNGIVESIVTIEGVPKTIIEPAQDWDDSHSAAEFRLSSHRGLYLESTAKDSSEDPSESSSNAA

SEQ ID NO: 16883 - protein, 628 aa, Listeria innocua Clip11262
MPEKNIVLIGAGYAGVHAAKKLAKKYKKDKDVNITLIDRHSYHTMMTELHEVAGGRVEPTAIQYDLRRLFNRTKVNLVTDNVTHVDHDKKVVTTEHGSYPFDYLVLGMGGEPNDFGTPGVGENGFTLWSWEDSVKLRNHIEETVTKASREQDVEKRKAMLTFVVCGSGFTGIEMVGELLEWKDRLAKDNKIDASEIKLVVVEAAPTILNMLERRDADKAERYMVKKGIEIMKNAAIVEVKPESIVLKSGEELPTSTLIWTAGVRANSDTKDYGMESARAGRLKVNQYMEAEGLKDVYVVGDLAYFEDEDGKPTPQIVEGAEQTALTAAKSIIVEMSGTGEKEPFQGKYHGVMVSIGAKYGVAHLGGMHLSGWFAILMKHMVNLYYFFGIRSGYYMWQYIMHEFFHIKDHRNIFRGWTSRYGNVLWVLPLRVYLGWFWIDEALSKIYGETTWDKVSITNLKPLFNGIGSDSWLTATSSKMPFEWLQTAATSGASQAAGDAAGAAATNVTTPILSHMPGWFEWIMKLLMPNLDVALVMQKVVPFVELAIGLAMVVGLFTWLVSIGSAGFLVMFTLSAMLGWDKFWALPASIALLNGAGRTFGLDYWAVPWFQKHLGHWWYGKPRSVYRDK

SEQ ID NO: 16884 - protein, 437 aa, Exiguobacterium sibiricum 255-15
MYGSRYLTEQNNELQIDGVAVTELAKQYGTPLYVMAERELTDRLATVRDAFLKKYPNTYASFASKALTIGAVYQQVVRHGLGIDVVTGGELFIARKAGVPAERIYFHGSNKSTQDLQYAVKEGVGKIVIDHYGEIAQLNQIAGDTCQTVQVLIRIVPQVIGGAHTKIQTGGVDTKFGFSTHDDSYLQAVEAVLAAEHLVLLGIHCHVGSQIQEIELFERTARTMMGFVETIRERTSFVASEVNLGGGFGIAYTQDDQPLDFEQTMERVMAIIDEETTRLAIDRPRIGIEPGRWVVANAGTTLYTVGAIKEVQGVRTYLSVDGGMADNIRPALYGAVYETVIANRIKGETRHVTVVGAACESGDLVAESADLAEPVSGDTLAVFGTGAYNYSMASNYNQFLRPAVVFVNQGESREVVRRQTYADLIQCDLGLENIPSS

SEQ ID NO: 16885 - protein, 310 aa, Exiguobacterium sibiricum 255-15
MAVDTQYGEAIWLDGVFHDPKEANTSVMSHAIHYGSGFFEGIRAYATPDGPAIFQLTEHIERLFRSCAFYHVTIPYTVEELVQATIDLVAKNGFESCYIRPFVFLGTPWQALMAKDTTVHVGISCWELGEYFDKGAGIRAKVASYRRVSSTMMPMQAKAAANYMNSQLLKGEAQRDGFDEAIALDMNGNVSEASVANLFMLKNGTIYTPSLDCSVLDGITRQVIMRLAQDQGYPVVERHIGRDELYVADEIFLTGTAAEITSVGEIDHIVINGGTRTVADELLDLYRQTVSGQLPQYADWLTHVTPAVAE

SEQ ID NO: 16886 - protein, 322 aa, Cryptococcus neoformans var. neoformans JEC21
MPMSSIPTTGNRTKLASSLAAFLKEDGKDLHLGGDEDFHAERRKHTEILGIHRIQGALEVPIGEVQFTAIRGPHGCIPLRILKPSNPGDRALVYMHGGGYTVGCADDFERGLRVVAEESGFTVVIVEYRLAPEYKFPTQLDEYEAVVAWLQGEEGKKRGIKKVVGGGDSAGGNMTAALALRLHDQKKANLAAQLLLYPEARVPFDTKACAENNSGYYLEANGIFSFADHYLPRGVPPSDRYISPGMQDVGNLKDLPPTYVFTAGFDPLRDVGVEYAHKLQEAGNEVVWRHRPDLTHGFLQFGHWSEECEEATKEVGKTLKDL

SEQ ID NO: 16887 - protein, 293 aa, Exiguobacterium sibiricum 255-15
MFKGAGTALATPFTSTGELDLAVFEQLIEQQLAANIQALVVGGTTGEGSTLTNEEFETLLETAIRVTAGRVPVIAGTGTNNTAQTIEKTQTAARLGADAAMLVTPYYNKTSQAGLVAHFTAVADAVDLPIMLYNVPSRTGVAISVETAVTLAKHPNIQAFKEASGDVSFMGELMTALPDGFAVFCGNDDQILPYMAWGAQGVISVLSNPYPAETQALAEALLANDYTTARRIQSDLMPVISALFSDVNPIPVKAALEEIGLAVGAPRLPLVRQSEAGHAHLLETMRSYKGVVG

SEQ ID NO: 16888 - protein, 211 aa, Cryptococcus neoformans var. neoformans JEC21
MVPSRAAQMGQQSKSSLWTFLPILLFLPLLSSFLTQSYTFNLSPYVLPHLRNFWAETPLNIWRREMKEFTPLQLAMFDGSPDRPVYLAIDGIVYDVSANRRIYGKGGSYNMMAGRDASRAFITGCFETHLTHDIRGLSKEELASLEHWKSFFAKSDKYFKVGTVLNPPIDTESPIPPSCREDESASGADIHAPGEAAAKKGKIKPGPVHGQ

SEQ ID NO: 16889 - protein, 356 aa, Salmonella enterica subsp. enterica serovar Paratyphi A str.
MMDYARHEENRMKQQTNRNRRWVLASRPHGAPQMDNFRLEEDDVATPGEGQVLLRTVFLSLDPYMRGRMSDEPSYAPPVEPGCVMVGGTVSRVVASNHPDYRPDEWVLSYNGWQDYDISDGEGLVKLGDNPQHPSWSLGVLGMPGFTAYMGLLDIGQPKEGETLVVAAATGPVGATVGQIGKLKGCRVVGIAGGAEKCRHATDVLGFDLCLDHHADNFPQQLAQACPQGIDIYYENVGGKVFDAVLPLLNTSARIPLCGLVSGYNATTLPDGPDRLPLLMATLLKKRIRLQGFIINQDYGHRIHEFQQEMGRWIKEGKIHYREQITDGLENAPEAFIGLLAGKNFGKVVIRLADDA

SEQ ID NO: 16890 - protein, 391 aa, Pseudomonas syringae pv. tomato str. DC3000
MEQHCEVAVLGLGAMGAATVYQLAKAGVDVIGVDRYAPPHTQGSSHGDTRITRLSVGEGPQYLPLVRSSHRIWRELEALSGESLFEQCGVLVMTSSPSYDAADADDFTHKTIALARAYGVEHQVLMATAIRERFPQFAPVLDTAIGYFEPEGGFVRPERCIGVQLRLAAQHGARLLTHETVTHLQPYGEQVRITTEKGSIIADKVVVSAGMWSTELLGAPFSDLLRVCRQKLFWFERQQDAVFAPRSPSFIMIHGPGDADVSYGFPPLPGENSMKVATEQYIEDSAPNTLDRTVTASEEQDRFDTQIKGKIAGLSPHVVKSSVCAYTVTPDYHFIIDEHPYLKNVTVVSACSGHGFKHSAGLGLALAQRCIHGKSDVDLSAFSLARFSAAV

SEQ ID NO: 16891 - protein, 376 aa, Oryza sativa (japonica cultivar-group)
MDSSSGGAGGGGGAQIKGMGTHGGRYVLYNVYGNFFEVSSKYAPPIRPIGRGAYGIVCAAVNSENGEEVAIKKIGNAFDNHIDAKRTLREIKLLRHMDHENIIAIKDIIRPPRRDNFNDVYIVSELMDTDLHQIIRSNQPLTDDHCQYFLYQLLRGLKYVHSANVLHRDLKPSNLFLNANCDLKIADFGLARTTTETDLMTEYVVTRWYRAPELLLNCSQYTAAIDVWSVGCILGEIVTRQPLFPGRDYIQQLKLITELIGSPDDSSLGFLRSDNARRYMKQLPQYPRQDFRLRFRNMSAGAVDLLEKMLVFDPSRRITVDEALHHPYLASLHDINEEPTCPAPFSFDFEQPSFTEEHIKELIWRESLAFNPDPPY

SEQ ID NO: 16892 - protein, 85 aa, Glycine max
VNRAQARMYVICTGHKYMVGFPTRKTNNDITCIVSNGGRVQCMQVWPPFGKKKFETLSYLGDADDAQSLEELQFRFRNEGSLAWI

SEQ ID NO: 16893 - protein, 1075 aa, Ehrlichia ruminantium str. Gardel
MPKRTDIESILVIGAGPIVIGQGCEFDYSGTQACKTLKKEGYRIILINSNPATIMTDPEIADSTYIEPITTHILEKIIIKEKPSAILPTVGGQTALNAAISLCNAGILEQYNVKLIGATKEAIKKAEDRNLFRQAMDRIGAKYPKSIIIRSIDEINHALEYIGLPAIIRPSFTLGGIGGGISYNKEEFQKNIEYGLNISPISEVQVDESIIGWKEFEMEVMRDNKDNCIVVCSIENLDPMGVHTGDSITVAPALTLRDVEYQKMRDISFSILREIGVDTGGSNVQFAVNPKNNDILVIEMNPRVSRSSALASKATGYPIAKIAAKLAVGYSLNEIQNDCTQAIPASFEPSIDYIVTKIPRFNFDKFRGADKELSTCMKSVGEVMALGRSFPESLQKALCSLEIGCCGLNEFFDDNVEIDQIYNALVKLSPERIFIIADALRRNISIEEINKITGYDKWFLMQIQNIIHHEQDIKKYGLPKDAEKLLLLKKMGFSDERLAHLSNNTVEYIEHFRNSLCIKPVYKHIDTCAGEFETSTSYMYSCYEGNTFSKTECESFITNNKKVIILGSGPNRIGQGIEFDYTCVHAAHTIKDMGYESIMINCNPETVSTDYDTSSKLYFSPLTREHVLDIIYKEQETSSLLGVIVQFGGQTPLKLAKVLHQKNIRILGTSFDSIDLAEDRMKFQQLLMQLNIKQPPNITCNSKDELLKNIETLDFPILVRPSYVLGGQSMSIIRDNNALLNYLTIHKNIFDHGSLLLDQFLTNAVEVDVDAICDGKDTYIAGIMEHIEEAGVHSGDSACSLPAYTLTKETIDTIASYTKKISLALNVQGFINIQYAIHNNEIYILEVNPRASRTVPFIAKATGIPIAKIATEILLGKKLPKNLERKFNHVAVKEAVFSFSRFPNIDVLLGPEMKSTGEVMGIDQSFEIAFAKAQMAAGYELPIEGAAFISVKDSDKPLILETAKILKDIGFTIFSTTGTSIFLNKAGIITQHVNKVREGRPHILDLLQDGKINLVINTSEGIKSFSESSSIRKTALIKKIPYSTTIPGAKAIALAIRTLKKQGVQVIPMQEYIIQ

SEQ ID NO: 16894 - protein, 310 aa, Glycine max
LEHAISIAVQAGCSVDPVNYFGNEHISSMIQPNKQSKEMEDISKQRLQISLNYNVHQDDADQLASIPNPNPVSTGLRLSYDDDERNSSVTSASGSMSATPSIILSFGDNIRTELDRQLKWLDHYFYTQKEQLSKGVRDMKQKHVAALLTSIEKGINTKLKEKDVEIENMNRKNRELAERIKQVAVEAQSWHYRAKYNESVVNTLRNNLQQAISQGAEQGKEGFGESEVDDDASYIDPNNFLNIPAAPINSTHKSYQDMENLTCRACKTKTVSMLLMPCRHLCLCKDCEGFINVCPVCQLIKTASVEVYLS

SEQ ID NO: 16895 - protein, 706 aa, Rhodopseudomonas palustris CGA009
MTALWVIVLCGALSIVYAIWATSSVLAADQGNARMQEIAGAVREGAQAYLKRQYMTIAIVGVVIFALLAYFLGILVAIGFAIGAILSGAAGFIGMNVSVRANVRTAQAATTSLAGGLELAFKAGAITGLLVAGLALLGVTLYFIYLIHFAGLQANSRTVVDALVALGFGASLISIFARLGGGIFTKGADVGGDLVGKVEAGIPEDDPRNPATIADNVGDNVGDCAGMAADLFETYAVTAVATMVLAAIFFGSATPDQLQSVMTLPLAIGGICILTSIAGTFFVKLGASQSIMGALYKGLIATGVLSLVGVGVVIHQLIGFGPLPGVSYTGLALFECGIVGLAVTGLIIWITEYYTGTDFRPVKSIAQASVTGHGTNVIQGLAISMESTALPAIVIIAGILITYSLAGLFGIAIATTTMLALAGMIVALDAFGPVTDNAGGIAEMAGLPKEVRKSTDALDAVGNTTKAVTKGYAIGSAGLGALVLFAAYNEDLKFFIAQKSPYFVGVAPDFSLNNPYVVVGLLFGGLLPYLFGAMGMTAVGRAAGAIVEEVRRQFREKPGIMKGTDKPDYGKAVDLLTKAAIKEMIIPSLLPVLSPIFVYFAIYAIAGGGAAGKSAAFSAVGAMLLGVIVTGLFVAISMTSGGGAWDNAKKYIEDGHHGGKGSDAHKAAVTGDTVGDPYKDTAGPAVNPMIKITNIVALLLLAILAH

SEQ ID NO: 16896 - protein, 203 aa, Helianthus annuus
PYGFSVIEKFLAGARSIDQHFHMAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16897 - protein, 374 aa, Aspergillus nidulans FGSC A4
MYSKFWPAGGLPGILHHFTETLVTFEFTTSATPKPHSLLFVGGLGDGLATTSYMADLAKALHSTDWSLFTLNLTSSYSAWGLGHLDRDTDEIAQCLNYIRDYKSGKFASTNNSGFKGHSNSKVVLMGHSTGSQCVIHYLSKPNPHTSTKAFDSDLQHILRTRLDGAIMQAPVSDREAIQYVLSTGWMGRTSSQVTAIYKELEKLAQDEVARNPDPQFDALLPLHMTGVIGYPGNVPLSARRFLSLVSPGTPNGSPGEDDLFSSDLSDESLKKTFGMIRERGLLASKLMVLISGADQAMPGWIDKEALLRRWRGFIDGERKDGEEEIWHEDSGLIPGASHALSNDDQAEPRRNLVERVMRYLKGGWRLEAYRLRN

SEQ ID NO: 16898 - protein, 260 aa, Azoarcus sp. BH72
MIGRPLNPPLTDWRGRRVWLVGASTGIGAALARALAARGAQLALSARHPDKLAEAAAACPDALLLPLDLSHENQFAAVHQRLLAQWGAIDVVMFVAGTYRPLRAWELDAAAVYETMAVNLTGTLCGVATVLPPMLARGAGSIVLVASVAGYRGLPRALLYGSSKAALINFAETLYLDLAPRGLGVYLVDPGFVATPLTAANDFRMPALIDADTAAREILTGMARGEFEIHFPKRFTRVMKALALLPRRCYFPLIRRITGA

SEQ ID NO: 16899 - protein, 386 aa, Glycine max
  misc_feature (78)..(78): Xaa can be any naturally occurring amino acid
  unsure (1)..(386): unsure at all Xaa locations
MEHKLATTEGQPIRCKAAVCRKAGEPLGIEEIMVAPPMPGEARIRIICSSLCRTDISFRNMQGPPANFPTILGHEAIXVVESVGEDVTEVAKGDMVVPIFIAECGECIDCKSSKSNLCSKFPFKVSPWMPRHATSRFTDLKGEIIHHFLSVSSFSEYTVVDIAHLIKIDPEIPPNRACLLSCGVSTGVGAAWRTAGVEPGSTVAIFGLGSIGLAVAEGARLCGATRIIGVDVNPEKYEIGKKFGLTDFVHSGECENKSASQVIIEMTDGGADYCFECVGNASLMHEAYASCRKGWGKTIVLGSDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 16900 - protein, 237 aa, Lolium perenne
MCPIKEEMGGESGSPCSGDYYSPSTSSELQQVHSQNQTPWTKRPAGRTKFRETRHPVYRGVRRRGNAGRWVCEVRVPGRRGSRLWVGTFDTAEIAARAHDAAMLALAAGDSCLNFADSAELLAVSASSYRSLDEVRHAVTEAVDEFERHHALGEEDALSGTSASTPSSSSSVTDDETSSSWAADSPFELEVMGDMGRDLYYSSLAQGMLMAPPTAAAALGDYGEANLADVALWSYQS

SEQ ID NO: 16901 - protein, 326 aa, Listeria innocua Clip11262
MQLHAMWDDYPALSKDLQEVLQTIESNIQIRDKHVEKNVKDLIHAGGKLLRPAFALLSAQAGPEFDKERAVSIAAALEVLHMATLIHDDVVDDSPLRRGIPTIHSKYGRNYAVYTGDYLFCICFKILSAHASSVENIEFNSKNIEKILMGELDQMRTSYKMDVTVREYLSRISGKTAQLFALSCYSGATGSKAPRMTVAKCYNIGHYLGMAFQIIDDVLDYTSTDEGLGKPVLNDMKQGIYSLPLIYAMKGHLAEFEPLLSQKLDMTDDASEQVLALISKYKGVEQAFKLASKYTNKALREIKKLPAGAYRDDMYRLTKSILDRDI

SEQ ID NO: 16902 - protein, 473 aa, Aspergillus oryzae
MAASNDVRGWIMSGVSGVACILGSAVICVDVLLRHFSRGKGFQIVNNNAFLSASLCLSAGVMLFTSLYSMLPTSKEYLTRAGWSPAAAAYSLIGLFLAGVIVIRFLSALLHRYIPSHIVGCAHSHEPDANSADPERGHGHHHAHHSEDHHGWTERTPLLARASKSSPAAPHAGSEAHSHSAVFPAGTWRVRLGRRLSRMVGVKTQCDKDGPCYGFSQTCGAECSKTLIAPEVSVADDTGVHTIPVSVDIERVDVPEEDLSVSNHTHHKLGDSSSSTPRNEMSEYLTSSAGDADGTLKTQVPGSQHHHHVPQNAFLSIGLQTSIAIALHKLPEGFITYATNHASPKLGLTVFLALFIHNISEGFAMALPLYLALQSRGKAIFWSSLLGGVSQPAGAGLAVLWIWGAGRTGSPGDDADSSWAVYGGMFAATAGVMTSVALQLFSEGLGLTHNRGMSIGFAIAGMGIMGLSFALTA

SEQ ID NO: 16903 - protein, 908 aa, Prochlorococcus marinus subsp. pastoris str. CCMP1986
MLNLEEYFPFPLDPFQIEAIKAINSGNSVVLTAPTGSGKTLIGEFAIYRGLSHESRVFYTTPLKALSNQKFRDFINQFGEKKVGLLTGDISINRDAPILVMTTEIFRNMLYGEFEEFDDPLVNLESVILDECHYMNDPQRGTVWEETIIHCPSRAQIIALSATISNADQLQNWIEKVHGPTVLVNSNKRPVPLDFIFCSAKGLHPLLNNKGNGIHPNCKIWRAPKGQKKKGKVGRIMQPKAPPIAFVVSKLAERNMLPAIYFIFSRRGCDKAVEYIKDLSLVSYSEANLISQRLDVYLKNNEEGIKDKFHCEALKRGIASHHAGLLPAWKELVEELFQQGLIKVVFATETLAAGINMPARTTVISTLSKRTDEGHRLLFSSEFLQMSGRAGRRGKDLQGYVVTLQTRFEGAKEASSLAISEPNPLVSQFTPSYGMVLNLLQNYSLDKSRELIKRSFGSFLYLGESSEETAILYNLGRDLKELKKITSNISWQDFDSYEKLKSRLKEERRLLRILEKQAAEKLSEEITSALTFIKDGSLISIKAPQINRKVVPALICKKIYESKKIKSLLCLTIDNLFILIKPSYIVNIFPDLEEIEILRLEEPKMNFSGEVVRGDNESQTFVDRIFDISEKYDLRTPQYDLSTEVLAQKKLITNLEETITNQPAHKFGDSKKLKRYRKRIIEIEQEIVMKNNLMEEKENHNWIKFTDLIKILNHFGCLNDLELTEVGQSVGAIRSENELWVGLVLLSGYLDDLAPPDLAAIIQAICVDVRRPNLWCNFKPSIKVIDVFNELESLRKLVASKQNKFNINTPIFLETELTGIISEWARGKKWKELIFNTSLDEGDVVRILRRSMDVLSQIQYCVGVSNKLKNKAKLALKAINRFPVSESNDLLKVSDNINPATKRIDNNS

SEQ ID NO: 16904 - protein, 108 aa, Triticum aestivum
CVQLGGKGANLAEMASIGLSVPPGFTVSTEACEQYQAAGRALPPGLWEETLEGLRWVEEYMGARLGDPARPLLLSVRSGAAVSMPGMMDTVLNLGLNDEVAAGLAAKN

SEQ ID NO: 16905 - protein, 569 aa, Zea mays
  misc_feature (51)..(51): Xaa can be any naturally occurring amino acid
  unsure (1)..(569): unsure at all Xaa locations
ISSIPTKPVEGQKTGTSGLRKKVKVFQQENYLANWIQIISPIDLSIFCGFXALFNSLPPEDYVGATLVLGGDGRYFNKEAAQIIIKIAAGNGVQKIIVGRNGLLSTPAVSAVIRKRKANGGFIMSASHNPGGPDNDWGIKFNYSSGQPAPETITDQIYGNTLSISEIKTADIPDTDLSSVGVVSYGDFAIEVIDPVSDYLELMENVFDFQLIKDLLSRPDFRFIFDAMHAITGAYAGPIFVEKLGADPDCILNGVPLEDFGNGHPDPNLTYAKELVFTMFGTHAPDFGAASDGDGDRNMILGKRFFITPSDSVAIIAANAQTAIPYFQFGTKGLARSMPTSGALDRVAEKLNVPFFEVPTGWKFFGNLMDAGKLSICGEESFGTGSDHIREKDGIWAVLAWLSILAHRNKDKKVGERLVSVEDIAMEHWKTYGRNFFSRYDYEACESHSANQMMDHLRDVMANSKPGEKYGNYTLQFADDFSYTDPVDGSTVSKQGLRFVFTDGSRIIFRLSGTGSAGATIRLYIEQFESDISKHSLDAQTALKPLIDLALSVSKLKDFTGREKPTVIT

SEQ ID NO: 16906 - protein, 334 aa, Zea mays
MAPPHSHRSFRGWQNASHVALVLVLVSVLFLSKARPSAGARSLLELYKPPASALLTYHNGAVLQGRIPVTILWYGRFTPAQKAVVTDFLQSLTTTATSPTAPPSPSVSQWWGTIDQLYLSKARSGGGSDDGSAQVALVGQAADEGCSLGKRLALSQLPQLAARAGPAAKGGVALVLTAQDVAVDGFCTSRCGLHGSDAGAGAAYVWVGNAETQCPGQCAWPFHQPLYGPQAPALVPPSGDVGMDGMVVNIASMVAGAVTNPFRDGFYQGDKDAPLEAATACTGVYGSGAYPGFAGNLAVDGTTGASYNANGANGRKYLLPALFDPATSTCSTLV

SEQ ID NO: 16907 - protein, 462 aa, Cryptococcus neoformans var. neoformans B-3501A
MHPQNSSTPSTNSPSTFSLPKSSISRKKPPGLDISKSILRPTRTAPVLPANGSSPSNFVSEADRLRDDIANLQLSSRSTGSNHSPEALDSPRAFQSDSSVASGLAKKEKSRDGKERGDKEKRKKKHKDKDGEDLVKDEDLEILHDLGAGNGGTVTKVWNKKRKCVMARKLILVDAKPSIRKQILRELQIMNDCDSPYIVGYYGCFPVDVHVGIVMEFMDAGSLDYIYRHHGAIDIDIVGKVAQAVLEGLIYLYDKHRIIHRDIKPSNVLANTRGEIKICDFGVSGELINSIANTFVGTSTYMSPERIQGAPYTIKSDIWSLGISLIELAVGRFPFSDSPDSEELSPSVSDFDPDPTLPRSVRRPKIESNSRHNGVSQSGGPHAMSILDLLQHIVNEPAPRLASRRRRFPQEAVAFVEGCLIKDPDQRRSPKELLSSSWITSLKTTKEDLQTWARSMVGPREE

SEQ ID NO: 16908 - protein, 291 aa, Triticum aestivum
YGEQPRNRLDLYIPKDNRRPCPVVAFVTGGAWIIGYKAWGALLGRRLAERGIIVACIDYRNFPQGTISDMVSDASQGISFERSKTARNGGEPSRIYLMGQSAGAHISACALMEQAVKESSGQPISWSVTQIKAYFGLSGGYNIHNLVDHFHQRGLNRSIFLSIMEGEEALSRYSPEIVVKESSTRTIALLPRIFLMHGTDDYSIPSSASRTFVDVLQQVGAQATLLLYEGKTHTDIFIQDPLRGGRDPLVEDVFSIIYADDATRQNTASAPTPRRLVFEWQLQLARWISPF

SEQ ID NO: 16909 - protein, 510 aa, Vibrio fischeri ES114
MSAKKPMALVILDGYGHRETQADNAITNANTPVLDGLMANQPNTLISASGMDVGLPDGQMGNSEVGHTNIGAGRVVYQDLTRITKAISDGEFQQNETLVNAIDKAVKAGKAVHIMGLMSPGGVHSHEDHIYAAVEMAAARGAEKIYLHCFLDGRDTPPRSAENSLKNFQELFAKLGKGRIASLVGRYYAMDRDNNWERVQKAYDLMTEAKAEFTFATAVEGLEAAYAREENDEFVQATEIKAEGEESAAIVDGDAVIFMNYRADRARQITRTFVPSFDGFTRNVFPAIDFVMLTQYAADIPLLCAFAPASLENTYGEWLSKEGKTQLRISETEKYAHVTFFFNGGIEDEFEGEERQLVASPKVATYDLQPEMSAPELTEKLVAAIKSGKYDAIVCNFPNCDMVGHTGVYDAAVKAVESLDECIGKVVEAIKEVDGQLLITADHGNAEMMIDPETGGVHTAHTNLPVPLIYVGSKAVEFKEGGKLSDLAPTMLALTDTAIPAEMSGEVLFK

SEQ ID NO: 16910 - protein, 790 aa, Triticum aestivum
MTMMAMAKAPCLCARPSLAARARRPGPGPAPRLRRWRPNATAGKGVGEVCAAVVEAATKAEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLADLVTYNNKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLHRFCCLMTKFRKECEGLGLEDFPTAERLQWHGHQPGKPDWSENSRFVAFSMKDERQGEIYVAFNTSHLPAVVELPERAGRRWEPVVDTGKPAPYDFLTDDLPDRALTIHQFSHFLNSNLYPMLSYSSVILVLRPDV

SEQ ID NO: 16911 - protein, 125 aa, Chlamydophila pneumoniae AR39
MPTCFAVNVTRSRDHMTVFKQIIDGLIDCEKVFENENFIAIKDRFPQAPVHLLIIPKKPIPRFQDIPGDEMILMAEAGKIVQELAAEFGIADGYRVVINNGAEGGQAVFHLHIHLLGGRPLGAIA

SEQ ID NO: 16912 - protein, 638 aa, Coprinopsis cinerea okayama7#130
MSASSQRQRGGSPATLASFPQNESATSPLLPMLLRQSGTLKQVTDPAQTTDAAVEDGFVTRVMDSNDLERERGITILSKCTSINYDDNVINIVDTPGHADFGGEVERVMNMVDGVALVVDATEGPMTQTRFVLAKALSRGLRPLVVLNKADRPTARPAQVESDLFDLFATLGATDEQADYPLLYASAKQGWAQDKPPQPAPEASSMASLFNLILNHVPAPRHLDRSKPFSMLTVQIESDPYVGVLYLGRIESGTLKVNDTVWALDPQGNKVGEGKVKKIFGKRGLERIEKDVAAAGEIVSIAGIKNGGVNITLIHPEGWGEEGPKPLPTAPIDPPTISVVLYPNDSPLAGQEGSKLTSQLIRDRIYKEAETNVALMVLPGPTSESLEVRGRGVLHLGVLFETLRREGFELGVGPPKAVMIPDPSQPGVMLEPIEECTIFVSEQYAGSVVQKLTMRKAEMVSYEADETQEGWVKIVMNVPARGLIGYMAGEFKNDVHGEGTINHIFKGYEPYKGAIDTGRNGALISMASGESSGYAMMPLQARGTMFIHPQTQVYPGMVIGESSKSQDLYLNPCVKKQLTNIRAAAADDKIVLASPRIMSLEEALSYMADDEIVELTPKTIRLRKQLLDVNKRQRMLKK

SEQ ID NO: 16913 - protein, 539 aa, Ralstonia solanacearum GMI1000
MPTALPAWQSLSQHAQAIRATHMRDWFAAPDAEQRVHAFTVEAAGLTLDYAKNRITPETLALLLQLADEAGVLTLRDAMLRGERINNTEHRSVLHAALRGHAEDDYRANGAAVMPDVLRVRAQMRDFAQRVHSGTWTGHAGQRITDVVNIGIGGSDLGPRMVCRALAHLAVPQVRVHFVSNVDGTDLAETLAGLNPDTTLAIVCSKTFTTLETMANAHSMRRWFIEHGVPEAQLKQHFVAVSTNRDAVVAFGIDPDNMFTFWDWVGGRFSLWSAVGLSIVLAIGPEQFETMLDGARAMDRHFASAAPRENMPLILGLLSVWYRGFFGAASACTVPYCAPLELLTDFMQQLEMESNGKSVQRNGAAIGTDTGPIVWGTAGTNGQHAYFQLIHQGSQIVPVDFITTLEPVRSLPGHHTKLLANCFAQGEALLRGRTAEEVRADGITDAALVPHMVFEGNRPSNTILMQRLDAASLGALIACAEHRTFVQGAVWNINSFDQWGVELGKKLAKPILEELEGAPASVAHDASTAALIRRAKAAR

SEQ ID NO: 16914 - protein, 513 aa, Candidatus Pelagibacter ubique HTCC1002
MDKNYYITTPIYYPSARPHMGHAYSSIVADFFARFKRIDGFNVHFLTGTDEHGLKIQRAAERKKIDPQTFCDEISQTFRDLSKTLNLSNTDFIRTTEERHKKTVQHLWNELEKNDDIYLSKYSGWYSVSDEAYYSDEEIIEKENVKIAISSGSSVEWIEEESYFFRLSKWQDELLKYYEKNPDFISPKSRKNEVISFVKGGLKDLSISRKAFSWGIKVPNSQDHVIYVWLDALTNYISALNYPDTNDELFKKFWPASVHLIGKDILRFHSVYWPAFLMAAKIPLPKKVYGHGWILSGDEKMSKSKGNILDPLDIIEIYGLDPLRYYLIKEVSFGNDGNISQDRLEDCINSDLANNYGNLCQRVTAFAEKNCSSLVPDNIKFNDEDLVMLNKFTDNLDIIRTEIDNQNINYYINFIVSSLFEANKYFNDQEPWKKKDDKNRLNTIVYTSLEMIRKISFMLYPIIPSSIEKALKIFDLNIDAINFESIAKHDYLISGKPINKIDIMFKKIEKKHD

SEQ ID NO: 16915 - protein, 531 aa, Ralstonia solanacearum GMI1000
MSAHPTWRDVLTDGILAERHGADLLFGSAAVRALETAAYRALAPFTLMARAGEAAADWLQARAPRGHLLLVAGPGNNGGDALVAATALHEAGRTVTVWLAADPARLPDDARRAWTEARAAHVPIEILHAPASVPATVTAIVDGLFGIGLARPLAGLHAALVETLNGSGLPAYALDIPSGLSGDTGQPPAPDSPVVRARATLTFLVAKPGLLTGAGRDATGDLALADLLAAQPAYDGVVEADALVNAPARWLAHLPRRRHDGHKGTYGSVAVVGGAHGMVGAPLLSARGALHLGAGKVHVVSLADDAPRVDFAQPELMLHTWGTLDLGGMQALAVGPGMGTGKDAYEALDHLLDRMLPARIAAVFDADALNLFARAPALLTRLTRLASGGAPVVLTPHPLEAARLLDTDAPTVQRDRLAAAQALVNRCGAVVVLKGSGTVVAAPGVPPTVNPTGNGSLATGGTGDVLTGMIGALLAQGVPAREAALAAVWLHGRAADDLVAAGEGPIGLHAGELCAPARRALNGLLKSDAYP

SEQ ID NO: 16916 - protein, 422 aa, Oryza sativa
  misc_feature (64)..(64): Xaa can be any naturally occurring amino acid
  misc_feature (220)..(220): Xaa can be any naturally occurring amino acid
  misc_feature (249)..(249): Xaa can be any naturally occurring amino acid
  misc_feature (292)..(292): Xaa can be any naturally occurring amino acid
  unsure (1)..(422): unsure at all Xaa locations
RWCQKDLYFGLLFFFSADGVGGVTERLPEGSSEPLLPTKREGGGGGGEFAGAVFNLSTTIVGAXGIMALPATMKVLGLAPGLVAILLAALLTDASIELLVRSSRAAGAPSYGAVMGDAFGWWGRRLLQVCVVVNNIGVMIVYMIIIGDVLSGTSSGGEHHYGVLEGWFGPQWWNGRFFVLLVTTLVVFTPLACLKRVDSLSYTSAISVALAVVFVIITAXGIAIVKLIKGQIPMPKLFPDVPDLASIWXLFTAVPVLVTAYVCHYNVHPIHNELKDPSQIKPIVHTSLVLCXTVYITTSFFGYLLFGESTLSDVLANFDSNLGIPYSQMLNDAVRVSYAVHLMLVFPMIFHALRLNLDGLLFSSSSPLSSDNRRFSVMTAVLLLVIFLSANFIPSIWDAFQFTGATAAVCIAFIFPAAITLR

SEQ ID NO: 16917 - protein, 781 aa, Aspergillus nidulans FGSC A4
MTVCYEHPSRGLTPTSMATLSDRFELMKEVGDGSFGSVAVARVRTAGSNIARRGTLVAIKTMKKTFDSLAPCLELREVIFLRTLPPHPHLVPALDIFLDPLTRKLHIAMEYMDGNLYQLMKARDHKYLDGKHVKSILYQILCGLDHIHAHHFFHRDIKPENILVSTSAPNDSTFSRYSNLVTPPSTPTTYTVKIADFGLARETHSKLPYTTYVSTRWYRAPEVLLRAGEYSAPVDMWAVGAMAVEIATLKPLFPGGNEVDQVWRVCEIMGSPGNWYSKSGAKLGGGEWKDGSRLAQKLGFTFPKMAPHSMESILPAPQWPAALSNFVTWCLMWDPKNRPTSSQAMQHEYFADAVDPLSVRPRSSTARLLGRKQSEKSVKSPTKDTYESPTLSSKPSWFRRSLIGRSESPALVEPEQPSKPTLPALDSNVDPQLLKPKHSTSKRATWAHGAPMPILPSIRPVSPLSNAVTAQANPPAQESNTNAAKSSKKIGRQLSVNSHGNHYGDVHRQEAERALNGLGNNSTSTISQKESFFSHLRKRARRLSGRNQNAMNDDIEANAGCMPWSNRSSLALDSVNVSEAKQNSDFSELDKAVQNVRYSMDSAALGNVPVSITTPVEASKRQSMPQGSIRSMGDSPASMNGNGGPISSRTRRAMQMTNHPVHRYETPEEEDELLDEVLHSASSAAMRLAQAQMSDTSSNYSRPLCNEQSHNLPSPYPTPSPSAKCDGVSFGNEDAAPNRRLPLSDEKSATSATRQWPTPPYDDGDWMNPASTKFLTGSTYR

SEQ ID NO: 16918 - protein, 203 aa, Helianthus annuus
PYGFSVIEKFLTGARSIDQHFHSAPFESNIPVLLGLLSVWNVSFLGYPARAILPYTQALEKLAPHIQQVSMESNGKGVSIDGVRLPFEAGEIDFGEPGTNGQHIFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16919 - protein, 203 aa, Helianthus annuus
PYGFSSIEKFLAGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16920 - protein, 95 aa, Glycine max
  misc_feature (85)..(85): Xaa can be any naturally occurring amino acid
  unsure (1)..(95): unsure at all Xaa locations
MEMFSSMISFPAVATVNRAGAGMVAPFTGLKSMAGFRTRKTYYVITSIASVGVRVQCMHVWPLIGWKTFATFHYLPDLDDALFAXVVAFLVRKGW

SEQ ID NO: 16921 - protein, 555 aa, Candida glabrata CBS 138
MASSNTYSNFKLATELPAWSKLQKLYDAQGKSLNVKEEFQKDSARYNKYAKTLTNYDGSKILFDFSKNLINDEILATLIELAKEAKVTDLRDAMFAGEHINFTEDRAVYHVALRNRANKPMKVDGVDVAPEVDAVLQHMKEFSEQVRSGEWKGYTGKKITDVVNIGIGGSDLGPVMVTEALKHYAGVLDVHFVSNIDGTHIAEVLKVVDPETTLFLVASKTFTTAETITNANTAKNWFLSKTGNDQSNIAKHFAALSTNETEVAKFGIDTKNMFGFENWVGGRYSVWSAIGLSVALYIGFDNFEAFLKGAEAVDKHFVETPLEDNIPLLGGLLSVWYNNFFGAQTHLVAPFDQYLHRFPAYLQQLSMESNGKSVTRGNVFSTYSTGSILFGEPATNAQHSFFQLVHQGTKLIPSDFILAAQSHNPIENNLHQKMLASNFFAQAEALMVGKDEAQVKSEGATGGLVPHKIFSGNRPTTSILAQKITPAALGSLIAYYEHVTFTEGAIWNINSFDQWGVELGKVLAKVIGKELDNTEKITAHDASTNGLINQFKEWL

SEQ ID NO: 16922 - protein, 473 aa, Bradyrhizobium japonicum USDA 110
MADTSFDIIIIGSGPGGYVTAIRAAQLGFKVAIVEKSYLGGICLNWGCIPTKALLRSAEIYHYMQHAKDYGLSAEKVSFDPKAVVQRSRGVSKRLNDGVGFLMKKNKVTVIWGAASIDAPGKVTVKKSDVEAPKGALGEGTYQAKHIIVATGARPRVLPGLEPDKKLIWTYFEAMVPERMPKSLLVVGSGAIGIEFASFFHTMGSDVTVVEVLPQILPVEDAEIAGLARKRFEKQGIKILSSTKVTKLEKKADSVVATIDDGKGKPVTTEFERVISAVGVVGNIESLGLEKLGVKTDRGCIVIDGYGKTNVPGIYAIGDVAGPPMLAHKAEHEGVICVEAIKGLHPHPMDKNLIPGCTYCQPQVASVGLTEAKAKENGREIRVGRFPFVGNGKAIALGEDQGLVKVIFDKKTGQLLGAHMVGAEVTELIQGYVVAMNLETTEEELMHTVFPHPTLSEMMKEAVLDAYGRVLNI

SEQ ID NO: 16923 - protein, 430 aa, Glycine max
VTIPSELLSKDLVLNYSGNINLHRESRIKGHMYVIIGSSVGASVLLLATIISCLYMRKGKRRYHEQDRIDSLPTQRLASWKSDDPAEAAHCFSFPEIENATNNFETKIGSGGFGIVYYGKLKDGKEIAVKVLTSNSYQGKREFSNEVTLLSRIHHRNLVQLLGYCRDEESSMLVYEFMHNGTLKEHLYGPLVHGRSINWIKRLEIAEDAAKGIEYLHTGCIPVVIHRDLKSSNILLDKHMRAKVSDFGLSKLAVDGVSHVSSIVRGTVGYLDPEYYISQQLTDKSDVYSFGVILLELISGQEAISNESFGVNCRNIVQWAKLHIESGDIQGIIDPLLRNDYALQSMWKIAEKAFMCVQPHGHMRPTISEVIKEIQDAISIERQAEALREGNSDDMSKHSFHSSMNMGSMDLGGAESYLSIDESIAQPTAR

SEQ ID NO: 16924 - protein, 348 aa, Prochlorococcus marinus subsp. pastoris str. CCMP1986
MKNLLGCSVKDLEKIALNYGQAAFRGRQIYNWLYNYKNRSKSIDEINVLPLKFRDQLKNEAFLFGELTLKEKYLATDGTLKLLLNTRDNESVECVGIPTEKRLTACLSSQVGCPMDCKFCATGKEGLKRSLKVSEILDQILFIENQMNQKVSNIVFMGMGEPLLNIDELLLSIRSINEDFAISQRKITVSTVAIPKMISKLSELSFQVLGKCQFTLAISLHASNQKIREAIIPSAKNYHIKNIIDDCREYVRETGRRVSFEYLMLHGVNDKLEHADELSNLIKGFQCHVNLIQYNHIEEVEFKQTPIKNAQLFQTRLSNSGINVSFRKSRGSDRNAACGQLRQNDKIK

SEQ ID NO: 16925 - protein, 310 aa, Exiguobacterium sibiricum 255-15
MNVTQQQLEELIAECRPYTVLGQVASYIPELAKSEPTQLGIAVCNADGSFVSAGDAETMFTLQSVSKIITLAFVLETFGEDYVFSKVGMEPTGDAFNSIAKLEETIPTKPLNPMINAGALAVTSMLPGEDAADKLNRLRQFIADLLDIELDMVKYDAEVAKSEFETTDLNRALLYFMRYHGVIEGNVEEIIDVYTKQCAILTNCKGLAMMGKILSQSGKTPSGNQVISRRNARIIRAIMTTCGMYDASGEFSVQVGLPGKSGVSGAIVACGRSDFDMADLGIGIFGPALDLKGNSIAGTKMLELLVQRHP

SEQ ID NO: 16926 - protein, 237 aa, Lolium perenne
MCPIKEEMGGESGSPCSGDYYSPSTSSELQQVHSQNQTPWTKRPAGRTKFRETRHPVYRGVRRRGNAGRWVCEVRVPGRRGSRLWVGTFDTAEIAARAHDAAMLALAAGDSCLNFADSAELLAVSASSYRSLDEVRHAVTEAVDEFERHHALGEEDALSGTSASTPSSSSSVTDDETSSSWAADSPFELEVMGDMGWDLYYSSLAQGMLMAPPTAAAALGDYGEANLADVALWSYQS

SEQ ID NO: 16927 - protein, 256 aa, Vibrio fischeri ES114
MRHPVVMGNWKLNGSKEMVVELLNGLNAELEGVTGVDVAVAPPALFVDLAERTLTEAGSAIILGAQNTDLNNSGAFTGDMSPAMLKEFGATHIIIGHSERREYHNESDEFVAKKFAFLKENGLTPVLCIGESEAQNEAGETVAVCARQIDAVINTQGVDALNGAIIAYEPIWAIGTGKAATAEDAQRIHAQIRAHIAEKSEEVAKNVVIQYGGSVKPENAAAYFAQPDIDGALVGGAALDAKSFAAIAKAAAEAKA

SEQ ID NO: 16928 - protein, 90 aa, Brassica napus
GSECEFPKPHPGPYLKALEVLNVSKEHALVFEDSVSGIKAGVAAGMPVVGPTTGNPASVLMQARPAFLIENYADPKLLGVLEELDNKKSS

SEQ ID NO: 16929 - protein, 373 aa, Picea smithiana
DHLSLHSYCFERVAEFADRPCLIDGATDKTYCFAEVELISRKVAAGLANLGLQQGQVVMLLLQNCIEFAFVFMGASVRGAIVTTANPFYKPAEIAKQAKAAGVRIIVTQSAYVDKLTDLQSDDLIVITIDGAPKEGCKHISVLTEADETQCPSVEIQPDDVVALPYSSGTTGLPKGVMLTHKGLVSSVAQQVDGENPNLYFHSEDVILCVLPLFHIYSLNSVLLCALRAGAATLIMQKFNLTTCLELIQRYKVTVAPIVPPIVLDITKSPNFSQYDVSSVRIIMSGAAPLGKELEDALRERFPKAIFGQGYGMTEAGPVLAMNLAFAKEAFPVKSGSCGTVVRNAQIKILDTETGQSLPHNQAGEICIRGPEI

SEQ ID NO: 16930 - protein, 191 aa, Mycoplasma genitalium G37
MDAHFLKSASDLKDCPQDNIPEICFMGRSNVGKSSLINAFFKKKLAKTSATPGRTQLLNYFEYKDKRFVDLPGYGFAKINKNKKDFITNLLTQFLNFRSNLVGVVLIVDSGVVTVQDQEVVKIILQTGLNFLIVANKFDKLNQSERYFSLKNIANFLKVNFDKCVFASTKTHHNLALVHKKIFELFVEDER

SEQ ID NO: 16931 - protein, 371 aa, Cathaya argyrophylla
LSLHSYCFERVAEFADRPCLIDGATNKTYCFAEVELISRKVAAGLANLGLQQGQVVMLLLPNCVEFAFVFMGASVRGAIVTTANPFYKPGEIAKQAKAAGARIIVTQAVYVEKLAELRSDDVIVITIDDAPKEGCKHISVLTEADERQCPSVEIHPDDVVALPYSSGTTGLPKGVMLTHKSQVSSVAQQVDGENPNLYFHSEDVILCVLPLFHIYSLNSVLLCALRAGAATLIMQKFNLTTLLELVQRYKITVAPIVPPIVLEITKSPIVSQFDVSSVRMIICGSAPLGKELEDALRDRFPKAIFGQGYGMTEAGPVLAMNLAFAKKPFPVKAGSCGTVVRNAQIKILDTETGRSLPYNQAGEICIRGPEI

SEQ ID NO: 16932 - protein, 336 aa, Salmonella enterica subsp. enterica serovar Paratyphi A str.
MKAAVVTQDHQVDVTEKTLRPLRHGEALLKMECCGVCHTDLHVKNGDFGDKTGVILGHEGIGVVAEVGPGVTSLKPGDRASVAWFYEGCGHCEYCNTGNETLCRNVKNAGYTVDGGMAEECIVVADYAVKVPEGLDSAAASSITCAGVATYKAVKISHIKPGQWIAIYGLGGLGNLALQYAKNVFNAKVIAIDVNDGQLKLAEEMGADLTINSRTEDAAKIVQEKTGGAHAAVVTAVAKAAFNSAVDAVRAGGRVVAVGLPPEAMNLDIPRLVLDGIQVVGSLVGTRQDLTEAFQFAAEGKVVPKVALRPLEDINVIFKEMEQGQIRGRMVIDFRR

SEQ ID NO: 16933 - protein, 337 aa, Zea mays
  misc_feature (87)..(87): Xaa can be any naturally occurring amino acid
  unsure (1)..(337): unsure at all Xaa locations
MVASTASRLSPPRFSTPSPSLHPPNRRSRFSPVRAAKLEAVLSIGAHLIPHPRKAASGGEDAFFANSDAGGVFAIADEVSGHSLIYXDRWAEKNVNPALFSRELMRNSSNFLNDEAVSHDPQILLMKAHAATSSIGSATVIIAMLEKTGTLKIASVGDCGLKVIRKGQVMFSISPQEHYFDCPYQISSEAEGQTYKDALVCSVNLMEGDIIVSGSDGLFDNIFDQEIVSIISESPSVDEAAKALAELARKHSVDVRFDSPYSMEARSRGFDVPWWKKLLGGKLIGGKMDDITVVVAQVKTVVVPEDEVQGGDTEEQKGNEQGAAAVVAYKMNDEEVA

SEQ ID NO: 16934 - protein, 624 aa, Coprinopsis cinerea okayama7#130
MSTDKHLGEKAGSDHDEKVVATVAHRSVDLANNVEARIQNPLHGIPEATLLRQAEEFAIDHGLEDKVDLFKKGALLAQNPADFESIPGMTEEEKEHIRRETTHRWSQSKALYMTIVICSLAAAVQGWDQTGSNGANLSFPKEFGIYTEDENDPNKDRYDWIVGIVNAGPYLATWAIGCWLTDPLNHFFGRRGTLFWCGIFCTFTVIGQGLAQTWPQLFVCRLLLGLGMGPKATTSPVFAAENVPANIRGGLVMCWQMWTAFGIFLGFSANLAVHKLGDIAWRLELGSAFIPAVPLTIGIYFCPESPRWLMKNGRYKKAFRSFVRLRNSELQAARDMYYVHCQLVEEFKVLKGSNYFTRFYELFTVPRVRRATLASWVVMIAQQMCGINIIAFYSSTIFRNAGYSMTQALFASWGFGLVNWVFAFPAVWTIDTFGRRNLLLFTFPNMAWTLLAAGFCFFIPEDSPARVPCVALFIFIFAAFYSPGEGPVPFTYSAEVFPLTHREMGMSWAVATNFFWASVLSLTFPRMLSAFGSVGAFGFYAGLNVMAFIMIFFLMPETKQRTLEELDYVFAVPVAQHAKYQLSEFLPYWIRRWVLFRKDAKLRPLYDFEEVEGRRASDEKTSSV

SEQ ID NO: 16935 - protein, 203 aa, Helianthus annuus
PYGFSSIEKFLTGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16936 - protein, 451 aa, Bradyrhizobium japonicum USDA 110
MPINILMPALSPTMEKGNLAKWLKKEGDKVKSGDVIAEIETDKATMEVEAIDEGTIAKILVPEGTQDVPVNDVIAVLAGEGEDVKAAGAAKPSASAAPPKATDAPAAAPAPATAPAAPKAAPPPAAAPAPQAAAPAAQSNGHGGRVFSSPLARRLAKDAGIDVSMVTGTGPHGRVVARDVEQAKSGKGLKAPAAAPSSAPSIAPTMSDKQILSLFEPGSYDIVPHDGMRRTIAQRLTASIQNVPHFYLTIDCDIGKLLAAREEINAAAPKDKEKKPLYKISVNDFVIKAMAVALQKIPNCNVSWTESGMVKHHHSDVGVAVAMPGGLITPIIRKAETKTLSTISNEMKDFAARARSRKLKPEEYQGGTTAVSNLGMYGISHFTAVINPPHATILAVGTSEERPVVRNGKIEIAHMMSVTLSCDHRAIDGALGAELIGAFKQLIENPVMMMV

SEQ ID NO: 16937 - protein, 463 aa, Bradyrhizobium japonicum USDA 110
MPIQVLMPALSPTMEKGNLAKWLKKEGEAIKSGDVIAEIETDKATMEVEATDEGTLGKILIPEGTADVAVNTPIATILADGESAADLAKAPAPAPQPKAAESAAPAAAKAEAPAPRAAPSAPQAAAEPDPEVPAGTEMVTQTIREALRDAMAEEMRRDADVFVMGEEVAEYQGAYKVTQGLLQEFGAKRVIDTPITEHGFAGIGVGAAMTGLKPVVEFMTFNFAMQAIDQIINSAAKTLYMSGGQMGCSIVFRGPNGAAARVAAQHSQDYSSWYSNVPGLKVVAPFSAADYKGLLKAAIRDPNPVIFLENEVLYGHTGEVPKLDDFVIPIGKARIVRSGSHVTIISWSNGMTYALKAADELAKDGIEAEVIDLRTLRPMDTETIVNSVKKTGRAVTVEEGWAQSGVGAEIAARIMENAFDYLDAPVARVSGKDVPMPYAANLEKLALPSAAEVVEAAKAVCYR

SEQ ID NO: 16938 - protein, 482 aa, Escherichia coli CFT073
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQNGVYDRFAEKLQQAVSKLHIGNGLEKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIIGINTGIISNEVAPFGGIKASGLGREGSKYGIEDYLEIKYMCIGL

SEQ ID NO: 16939 - protein, 231 aa, Zea mays
MAGAGDKVDYVFKVVLIGDSAVGKSQILARFARNEFSLDSKATIGVEFQTRTLVIDHRSVKAQIWDTAGQERPLWWEAYHAGLNLRYRAVTSAYYRGALGALLVYDITRRQSFDHIPRWLDELRAHADKNIVIMLVGNKSDLEEQRAVSTEDAKEFAEKENLFFLETSALQATNVESAFQTVLTEIFKIHSKKNMVSEPKSNGAAPAMPGTKVLVPGPAQEIPKSKCCSSM

SEQ ID NO: 16940 - protein, 428 aa, Escherichia coli CFT073
MRMSSNKELMQRRSQAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYAATPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANVLGQKLKDGLLAIAEKHPEIGDVRGLGAMIAIELFEDGEHSKPDVKLTAEIVARARDKGLILLSCGPYYNVLRILVPLTIEDAQIRQGLEIISQCFAEAKQ

SEQ ID NO: 16941 - protein, 487 aa, Escherichia coli CFT073
MTRRGKCRGALPSDTLSRGFRMGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIRKILRAEGSEIRLRMWLYPWLTWLVIGFITFVLVVMLFRPAQQLEVISTGLLAIGIICTVPIMARWKKLIMWQKTPIHNTR

SEQ ID NO: 16942 - protein, 246 aa, Glycine max
MSAAVSSTTPHLEEELKNKATNNKKKNNVGGESDQPPYNDGANSDVAEETEPEEDDDSKLESNKDLDLGPQFTLKEQLEKDKDDESLRKWKEQLLGSVDMSVVGSECKDPEVKILSLIITSPDKPDLTLPIPFTTDPKKSLFILKEGSKCQMKFTFTVSNNIVSGLKYTNVVWKTGVRVDSRKKMLGTFSPQQEPYTFELEEETIPSGMFVRGTYAARTKFVDDDRKCYLDVSYYFEIQKNRPTPQ

SEQ ID NO: 16943 - protein, 671 aa, Listeria innocua Clip11262
MKKTLDRQAVDTIRSLSIDMIEKANSGHPGMPMGAAPMAYMLFAKHLVFNPANPEWFNRDRFVLSAGHGSALLYSMLHLFGYDVKMEDLKQFRQLDSLTPGHPEFGWTAGVDATSGPLGQGIGMAAGMALAESHLAAEYNQPNYPIVDHYTYAICGDGDLMEGVASETASLAGHLGLGKLIVLYDSNDICLDGDLSATFSENAADRFRAYGWQVLRVEDGNNLAAIQEKIVQAKLETSKPTLIEVKTVIGYGAPTKAGSSASHGAPLGEKEANGAKEHYEWAEEPFTVPAEVRDYLRNYKARGEKLEGAWNTMLANYKKEFPELARQLDRVLAGEVAADWNANLPTFEAGTNIATRSASGKMINAIAAELPELFGGSADLGCSNKTFIDASPAYSIQDPAGKNIWFGVREFAMGAMLNGMALHSGLRVFGSTFFVFSDYVRPAMRMAALMQLPVTYVFTHDSIAVGEDGPTHEPIEQLASLRAMPGLTVIRPADAKETRAAWEIAATNTHGPIALVLSRQDLPVLENAQEEVDAGVDKGAYIVAPANSSKPDAIIIATGSEVSLAIEAKAELAKKDIDVSVVSLSSWERFEKTTDAYKESILPKEVTARFAIEAGATFGWKEFIGSEGDMLGINHFGASAPAKDLFNAYGFTPENVADRVEAVIAKAGVRV

SEQ ID NO: 16944 - protein, 316 aa, Zea mays
MAQPSVILATASYDHTIRFWEAKSGRCYRTIQYPDSQVNRLEITPDKRFLAAAGNPHIRLFDVNSNSPQPVISYDSHTSNAMAVGFHCDGNWMYSGSEDGTVRIWDLRTGTCQREYESRAAVNTVVLHPNQKELISGDQNGNIRVWDLAANSCSCELVPEVDTAVRSLTVMWDGSMVVAANNRGTCYVWRLLKGTQTITCFEPLHKLQAHDGYILKCLLSPEFCDPNRYLATASSDRTVKIWNVDSFKLERTLVGHQRWVWDCVFSVDGAYLITASSDTTARLWTMSTGEAIRVYQGHHKATVCCALHDGAESAPS

SEQ ID NO: 16945 - protein, 175 aa, Triticum aestivum
MVPTVMSSSDTSVALFQGLKSTAGLPVSRRSNGASLGSVRNGGRIRCMQVWPIEGIKKFDTLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 16946 - protein, 343 aa, Listeria innocua Clip11262
MKAVVKTNPGYDQMELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTICPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFIQVGLFAEKKNAIDEESIIQREIAYIGSRSQKPSSWILALDLLANGKINTDKMITKVYGLDDWREAFEAVMAGNEIKVLVKS

SEQ ID NO: 16947 - protein, 350 aa, Listeria innocua Clip11262
MRAAVLYENNVIKAEQIDEATCGKDQVRVEVKAVGICGSDIHKMQTRWKYPLPAVMGHEFAGVVTEIGSEVTNVAIGDRVAGIPLEPCMECNYCKAGDFALCDNYRMVGSHFHGGFAENVVMKADNVISIGDLDFEEGAMIEPLAVSMHGVLGIEPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGYLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 16948 - protein, 231 aa, Prochlorococcus marinus subsp. pastoris str. CCMP1986
MKQIVADSAIEEVEDGMILGLGSGSTAALMIKSLAEKIRSGKLKNIKGVPTSFQSEVLALELNIPLIDLASVPYIDLAIDGADEVDPDFQLIKGGGACHVREKLVASKANKLLIVIDESKLVQNLNQVFPLPVEVMPSAWKQVKDIISEMSGVSNLRMATKKAGPVVTDQGNLILDVLFDAGIRDPKDLEMRINNIPGVLENGLFVDLADKVLVGKIEDDVPVLFSPSRRS

SEQ ID NO: 16949 - protein, 294 aa, Blastopirellula marina DSM 3645
MDRTKRKDDAGPALLRLQPRKTNSHKGDYGRVLAVGGSPGMSGSITLTGVASLRCGAGLTTIAAPKSLQPLIAQFEASCMTIGLSEDRNGQLPMHARAEIAKAARISDVVAVGPGLGRSHGLDLLIKDLYCDLTTPMVVDADAINALGSRENPLAAPGGPRVLTPHPGEFRRLAHNRELPKGRWTDVAADMAKQNGVVLVLKGHRTTVTDGDHVYSNETGNPGMATAGAGDVLTGVIAALLGQGIPAFEAAQLGVYLHGLAGDLAAKAIGSDGLIASDLLDYLEAAFQQHRRRR

SEQ ID NO: 16950 - protein, 512 aa, Bradyrhizobium sp. BTAi1
MDKATPKADIYKANLDRAAPLLAKLKDEGIGHFIDGKVVPAISGATFETKSPIDNTVLAKVARGNAEDIDRAATSAALAFKSWREMAPAMRRKLLHRVADAIEDHADDIAVLECIDTGQAYRFMAKAAIRAAENFRFFADKCTEARDGLNTPSEEHWNISTRVPIGPVGVITPWNTPFMLSTWKIAPALAAGCTVVHKPAEWSPITAHWLAKLAKDAGIPDGVLNTVHGFGEEAGRALTEHPAIKAIGFVGESTTGSAIMAQGAPTLKRVHFELGGKNPVIVFDDADLDRALDAVVFMIYSLNGERCTSSSRLLVQQNIAETFTAKLAARVRALKVGHPLDPATEVGPLIHERHLAKVCSYVDIARQDGAIIAVGGKPVAGPGGGHYVEPTLVTGASQIMRVAQEEVFGPFLTVIPFGDEADAIAIANDVQYGLTGYVWTGDMGRALRVADALEAGMIWLNSENVRHLPTPFGGMKASGIGRDGGDYSFDFYMETKHVSLARGTHKIQRLGV

SEQ ID NO: 16951 - protein, 819 aa, Xanthobacter autotrophicus Py2
MDRHTSHPPTPSALSTPLRPRPAPPSAGDLAILAELERKVLWLASWMIHNANHLRPGTDGLKVGGHQASSASLAAIMSALYFHVLRPEDRVAVKPHASPIFHAIQYLFGRQTRERLENFRGFKGAQSYPSRTKDADDVDFSTGSVGLGVAQTLFASLAQDYVHAHGLAGDRPKGRMIALVGDAELDEGNVFEALLEGWKHEVRNTWWIIDYNRQSLDGVVREGLYERFTGIFEAMGWQVVVLKYGTLQQAAFAEPGGAALKSWIDTCPNAEYSALTFQGGAAWRKRLMDDLGDQGEVSALIARRSDAELSALMTNLGGHDIAALIAAFDAIDHDRPVAFLCYTVKGFGLPLAGHKDNHAGLMTPAQMEALRAAMGVGEGREWEPFEGLKRPAGELAAFLARVPFAQGGPRRFTDPALAVPALAPPPNPVISTQAGFGLILQDLAKGESQLSDRIVTTSPDVTVSTNLGPWVNRRGLFAHAALADVFKRERIPSTFAWEFSPKGQHVELGIAEMNLFLALSAFGLSHSLFGARLVPVGTLYDPFICRGLDALNYACYQDARFILVATPSGITLAPEGGAHQSISTPLIGMAQDGLAAFEPAFVDELAVLMEFAFDYVQRDGEGAGDERNWLRDETGGSVYFRLSTRPLEQPKRVLSEAQKRGIVDGAYWLREPGPNCEVVVAVQGAVTPEAIAAVALIAQDRRDVGLLAVTSADRLNAGWTAAARARERGFAGATSHVERLLEPLPRHCGIVSVIDGHPATLGWLGAVAGHRLRALGVEHFGQTGTLSDLYAHYGLDTAAIVAAAQAISPGRPLRHLKAV

SEQ ID NO: 16952 - protein, 110 aa, Chlamydophila caviae GPIC
MTIFEKIIEGSIECEKVFENENFIAIKDRFPQAAVHLLIIPKKHIERVQDMQEEDLPLLAEAGKIIQQLAETFGIADGYRVVINNGIEGGQSVFHLHIHLLGGSALGAIA

SEQ ID NO: 16953 - protein, 308 aa, Pseudotsuga menziesii
DGATDKTYNFAEVELISRKVAAGLAKLGLKKGQVVMLLLQNCIEFAFVFMGASILGAIVTTANPFYKPGEIAKQAKAADARIIVTQAAYADKLADLQRDDVTVVTMDGVPKEGCQHISVLTEADETQCPSVEIHPDDVVALPYSSGTTGLPKGVMLTHKSLVSSVAQQVDGENPNLYFHSEDVILCVLPLFHIYSLNPVLLCALRAGAATLIMQKFNLTMLLELIQRYKVTVAPIVPPIVLDITKNPIVSQYDVSSVRIIMSGAAPLGKELEDALRERFPKAIFGQGYGMTEAGPVLAMNLAFAKEPF

SEQ ID NO: 16954 - protein, 1136 aa, Zea mays
MSSSRPAHSSSSSSRTRQSSRARILAQTTLDAELNAEYEESGDSFDYSKLVEAQRSTPPEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLLGGSMEALCNTVVKEVFDLTGYDRVMAYKFHEDEHGEVFAEITKPGIEPYIGLHYPATDIPQAARFLFMKNKVRMICDCRARSVKIIEDEALSIDISLCGSTLRAPHSCHLKYMENMNSIASLVMAVVVNENEEDDEPEPEQPPQQQKKKRLWGLIVCHHESPRYVPFPLRYACEFLAQVFAVHVNKEFELEKQIREKNILRMQTMLSDMLFKESSPLSIVSGSPNIMDLVKCDGAALLYGDKVWRLQTAPTESQIRDIAFWLSEVHGDSTGLSITSPPPPPHPGAASLGDMICGMAVAKITSKDILFWFRSHTAAEIKWGGAKHDPSDKDDNRRMHPRLSFKAFLEVVKTKSLPWSDYEMDAIHSLQLILRGTLNDASKPAQASGLDNQIGDLKLDGLAELQAVTSEMVRLMETATVPILAVDGNGLVNGWNQKVAELSGLRVDEAIGRHILTLVEDSSVSLVQRMLYLALQAGREEKEVRFELKTHGSKRDDGPVILVVNACASRDLHDHVVGVCFVAQDMTVHKLVMDKFTRVEGDYKAIIHNPNPLIPPIFGADQFGWCSEWNAAMTKLTGWHRDEVVDKMLLGEVFNSSNASCLLKSKDAFVQSSVRLGVIINSALAGEEAEKAPFGFFDRDGKYIECLLSVNRKVNADGVVTGVFCFIHVPSDDLQHALHVQQASEQTALRRLKAFSYMRHAIDKPLSGMLYSRETLKGTGLDEEQMRQVRVADNCHRQLNKILADLDQDNITDKSSCLDLDMAEFVLQDVVVSAVSQVLIGCQGKGIRVACNLPERSMKQKVYGDGIRLQQILSDFLFVSVKFSPAGGSVDISSKLTKNSIGENLHLIDFELRIKHQGAGVPAEILSQMYGEDNREQSEEGLSLLVSRNLLRLMNGDIRHLREAGMSTFILTAELAAAPSAVGH

SEQ ID NO: 16955 - protein, 344 aa, Burkholderia sp. 383
MKALVLERTRELALRDIDLPQEVGPGDVRIKVHTVGVCGSDVHYYVHGGIGPFRVDAPMVLGHEASGTVVETGAGVTHLRVGDRVCMEPGVPRFDSPATLRGLYNLDPDVRFWATPPIHGCLTPYVVHPAAFTYRLPDTVSFAEGAIVEPLSIGLQAAKKAAMKPGDLAVVIGAGTIGAMTALAALAGGAARVILADVVPDKLALFADNPAVTTVDVRTQPLADVVAEATDGWGADVVFEASGSANAYAGLVDLMCPGGCAVLIGMPVAPVPLDVVALQAKEGRIESVFRYANIFPRALALIASGAIDVKPFISRTFPFSEGVRAFEEAASGHPRDVKIQIEMD

SEQ ID NO: 16956 - protein, 691 aa, Salmonella enterica subsp. enterica serovar Paratyphi A str.
MTTNRAFEIRSGYSHTLGANYDGEGVNFAIFSAHAERVELCLYDPSGEHEIARLELPEYTDEIWHGYVPKLQPGALYGYRVYGPYDPENGHRFNPNKLLIDPYARELVSDIQWNDAHFAYQLLHDDKDLTFDDQDSAPFTPKCRVIDPAEANWEDRQRPSIPWSNAIIYETHVKGFTQLNSAIPEPLRGTFEGMGHKASVDYIKSLGITSVELLPVHWFPDDQHLLDKGLKNFWGYNSLGFFAPATRYYGPKGIQGFRDMVRAFHDAGVEVILDVVYNHTAEGNELGPTLSFKGIDNFSYYRTMPDQHRYYINDTGTGNTVNTSHPRVLQMVMDSLRYWAESMHVDGFRFDLGTILGREPEGFDQRGGFFDAVTQDPVLAKLKLIGEPWDIGPGGYQVGGFPPGWGEWNDKYRDTVREYWKGDNVTNDFAARLLGSGDLYDLRGRRSWSSVNFITAHDGFTLNDLVSYNDKHNEANGEDNNDGHNDNRSCNYGAEGPTDDEGINAIRERQKRNFLTTLLFSHGTPMLLAGDEFGRSQMGNNNGYCQDSEISWVHWDNLPETANALREFTRHLIQLRATQPLLRRESWRDGLEIRWFNAGGGAQQSEQWDEGSTIGVCISRPDLQPEAGIWHDALLLFNPFEGSVPFRIPMWGEGGWVLELTTADNAQQGMRITEEMDFDLAGRSIVLFRRP

SEQ ID NO: 16957 - protein, 239 aa, Pseudotsuga menziesii
IAKQAKAADARIIVTQAAYVDKLADLQSDDVIVISIDGAPKEGCQHISVLTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTMLLELIQRYKVTVAPIVPPIVLDITKNPIVSQYDVSSVRIIMSGAAPLGKELEDALRERFPKAIFGQGYGMTEAGPVLAMNLAFAKEPFP

SEQ ID NO: 16958 - protein, 203 aa, Helianthus annuus
PYGFSVIEKFLAGARSIDQHFHSAPFESNIPVLLGLLSVWNVSFLGYPARSILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16959 - protein, 159 aa, Aspergillus nidulans FGSC A4
MVDQVRSMESRVGRKNQRYGSKGERLVAGVVPLSKDKSLVMMIQSAGRGGWVLPKGGWETDEASAQQAACREAWEEAGVICTVLRDLGTISDMRPSTMLTSNSPRASYQFFEVTVDREEDRWPEMHKRRRQWVTYTQAAAALASRPELLEALNRSSMKR

SEQ ID NO: 16960 - protein, 212 aa, Pseudomonas syringae pv. phaseolicola 1448A
MNELQDLIDNNARWADAIKQEDPEFFAKLARQQTPEFLWIGCSDARVPANEIVGMLPGDLFVHRNVANVVLHTDLNCLSVIQYAVDVLKVKHILVTGHYGCGGVRASMQDRQFGLIDGWLRTIRDLYYENREVLAKLPTEEERVDRLCELNVIQQVANVGHTSIVQNAWHRGQSLSVHGCIYGIKDGRWKSLDVTISGFEQLPPQYRLRPQD

SEQ ID NO: 16961 - protein, 262 aa, Campylobacter jejuni RM1221
MKFLAVIGDPISHSKSPRMHNNAIKALGLDSIYTRYHLRNANCLREDFFKLGLSGANITLPFKEKALDIADVKDDFARNIGSANTLCLKEDKIYAYNTDALGFLEAIKDFDNIKKALILGAGGTALALAYALKQKGVEVYIANRSKERFKDFLAYPTYLYKNLQDFDFDLVINSTSAGLKDENLPCDRELLDRILPKAKFAFEVIYGRETPFYRLCKEYHLKIKDGLDMLLWQGVFAFELFFEIQDKREMIKNAMQQALILK

SEQ ID NO: 16962 - protein, 131 aa, Azoarcus sp. BH72
MSTSTKWLNEVKWDENGLVPVIAQEASTGDVLMFAWMNREALQRTAETGNAIYWSRSRRKLWHKGEESGHVQKVVELRIDCDNDVVLMKVEQVGGIACHTGRHSCFFQKYLADGRWETVEPVLKDPKDIYS

SEQ ID NO: 16963 - protein, 563 aa, Aspergillus oryzae
MDNNEGRASGSEEADRKRKKGDLGRAEWSWQTSDKRGRLDKENEAKRQKLEKGEEVKAPIYATHFSQEDIENEQRRPKKKVAVLLGYSGTGYKGMQLSATEKTIEGDLFAAFVAAGAISKANAADPKKSSLVRCARTDKGVHAAGNVVSLKLIVEDEDIVQKINAHLSPQIRVWGILVASKSFSSYQMCDSRIYEYLMPSYCFLPPHPSTFLGKKIIEIAEKEGDLEAHKARQAEVANYWEEADAKYIQPVLDTLDEDIREVVKNAIYHEKPEDESFGTEEQSQATEGGADAATKPELTEAELAHRRKIIDAVKAVKAAYNTAKRSYRIPPARVARLQEALDKYLGTKNFYNYTIQKLYKDPSAKRHIKSFKVDPNPIIINGTEWLSLKVHGQSFMMHQIRKMVAMATLIVRCGCDPKRIVDSYGPTKIPIPKAPGLGLLLERPIFNGYSKKAEELGKKPINFEVYATEMNEFKQREIYDRIFREEEETNAFASFFNHIDHFPQEEFLYVTSGGIPAAKPATQPSAATEDAQKGRKSQREALAEIEEESEDEGNLPNNGEEGG

SEQ ID NO: 16964 - protein, 203 aa, Helianthus annuus
PYGFSVIEKFLAGARSIDQHFHSAPFESNISVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 16965 - protein, 524 aa, Catharanthus roseus
MEMDMDTIRKAIAATIFALVMAWAWRVLDWAWFTPKRIEKRLRQQGFRGNPYRFLVGDVKESGKMHQEALSKPMEFNNDIVPRLMPHINHTINTYGRNSFTWMGRIPRIHVMEPELIKEVLTHSSKYQKNFDVHNPLVKFLLTGVGSFEGAKWSKHRRIISPAFTLEKLKSMLPAFAICYHDMLTKWEKIAEKQGSHEVDIFPTFDVLTSDVISKVAFGSTYEEGGKIFRLLKELMDLTIDCMRDVYIPGWSYLPTKRNKRMKEINKEITDMLRFIINKRMKALKAGEPGEDDLLGVLLESNIQEIQKQGNKKDGGMSINDVIEECKLFYFAGQETTGVLLTWTTILLSKHPEWQERAREEVLQAFGKNKPEFERLNHLKYVSMILYEVLRLYPPVIDLTKIVHKDTKLGSYTIPAGTQVMLPTVMLHREKSIWGEDAMEFNPMRFVDGVANATKNNVTYLPFSWGPRVCLGQNFALLQAKLGLAMILQRFKFDVAPSYVHAPFTILTVQPQFGSHVIYKKLES

SEQ ID NO: 16966 - protein, 209 aa, Azoarcus sp. BH72
MVSWASIFSAACPAMRHADVTRDTLETRISVRIDLDGTGKSVLATGVPFFDHMLDQIARHGAIDLEVRAEGDTHIDDHHTVEDVGITLGQAFAKALGDKKGILRYGHAYVPLDEALSRVVVDFSGRPGLHYFVDYTRARIGNFDVDLAREFFQGFVNHAGVTLHVDNLRGDNAHHQCETIFKAFGRALRMAATRDERLAGAIPSTKGAL

SEQ ID NO: 16967 - protein, 476 aa, Candida glabrata CBS 138
MIVKRLFRTMAPVAKHFDYLVIGGGSGGVASSRRAASYGAKTLLIEGKALGGTCVNVGCVPKKVMWYASDLATRLTHAHEYGLAQNVPLSKESITFNWPEFKKKRDAYIHRLNGIYENNLKKEGVEVVFGWAKFNKDGNVEVTKHDNTTEVYSADRILVATGGKPVYPEKVPGFELGTDSDGFFRLEEQPKKVVVVGAGYIGIELAGVFHGLGSDSHLVIRGKTVLRKFDEIIQNTVTDYYVEEGINVHKETNVDKVEKDEKTGKLSVHLTNGQVLEDVDELIWTMGRRSLLGIGLENVGVKLNDKEQIITDEYQNTNVPNIYSLGDVSGRVELTPVAIAAGRKLSNRLFGPEQYRNDKLDYTNVPSVVFSHPEAGSIGLTEDEAIKQYGKDNIKVYTSKFTAMYYAMLEHKSPTRYKIICEGPNEKVVGLHIVGDSSAEILQGFGVAIKMGATKADFDNCVAIHPTSAEELVTMR

SEQ ID NO: 16968 - protein, 552 aa, Leptospira interrogans serovar Copenhageni str. Fiocruz L1-130
MNPNMKLSKKYTFRSRKVLLIILDGVGYSPKGPESGNAIAGAKLPFLNRVWNQFPTLHIQAHGKAVGMPSDDDMGNSEVGHNVLGSGRIFDQGAKLVSNSIASGDIFNGQAWKEVIGNSKKNNSTLHLLGLFSDGNVHSHIDHTKALISQAILEKVPKIRLHILLDGRDVPEKSALDYLNPFETWLNSLRKSGTDIRIASGGGRMTITMDRYEADWSMVERGWKVHVKGEGRYFSSAKEAIETFRSENPKIIDQYLPSFVISDNGKPVGKIQDGDSVVFTNFRGDRAIEISLAFTEKNFDKFDRGPLPNVLYAGIMQYDGDLKLPERFLVAPPAIDRTLGEYMASSNIPQYALSETQKYGHVTYFWNGNKSGYFDQNSEEYREILSDVIPFDQSPEMKALLITEALEKALNENKQDFYRVNYANGDMVGHTGNYLATVQAMEFLDGCVERLWKTCEKQNIVLLVTADHGNADEMFQLDKKGNVEKDSHGNPIPKTSHTLNPVPISILDPENKIRFNSKLSNPGLANVAATILDVMGYETPEGYHPSLIQNES

SEQ ID NO: 16969 - protein, 445 aa, Leifsonia xyli subsp. xyli str. CTCB07
MDKQRDFVLRTIEERGIKFVRLWFTDVVGTLKSVAIAPAEVEGAFYEGLGFDGSAIEGLTRAYESDLLAHPDPTTFQILPWRGEIDPTARMFCDITTPDGQPAVSDPRNVLKRTLEKAADRGFTFYTHPEIEFYLLTSSRFGENGPEPVDSAGYFDNVPGGTAHDFRRRSVRMLEDLGISVEFSHHEAGPGQNEIDLRYADALTTADNIMTFRTVVKEVAIEQGVYATFMPKPLSGHPGSGMHTHMSLFEGDTNAFFEAGAQYQLSKVGRQFIAGLLKHAPEITAVTNQFVNSYKRLWGGDEAPSFVCWGHNNRSALVRVPLYKPNKGQSSRVEYRAIDSAANPYLAFSLMLAAGLAGIEGGYELPPEAEDNVWALSDAERRALGYSQLPASLDHAIALMEGSELVAETLGEQVFNYALLNKRREWAQYRAQVTPFELRSNLEIL

SEQ ID NO: 16970 - protein, 277 aa, Oryza sativa
  misc_feature (7)..(7): Xaa can be any naturally occurring amino acid
  misc_feature (16)..(16): Xaa can be any naturally occurring amino acid
  unsure (1)..(277): unsure at all Xaa locations
MAGGGGXYLRQFVEEXTAWYNEIFLSHVVPGDWWRALPHPLQSWLRNGLGGYLIYFACGFLWCFVIYYWKRHAYIPKDSIPTIEAMKKQIIVASKAMPLYCALPTLSEYMVENGWTQCYVNISEVGWPMYLVYLALYLIFVEFGIYWMHRELHDIKPLYKYLHTYHHIYNKENTLSPFAGLAFHPLDGILQAIPHVFALYLIPTHFRTHIALLFIEAVWTTNIHDCIHGKVWPVMGAGYHTIHHTTYRHNYGHYTVWNWNWMFGTLREPEGIILKKD

SEQ ID NO: 16971 - protein, 456 aa, Xanthomonas campestris pv. phaseoli
MSARYDYDVVILGGGSGGLAAGFRAARHGARVAIMEPSELGGTCVNLGCVPKKAMWLAADLAGKIELASALGFDLPRPTLAWQELVTHRQGYIANIHASYRRRLNEDGVVLIPQRGVLQDRHTVMGSDGVPVTAEHIVIATGAHPLRPDVQGAEHGEVSDDFFNLCHAPEQVAIIGGGYIAVEIAGLLQALGSRVHLFVQGERLLERFDAELTLQLADNLRHLGVRLHFGFTTTALERDLHGALRVHGHSVHPREQGNDVFDKVFFAVGRRANTAGLGLDTVGVALGDKGEVVVDDGQTTNVPNIHAIGDVGGKVGLTPVAIAAGRKLMDRLFGHQPDARMDYENVPSVVFSHPPLGHVGLTEEQARARYNGAVRVYRSNFRPMLHALADAPQRSLFKLVCVGEEERVVGVHLLGESADEMLQGFAVAVKMGATKRDFEETVAIHPTSSEEIVLMH

SEQ ID NO: 16972 - protein, 423 aa, Solanum lycopersicum
MATPMAEDSNFEDDQLHAMSTEDIIRASRLLDNEIRIIKEELQRTNLELDSFKEKIKENQEKIKLNKQLPYLVGNIVEILEMNPEEEAEEDGANIDLDSQRKGKCVVLKTSTRQTIFLPVVGLVDPDNLKPGDLVGVNKDSYLILDTLPSEYDSRVKAMEVDEKPTEDYHDIGGLEKQIQELVEAIVLPMTHQERFQKLGVRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDDRIKVIAATNRADILDPALMRSGRLDRKIEFPHPTEEARARILQIHSRKMNVNPDVNFEELARSTDDFNGAQLKAVCVEAGMLALRRDATEVTHEDFNEGIIQVQAKKKASLNYYA

SEQ ID NO: 16973 - protein, 299 aa, Mycobacterium smegmatis str. MC2 155
MSDIILGKNQYGKAENRVVRIYRDSPRHEIRDLNVSTCLRGDFSGAHLTGDQSQVLPTDSQKQTAYAYAKQPGITTIEEYGLALARHFVDDVEPVAAARIEIDEYAWERVVVDGTEHDHTWIRKGQETRTAAVTVDADGAWIVGGLKDLVILKSTGSEFAGFLTDEYTVLEPTHDRVMATSLIAQWRFTTTDADWDDIYTGVKAHLVEQFAVLQSKALQQTLFHMGKAVLESYPMIAEVRLSAPNKHHFAYDLSRFGLENNNEVFHADDRPYGLIQATVIRDDAPPPGPAWDLQQGWLA

SEQ ID NO: 16974 - protein, 503 aa, Cryptococcus neoformans var. neoformans B-3501A
MPPRITSRALSTLSTAQSSAGSSSTLPPSTFSLRQHKRSPSSHSFTFRHFGPLLAHPRNPSTASLGWRRSFHSSTVHPASAKDPYNVLGVNKDASSSDIKKAYYSLAKKWHPDSSKEKDAKEKFHEIQAAYDILSDDKKRQAYDRYGSASTQEGFDPNFAHGAGGFGGFQGFGPGFGDGASDLFESLFGGAFGGGSSAFGGRQRPVRGDDLEVGVNLSFLEACNGVTRKVTVTPVIDCKTCTGSGLKPGEKKSQCPACRGSGQRTFQVQGMVMASTCQTCGGTGSTIPKNARCGECDGVGKVKEKKVLDVEIPAGVEDGMMIRVPGAGDKPLSASGPAGDLLVRVLVKPSSVFRRQGVNLYHDAKVPLHIALLGGVIRIPTLEGDVDVKVKNGTQNGEEAVLKGRGVKSVYGGRRNDRGDLIVGWKVQIPRSLTPFQRKILQAYADDIEGRNPQVHFGPLPSDPPVTSPSSPPKEPTNGETKKEIGEEGRQTKSEEDEVGGKI

SEQ ID NO: 16975 - protein, 547 aa, Cryptococcus neoformans var. neoformans B-3501A
MPPRITSRALSTLSTAQSSAGSSSTLPPSTFSLRQHKRSPSSHSFTFRHFGPLLAHPRNPSTASLGWRRSFHSSTVHPASAKDPYNVLGVNKDASSSDIKKAYYSLAKKWHPDSSKEKDAKEKFHEIQAAYDILSDDKKRQAYDRYGSASTQEGFDPNFAHGAGGFGGFQGFGPGFGDGASDLFESLFGGAFGGGSSAFGGRQRPVRGDDLEVGVNLSFLEACNGVTRKVTVTPVIDCKTCTGSGLKPGEKKSQCPACRGSGQRTFQVQGMVMASTCQTCGGTGSTIPKNARCGECDGVGKVKEKKVLDVEIPAGVEDGMMIRVPGAGDKPLSASGPAGDLLVRVLVKPSSVFRRQGVNLYHDAKVPLHIALLGGVIRIPTLEGDVDVKVKNGTQNGEEAVLKGRGVKSVYGGRRNDRGDLIVGWKVQIPRSLTPFQRKILQAYADDIEGRNPQVHFGPLPSDPPVTSPSSPPKEPTNGEGSYPSYRSQNQPQAEHAPHRPSRPPAEPYKPYNPLSSSEEPISLANKLASAIGGAIGWVERFMRGRR

SEQ ID NO: 16976 - protein, 315 aa, Pseudotsuga menziesii
IDGATDKTYNFAEVELISRKVAAGLAKLGLKKGQVVMLLLQNCIEFAFVFMGASILGAIVTTANPFYKPGEIAKQAKAADARIIVTQAAYADKLADLQRDDVTVITMDGVPKEGCQHISVLTEADETQCPSVEIHPDDVVALPYSSGTTGLPKGVMLTHKGLVSSVAQQVDGENPNLYFHSEDVILCVLPLFHIYSLNSVLLCALRAGAATLIMQKFNLTTLLELIQRYKVTVAPIVPPIVLDITKNPVVSQYDVSSVRMIISGGAPLGKKLEDALRDRFPKAIFGQGYGMTEAGPVLAMNLAFAKEPFPVKSGS

SEQ ID NO: 16977 - protein, 542 aa, Ralstonia solanacearum GMI1000
MGHMMSAPLLISTIIEHAARNYGSTEVVSRRVEGDGGELHRTTYAAVRDRAKQLANALAALGVQPGERIGTLAWNGYRHLEIYYGVSGSGAVCHTINPRLFPDQVAYIVNHADDQYVFFDLTFVPLVEGLAPHCPNVKGWVAMTDRAHMPASSVPMLCYEDLLAAQRAEYTWPLFDENTASSLCYTSGTTGNPKGALYSHRSTVLHSYGSALPDALGCSAQDVILPVVPMFHVNAWGLPYSVPLVGAKLVFPGPKLDGASLYELFEQEQVSFSAGVPTVWLGLLQHVQGKGLKFSSFRRTVIGGSACPPAMIRTLNALGVEVIHAWGMTEMSPLGTTCKLMSKHNGLPDETRQQVLERQGRAIYGVEMKIVDGNGHELPWDGKAFGDLHVRGPWTIASYYRNGQSPLVDGWFPTGDVANIDPDGYMQITDRSKDVIKSGGEWISSIDVENVAAAHPAVHMAACIACRHPKWDERPLLVVMKKPGAELTRDEMLRYFEGKVAKWWIPDDVVFVTEIPLTATGKMQKLKLREQFRDYQLPLAQA

SEQ ID NO: 16978 - protein, 318 aa, Striga hermonthica
MATFPVINMAKLNGEGRPATMAQIEDACQNWGFFEVVNHGISAEFMDRVERLTKEHYKKCMEQRFKEMVAAKGLEAVQSEINDLDWESTFFLRHLPSSNISEIPDLHPEYREVMKEFAAHLEKLAEHLLDLLCENLGLEMGYLKKVFYGSKGPTFGTKVSNYPPCPKPDLIKGLRAHTDAGGIILLFQDDKVSGLQLLKDGQWVDVPPMRHSIVVNIGDQLEVITNGKYKSVMHRVIAQTDGTGRMSLASFYNPGSDAVIYPAPALVEKAENNELYPKFVFEDYMKLYAGLKFQAKEPRFEAFKNMDKAANLGPIATA

SEQ ID NO: 16979 - protein, 474 aa, Leifsonia xyli subsp. xyli str. CTCB07
MFRDSSEVLKYIKETDVKFLDIRFTDLPGVQQHFNIPAATVDEEFFSVGQLFDGSSIRGFASIHESDMQLIPDVSTAYIDPFRHERTLIMVFDIYNPRNGDIYAKDPRQVAKKAEKYLATAGIADTAFFAPEAEFYIFDDVRYEVKQNAIFYAVDSSEGAWNSGREEEGGNLANKTPYKGGYFPVSPVDQHADLRDDIVLKLVEAGLEVERSHHEVGTAGQGEINYKFDTMVSAADDILKFKYIVKNTANEWGKTATFMPKPLFGDNGSGMHTHQSLWNDGKPLFYDEAGYGALSNIARWYIGGLLKHAPAVLAFTNPTVNSFHRLVPGFEAPVNLVYSAGNRSASIRIPITGSNPKAKRIEFRAPDASGNPYLAFAAQLMAGIDGIKNRIEPHEPVDKDLYELPPEEARNIPQVPASLGEALDALEADHDFLTAGGVFTPELIETWIEYKREKEIKPLAQRPHPFEYELYYGV

SEQ ID NO: 16980 - protein, 633 aa, Lactobacillus plantarum WCFS1
MCGLVGCLTDRRKVDNAAYDQVVREMTKMIVHRGPDDEGYFADDNITMGFRRLSIIDLAGGHQPLSYDNERYWLTFNGEIYNYVELREQLIQEGYTFKTDSDSEVILGMYAKYQAKLTTYLRGMFAFVIWDKQEKTLFAARDQFGIKPFYYAIAGDDFYYASESKAIYKILKDKHFDQEALQDYLTFQYVPETETLTKEIKMLAPGCSLTKQLGHAPQIKRYYHWEFHPVVRSEQDYATRLKETLIDSVKIHMRSDVPVGTFLSGGIDSSIVVAIAKQFNPNLKTISVGFERPGYSELDVAQETAAKLNVDNVQMTITPEAFMAAFPHFVWSMDDPLADPAAVPQYFLTKEAVKHVKVCLTGEGADELFGGYTIYHEPESLKAFRYTKPINGALQRIAAMMPAGMRGRSLLMRGTTPLEKRYVGNAFIFNETEKQQFMKHYNRDHSFQQTTRVFYDEAKHYDLISKMQFIDMHTWLNGDLLHNADRTALAHSLELRTPFVDREVFNLAAEIPANLRISHGTTKYILRKAVEDIVPAHVLYRKKLGFPVPIRLWLKDEMYDWAKNIIVTSQTDQYFDKTYFLKLLDDHRAGIRDNSRQLWTVLTFMMWHKLYVEADMLMDSVTANHLAEQVEIG

SEQ ID NO: 16981 - protein, 405 aa, Azoarcus sp. BH72
MTGDRHGCENAALVRRREAAMPHFPAPVVSRLPQVGTTIFTVMSRLAQECGAINLSQGFPDFNADDALFERVAHWMRTGHNQYAPMAGVPALREAVAGKVAALYGSTYDVEHEVTITAGATQALFTAVAALVHPGDEVIVFEPVYDSYGPAVELAGGRVVRMQLAAPDYRPDWAAVAAAITPRTRMIMINSPHNPTATVWTAADYDRLAALLRDTGIIVVSDEVYEHIVFDGLQHRSCAAHPELAARSIVVSSFGKTYHITGWKVGYVVAPRELMAEFRKVHQFNVFTVNTPVQYALADYMAEASRHLGLAAFYQAKRNLFRDALAGSRFELLPSRGTYFQLARYSAISDEGDVAFCNRLARQVGVAAIPVSAFFADGRDERVIRFCFAKNDTTLNAACERLRAL

SEQ ID NO: 16982 - protein, 470 aa, Leifsonia xyli subsp. xyli str. CTCB07
MSESVSLPALGESVTEGTVTRWLKNVGDHVDVDEPLLEVSTDKVDTEIPSPVSGVIEAILVQEDKTVEVGTALVTIGDGSGAGEPPAAPAAETTAPAAEAAPASPGPAAQETAAAAAVLSAPTVDATPAPAQQATVAPAVAAPTVEAALAPAQQAAPAAAPAPAPGGAHTGNVGYVTPIVRMLANQQGVDLSAVTGTGVGGRIRKEDILSAAAPAATGLAAAAVPAPAAEVSPLRGTTQPMSRLRKVVAERAVVSMQSTAQLTSVVEVDVTKVAALRDRVKSDFLAKTGVKLSFLPFFALAAAEALKTYPVINATVDGDNIVYPNQENMSIAVDTERGLLTPVVRNASELDLAGLAKEISDLAERTRDNRLKPDELAGGTFTLTNTGSRGALFDTPVVFLPQVAILGTGIVTKKPVVVSADGTDSIAIRSTIYLALSYDHRIVDGADAARFLVAVKNRLEGADFERSLGL

SEQ ID NO: 16983 - protein, 457 aa, Leifsonia xyli subsp. xyli str. CTCB07
MSEQNFDIVVLGGGSGGYAAALRAVELGFTVGMIEKDKVGGTCLHRGCVPTKALLHAAEVADYSRESGKYGIVTQMQGVDINGVTEYRQGIVTKKYKGLQGLVKARGITVIEGEGRLVSPTTVQVGEDTIVGKNIILATGSFSRSLPGLEIGGRVITSEQALELDFVPQKVAVLGGGVIGVEFASVWKSFGADVTVIEALPHLVPNEDESISKSLERAFRRRGIDYRLGVRFAGVSQHENGVVVSLEDGSTVEEELLLVAVGRGPLTQGLGFEEAGITLDRGFVITDERLRTSVPGVYAVGDIVPGLQLAHRGFQQGIFVAEEIAGLNPVVIPDVNIPKVTYCDPEVASIGLTEIKAVEQYGADRVTSYDYSLAGNAKSEIIGTNGSVKVVRVNDGPVVGVHMIGARVGELIGEAQLAVNWEAYPEDIAPLIHAHPTQNESLGEAFLYLSGKPLHTL

SEQ ID NO: 16984 - protein, 269 aa, Thermococcus kodakarensis KOD1
MLEGFIANLSSWLLSISGGSLIMVAFYAGLFVALMTTLGALLAIFANRMPGWGVDVSLSFAAGVMIVASFTSLILPAIESTGTFTPAGVGILLGVILIYLIDRFIPHEHLVKGYEGPREFKERLRVVWLIVLAVIIHNLPEGMAVGTSLVYDLERGLITAIAIGIQDFPEGTVVSLPLATLQKKRLMPIVMGALSGVAEMVMVILGAFLFTVFHSLLPYGLGMAGGAMLYVTVKEMIPEIYKREENETLVTLGFFLGFYVMLFLDSMLG

SEQ ID NO: 16985 - protein, 346 aa, Corynebacterium efficiens YS-314
MGAMRIATLTSGGDCPGLNAVIRGIVRTASNEFGSTVVGYQDGWEGLLADRRVQLYDDEDIDRILLRGGTILGTGRLHPDKFRAGIDQVKANLADAGIDALIPIGGEGTLKGAKWLADNGIPVVGVPKTIDNDVNGTDFTFGFDSAVSVATDAIDRLHTTAESHNRVMIVEVMGRHVGWIALHAGMAGGAHYTVIPEVPFDISEICKRMERRFQMGEKYGIIVVAEGALPKEGTMELREGEVDQFGHKTFTGIGQQIADEVHRRLGHDVRTTVLGHIQRGGTPTAFDRVLATRYGVRAARACHEGQFNTVVALKGERIRMISFDEAVGTLKKVPMERWVTAQAMFG

SEQ ID NO: 16986 - protein, 145 aa, Triticum aestivum
MPVLVLVLMALVMVCLSANGAAAQRASGVAATYNLYNPEKINWDLRVASVYCATWDADKPLAWRQRFGWTAFCGPAGAHGQSSCGRCLKVTNRTTGARTVARVVDQCDNGGLDLDAAVFRRIDTDGGGVANGHLIVDYEFVGCQD

SEQ ID NO: 16987 - protein, 409 aa, Aspergillus nidulans FGSC A4
MSFRGGGRGGFSGRGGGFGGRGEMGTFMHACEGEMVCESINPKIPYFNAPIYLENKTPIGKIDEVLGPINQVYFTIKPQEGIVATSFKPGDKVYIGGDKLLPIEKYASFCPWESAKAKKAVGARGGGRGGRGGARGGGFRGRGGAPRGRGAPRGGSFGFRGGAGAFPCMSMSRRTSAMPANSSSHSGVSASADGGQEKQKMLLSSDTGHFSMVRALHLADLVTELNVMSVFSSLRYCLGDPHDYGAIWAALGFMPFGLFFDFMDGRIARWRKKSSLMGQELDSLADLISFGMAPAAAAFALGIRTPLDHLFLTFFVLCGLTRLARFNVTAAVLPKDKTGKSKYFEGTPIPTTLSIVAVMAYWVSQEWILEDIPLGVAAQGTTLEFHPIVLLFVLHGCLMVSKTLHIPKP

SEQ ID NO: 16988 - protein, 479 aa, Exiguobacterium sibiricum 255-15
MNGKFLINGQWLDQGRERTDVKNPATGEVVGSVPNGTKSDVNDAVEAAHNAFPDWSKRTVYERAALLEKLYAKMLEKKDELARLMTLEMGKPLAESEGEVEYAANFVKWFAEEGKRAYGRIIPSHDATKRLHVIKQPVGVVAAITPWNFPAAMITRKLAPALVAGCTFVLKPPTATPLTALRLLELCQEVGIPDGVVNAVTGSGKDLGESLATHPHVAKITFTGSTEVGRTLMAQGAETIKAMSLELGGHAPILVFDDCDLDLAVRETIKSKFRNGGQTCVCGNRIYVSDSIYDEFVEKLGQETAKLKTGNGLDQETKIGPMINKAGYDKVKKHVDDATSAGARIVTGGSGQTDDDNDVYYYEATVLADVTPQMLIMNEETFGPVAPVQRVSSDEEAVHYANQTPFGLASYVFTNNYARAFKAIEHLDYGIVGWNDGVPSAAQAPFGGMKQSGVGREGGSEGLEAYLETKYVSIGGLDQ

SEQ ID NO: 16989 - protein, 166 aa, Triticum aestivum
MAARLALVVALLCAGAAAAAAQQASNVRATYHYYRPAQNGWDLGAPAVSAYCSTWDAGKPYSWRSRYGWTAFCGPAGPRGQASCGRCIRVTNTGTGAQITARIVDQCANGGLDLDWDTVFVKIDTDGMGYQRGHLIVNYQFVDCRDNHINFHGKNETLPASTDAVA

SEQ ID NO: 16990 - protein, 311 aa, Pseudotsuga sinensis
IDGSTNKTYNFAEVELISRKVAAGLAKLGLKKGQVVMLLLQNCIEFAFVFMGASVLGAVVTTANPFYKPGEIAKQAKAADARIIVTQAAYVDKLADLQSEDVIVISIDGAPKEGCQHISVLTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLDITKNPIVSQYDVSSVRIIMSGAAPLGKELEDALRERFPKAIFGQGYGMTEAGPVLAMNLAFAKEPFPV

SEQ ID NO: 16991 - protein, 312 aa, Burkholderia sp. 383
MPIDNHIAALLARLALAEPPSSLDALRQATETTLTGWHGPLEAVDRTETFAVPTRDGRQIRVRAYWPAATSAHAERQPAIVYAHGGGWCLGTLELYDNPCRALANATQCVVLSVDYRLAPEHEFPVPLEDFCDALDWVFGEAAGLGLDPARIAVGGDSAGGNLAAAACLVARERGGPSIAHQLLLYPPLDASMSTTSYRTCGQGYYLTDEIMQYCFDLYLADPADGSSPSVSPLRAASLEGLPPATLLACEYDPVRDDAHAYAARLREAGVPVDCVVLPGMIHACIHMVGVTPAARQVFDVAGAQMRRAFQR

SEQ ID NO: 16992 - protein, 509 aa, Ralstonia solanacearum GMI1000
MHTPITPTGLEGQSELRRRLRARHLTMIALGGAIGTGLFVASGASIAQAGPGGALFTYTLIGVMVYCLMTSLGELAVHLPVSGSFVTYSRLYVEEGFGFALGWNYWFALAVSVAVELAAAQLVMKYWFPGVSGMVWSAAFLLLMFVLNAFSVRGFGEAEYWFSMIKVVTIVVFLLIGLAMIFGIMKGGPQSGWHNFTVGDAPFVGGLPAMIGVAMIAGFSFQGVETIGVAAGEAENPARTIPRGIRQTFWRILLFYVLAILIIAVLLPYTDPNLLRNEATDIGVSPFALVFQHAGLAFAAGMMNAVVLTALLSSGTSSLYVSTRILYDLALEGQAPRWFARVSGNGVPHRALLATSAVGALCFFSSLFGDQVVYLWLLNTSAVTCFIAWFGIALAHYRFRKGFLHQGHTVDQLEYRSPFFPFGPILVAALCVIIILGQNTKALFAPIDNFGAFVATYCGVFLFVAIWLGYRWRYKTRFVRYEQMQFSPRHIRAAQAGDGGAALPGVAAD

SEQ ID NO: 16993 - protein, 512 aa, Ralstonia solanacearum GMI1000
MSEHTTASAGTPGLRRTLRARHLTMIAIGGSIGTGLFVASGASVSQAGPGGALAAYVLIGTMVYFLMTSLGELAAYMPVPGSFATYGARYVDEGFGFALGWNYWYNWAVTIAVELAAAQLVMHYWFPEVPGVLWSAGFLAVMFLLNAISVRGFGEAEYWFALIKVVTVLCFIAIGLAMIFGIIKGAPASGLHNLTLGEAPFVGGLPAMIGVAMIAGFSFQGTELIGVAAGESADPARTIPRAVRQVFWRILLFYVLAIFIIGALVPYTDPNLLSTEVANIGVSPFTLVFRHAGLAFAAGLMNAVILTAVLSAGNSGMYASTRMLYNLATEGRAPRLFARLSKNGVPRNALLATTAVGALCFLSSLYGDKTVYLWLLNTSGMTGFVAWLGIAISHYRFRKGLVLQGHDPALLPYRSPFFPYGPLFAFGLCLVITLGQNYQAFASGRVDWAEVTATYIGIPIFFAVWLGYRLVRGGGIIRYQDMRFPRPPVTRDPPGEAPAAPGLPAAATSPQR

SEQ ID NO: 16994 - protein, 446 aa, Nicotiana tabacum
MASRNVLQQQNIGEAVPGALKQKNMAAAAQGRNRKALGDIGNNMVTVRGVEGKPLPQRPITRGFCAQLLANAQAAAENQKKSMVVNGDAPIVAKGVLPVKGAAKKPVQKKAAVKPKPDVIEISPDTEEQVKENKQKKKAGDDSSVKKATLTSTLTARSKAACGLSHKPKVQIVDIDAADVNNELAVVEYVEDIYNFYKIAENESRIHDYMDSQPEITARMRAILIDWLIEVHHKFELSQETLYLTINIVDRYLAVTTTSRRELQLVGMSAMLIASKYEEIWAPEVNDFVCISDKAYSHEQVLGMEKRILGQLEWYLTVPTPYVFLVRYIKAAVSNAQMENMVYFLAELGLMNYATNIYCPSMIAASAVYVAQHTLNCTPFWNDTLKLHTGFSESQLLGCAKLLVSYHMEAPEHKLKVIYKKYSKPERGAVALQPPAKSLLAASSYE

SEQ ID NO: 16995 - protein, 447 aa, Pseudoalteromonas tunicata D2
MNKLTLAPTSKMNSPDFIFGVATAAFQIEGAANTRLPNIWDTFCSIKGNISDGSNGDIACDHVNLWQQDLALIASLGVDAYRLSIAWPRVMTKEGTLNQAGVDFYIRLLDQLKTYNIKAFVTLYHWDLPQYLEDQGGWLNRNTAYEFAHYADLISQAFGERVYAYATLNEPFCSAYLGYEAGIHAPGLKGKQYGKKAAHHLLLGHGLAMLALQKNSPKSQNGIVLNFTPAYPASDSKADINAARYADDYFNQWYIKPIFNGCYPDLINTLPKEQQPDILPGDMTIISQKLDYIGVNYYTRAVYQADATHIFKELPPQAPKTDIGWQIYPQAFSQLLTHLHQTYPLPPMYITENGAAMADKLEHGHVHDQNRIDYYQSHLDAVNDAIDIGVDIRGYFAWSLMDNFEWAEGYSKRFGIVYVDYQTQQRTIKASGLAYRNLILQRNQDKK

SEQ ID NO: 16996 - protein, 371 aa, Nicotiana tabacum
MANEENKAAPTNTSRASNKRAFDDTLAAASSNGNDPLLKRVVLGELTNLEYVVGSTKTNTHNSKHKIKLKKTAPTKRKKIAIQSFKSDAATNFSPNDDLQKCAYAPLIYQHLHSLEVEARRRPLSNYMEKVQNDVTPTMRMILVDWLVEVADEYKLVSDTLYLTVTFVDRFLSSHVMARNSLQLLGVSCMLVASKYEEISPPHVEDFCYITDNTYTGEEVVNMERDLLNFLNFEISNPTTKTFLRIFTKVSQDNVDFLTLHFEFLGCYLAELSLLDYSCVRFLPSAVAASAIFLSRFTLLPKVHPWNLALQHCTGYKPSELKDCVLVIHELQSGRRAASVQAVRKKYMDHKYKCVAALHPPDIPACFFDDA

SEQ ID NO: 16997 - protein, 114 aa, Sinorhizobium meliloti
EKITGRVFGDTIRPLLLSVRSGARASMPGMMDTVLNLGLNDQSVHALGHDADDARFAWDSYRRFIQMYGDVVMGVDHEVFEEVLEDEKARLGHEQDTELSAVEWQHVISRYKEA

SEQ ID NO: 16998 - protein, 680 aa, Oryza sativa (japonica cultivar-group)
MAALVVLWPTLLPLVLLANLLPLPRHGRALELMNWSCNNGSSYAANTTYHSNVRAVLTALSAITPNSTARFATASAGRGGADAVWGLALCPRRHRPRRVRVLPRRRAGRRLRRVPRRQGRGRVLRPLPRPVLVRGLHVEARQHGGPDREPQREPRHVDAGRFDALVARLAGALADWAAYNSTRRYAAGLMASGDGFTSTTEDMVHNIHGVVQCTPDQAAAACRACLETLRVDMPKVFAGRIGGRFDAVWCNLRYETFLFYDGDPTVRLAASPSPGSSSSPLPSPSPSLPPLEGKRRNRPKNAAIVVVSVLASLVVLLSLLSFYLWRKLQAKQYTDENDIYSGSLLFDLATLRKATASFAEHNKLGHGGFGAVYKGFLPDGREIAVKRLDKTSGQGLEQLRNELLFVAKLRHNNLAKLLGVCIKGEEKLLIYEYLPNRSLDTFLFDPEKRGQLNWETRYQIIHGIARGLLYLHEDSQIKIIHRDLKASNVLLDANMNPKISDFGLARLFDGTKTASITNHVVGTLGYMAPEYAVLGHVSVKLDVYSFGILVLEIVTGRRNTDVSGEVEESNNLLSYVWDHWVKGTPLEIADASLLGDGRSLSDMELLKCVHFGLLCVQENPVDRPTMLDILVMLHDVDTNSFVAPSKPAFTFAHGGNTTSSSQGVAALSTNEVSISEFVPR

SEQ ID NO: 16999 - protein, 65 aa, Sinorhizobium meliloti
DPEVQLWGAIGAVFSSWMNPRAITYRHLHGIPAGWGTAVNVQAMVFGNLGNSSATGVAFTRNPST

SEQ ID NO: 17000 - protein, 405 aa, Chlamydia trachomatis
MSMDKLSIRDLSLEGKKVLVRVDFNVPIKDGKILDDVRIRSAMPTIHYLLKQDAAVILVSHLGRPKGGVFEEAYSLAPIVPVLEGYLGHHVPLSPDCIGEVARQAVAQLSPGRVLLLENVRFHKGEEHPDEDPSFAIELAAYADFYVNDAFGTSHRKHASVYRVPQLFPDRAAAGFLMEKELEFLGQHLLVEPKRPFTAILGGAKMSSKIGVIEALLSCVDHLVLAGGMGYTFLRAMNRQVGNSLVEESGIPLAKKVLEKAQALGVKIHLPVDAKVAKQCDSGEDWRELSIQEGIPEGLAGFDIGAQTIELFSKVIQESATIFWNGPVGVYEVPPFDQGSKAIAQCLASHSSAVTVVGGGDAAAVVALAGCTSQISHVSTGGGASLEFLEKGSLPGTEILSPAQS

SEQ ID NO: 17001 - protein, 317 aa, Yersinia pestis CO92
MTDKLTSLRQITTVVADTGDIAAMKLYQPQDATTNPSIILNAAQIPEYRKLIDEAIAWAREQSSDHAQQIVDATDKLAVNIGLEILKLIPGRISTEVDARLSYDTVASVAKAKRLIKLYNEAGISNDRILIKLASTWQGIRAAEQLEKEGINCNLTLLFSFAQARACAEAGVFLISPFVGRILDWYKANGDQKEFAPSEDPGVVSVTEIYQYYKKHGYKTVVMGASFRNLGEIIELAGCDRLTIAPSLLKELAESEGPVERKLAYTGEIQAKPAPLTEAEFYWQHNQDPMAVDKLADGIRKFAIDQGKLEKMISDLL

SEQ ID NO: 17002 - protein, 422 aa, Corynebacterium glutamicum ATCC 13032
MNTSAETGILIIGANQSGVQLAISLRATGFTESITLLGEEDHRPYQRPALSKEFLQDKIDKERLIFRSNEYWEENNIRLVKGVRIERIEKNDDGSGVAYGAGQEFAFRRLALAVGARPRHLDLPGATLEGVTYLRNADDALALKAMIGSVTDAVVVGGGFIGLEAACSLHDLGKNVTVLEYGPRLIGRAVGEETAAFFLEQHRSRGVNIVLDARMKQFVGKDGKLSGIELEDGTVIPAQLVIVGIGVIPNTELAAVLGLDINNGIVVDKHAVASDGTTIAIGDVANIPNPIPGSPADERIRLESVNNAIEHAKIAAYSLVGQPEAYAGIPWFWSNQGDLKLQIAGLTLGYDSTVIRQDPEKKKFSVLYYRGDNIIAADCVNAPLDFMAVRSALSRNQNIPADLAADISQPLKKLAVDLEVTR

SEQ ID NO: 17003 - protein, 397 aa, uncultured delta proteobacterium
MKLAERIARIKPSETLAITAKTNALRAQGRDVIGFGAGEPDFDTPVNIKNAAIKAIEGGFTKYTPVTGTDELKDAIVAKLKQDNSLDYKRSQIVVSCGAKHTLYNLAQALFEEGDEVIIPSPYWVSYPDIVVLAGASPVYVTTDEKDGFKMKPQQLSSAISERTRAVIINSPSNPTGAAYSPDELKSLAKVLLDKDILVITDDIYEKIFYADFAFANIASAEERIKDKTIVVNGVSKTYAMTGWRIGYAACSEEIASAMNKIQSQSTSNPTSIAQKAALEAISGDQSAVPQMVNEFSKRRDFIVGALNAIDGIKCFSPEGAFYVFPNVSGVYERAFQGKKITNSAEFIDFLLDEANVAAVPGAAFGSDDHIRLSYATSMKNIEEGIRRIKNAVSKLD

SEQ ID NO: 17004 - protein, 191 aa, Bordetella parapertussis 12822
MLLFPGTFTMQTDYAELVRRTIRSVPDWPTPGVTFRDITPVLQDPRTFRVLIDLFVYRYMRQRLDLVAGVDARGFIVGAVLAHELNLGFVPVRKKGKLPYRTVAEEYSLEYGNAAVEMHTDSVRTGQRVLLVDDLIATGGTMLAAIKLLQRLGANVVEAAAIIDLPYLGGSAQITATGTPLYTVCQYQEGD

SEQ ID NO: 17005 - protein, 595 aa, Aspergillus oryzae
MARLPSQQGRQVHATSTSYVNHAAPVEANYDTANPPYIRKYLRTYGLTPPRAESYEVQKTRCLAQLALKQTAIDKFLYLSTLRKNNVHLFYRLVTDHLRELTPLIYTPVVGEACQRWSEIYQQPEGMYLSWEDRGNLAAVIANWPQPNVEITCITDGSRILGLGDLGINGMGIPIGKLALYTACAGIRPEATLPLTLDLGTSNKTLREDPLYMGSNRDKITPEEEREFMDELMSALTERWPGIVIQFEDFKNPFPALERYRDIYTCFNDDIQGTGAVILGGVINAVKRSGLPCKDHRAVFFGAGSAGVGVAKQIVAFFMREGMTEDEARSCFYLVDTKGLVTNDRGDKLAEHKVYFAREDNEGQQYKTLEEVVDYVKPTILMGLSTIGGVFTPEILRKMADWNTAPIIFPLSNPSSKSECDFETAITHTDGRALFASGSPFQPFSFTNSAGETRTYYPGQGNNMYVFPGIGLGTILSKAVKITDSMIYASGAALSQALTAEEIERGLLYPDLTRIRQVSVVVTRKVIRAAQEDKVDRETALRSMNDDALDAWIKARMYDAHSEVLALEREVGALLHNLNPASLLNGLSSEENAKL

SEQ ID NO: 17006 - protein, 408 aa, Pseudomonas syringae pv. phaseolicola 1448A
MKHLIGGISSGGRALPEIDGQAFNVARSNGPWLWDSKGVRYVDTAMGFGATMLGHAQMEVMAAASAAMLNGPMPSFAHADEEAAAAALATFTGDLSQVIFLNTGSEAVHLACRTARVATGRQRIVKFAAGYDGWYDSVAFGNAGQASALMSGTTRPERDGMLLLRYNDFEDAEQLFRDYSDIAALVVEPVLANAGCIEPAPGYLKHLSDLAHRNGALVILDEVLMGLRLCPGLTGTLLGAEPDLATVGKAIGSGIPVAALVGKPEYMRLFEQGKIVRAGTYSGAPPACAAVLATLKQLATANYAALLTRGDQLRAQLVAAFASKGMAVSSTGYGSVFTLWPSATPPRTYADAAHVADSEWTLALHKALRRERVMSMPFAFGRTYLTFAHQEKALQAVLEGYKAAIASL

SEQ ID NO: 17007 - protein, 380 aa, Dianthus caryophyllus
MSSTAGQVIRCKAAVAWEAGKPLVIEEVEVAPPQKMEVRVKILFTSLCHTDVYFWEAKGQTPVFPRILGHEAGGIVESVGEGVTELQPGDHVLPVFTGECKECAHCKSEESNMCDLLRINTDRGVMLADGKSRFSINGKPIYHLVGTSTFSEYTVTHVGCLAKINPKAPLDKVCILSCGISTGFGATVNVAKPKKGQTVAIFGLGAVGLAAAEGARVSGASKIIGVDLIPARFEAAKKFGVTDFVNPKDHDKPVQEVIVEMTNGGVDRSVECTGNIQAMISAFECVHDGWGVAVLVGVPNKDDAFKTHPMNFLNERTLKGTFFGNYKPRTDIPKVVEKYMNKEMELDKFITHEISFKDINKAFEMMARGEGIRCIIRMDA

SEQ ID NO: 17008 - protein, 379 aa, Yersinia pestis CO92
MAKRDYYEVLGVSRDAEEREIKKAYKRLAMKFHPDRQSEDKNAEEKFKEAKEAYEILTDAQKRAAYDQYGHAAFEQGGMGGGGFGGGGGGADFSDIFGDVFGDIFGGGRRQQRASRGSDLRYNMDLTLEEAVRGVTKEIRIPTLDECDVCHGSGAKPGSSPVTCPTCHGAGQVQMRQGFFTVQQACPHCHGRGQIIKDPCNKCHGHGRVEKSKTLSVKIPAGVDTGDRIRLSGEGEAGEHGAPSGDLYVQVQVKAHPIFEREGNNLYCEVPINFAMAALGGEIEVPTLDGRVKLKIPAETQTGKMFRMRGKGVKSVRGGSQGDLLCRVVVETPVSLSEKQKQLLRELEESFVGAAGEKNSPRAKSFLDGVKKFFDDLTR

SEQ ID NO: 17009 - protein, 438 aa, Kluyveromyces lactis NRRL Y-1140
MPTMKSVVIQISQTRVICGFSNQDLPQLIVPSQYLAYKRDGSDVKVFGKWEMIEHCDDESAEIYQLYDKNGLPNDWDMMDAQWQYIFQSLGIQFEDYPVCVVLPSDLNSARRKRFMEQLLGYGFPMVQLLNEAVCNTLSQGRSSGIVVDIGHSGVKVDVVIDGVLFKQYRKENKIGGAFLNWQICDQYLKQDSGKSTKIWRDATEWLPNFKNSMLQVSPIELDANYDVAPHYQHMVSPMDLTKNFLLDKKTLTFTNKQLYTIGELLFKPVIHVSNNANGDVEMADVNDIEKKPHPEKLIGVIGLIRACIQSLLNGVNAMSTAGSNTTGSSTTTGNASSGNQSNNNEDTNIPTHSYTSEQLQSLLLTNILVTGSTSNIQGLEQRILNDVSVSLNDLTTVRPKILFKQTKLDRNFQSWQSATTLCRLPLRESLHAWESIE

SEQ ID NO: 17010 - protein, 492 aa, Campylobacter jejuni RM1221
MKQKCVLIITDGIGYNKNSKFNAFEAAKKPSYEKLFKEVPNSLLKTSGLAVGLPEGQMGNSEVGHMCIGSGRIIYQNLVRINKAIENKELEKNENLQKLLAKCKRVHIIGLYSDGGVHSMDTHFKAMLEICAKNGNEVFAHAITDGRDVSPKSGLNFIKDLKGFCENLGVHFATLCGRFYAMDRDKRWDRVKEYYECLLGKAYKVPNLLEYLQKSYDENVTDEFIKAAQNENYKGMREEDGIIFINFRNDRMKQLVEVLNSKDFKEFEREKIFENLLTMSVYDDKFKLPVLFEKEKIENTLAQVISKAGLSQLHTAETEKYAHVTFFFNGGKEELLENETRVLIPSPKVKTYDEKPQMSAFEVCDAVKKGIEKGEDFIVVNFANGDMVGHTGDFNAAIKAVEAVDTCLGEIIECAKKHDYAFIITSDHGNCEAMQDEKGNLLTNHTTFDVFVFVQAKGVSKIKDNMGLSNIAASVLKILDLEIPKEMNEALF

SEQ ID NO: 17011 - protein, 441 aa, Xanthomonas campestris pv. vesicatoria str. 85-10
MGPRRTPSDLTMTSPPSQAPLHLVVVGGGFAGLWATRALDDPGIRITLVDRQNHHLFQPLLYQVATAGLSAPDIAAPLRHILREQRNVEVLLGDVTDIAPDRREVVLADGSTLGYDMLLLATGATHAYFGNDQWAEHAPGLKTLYDALVLRRKLLLAFERAEAESDPAARAAWLSFAVVGGGPTGVELAGTLAEIARHTLKNEFRHIDPRQARVRLVEAGPRVLPSFPEDLTAKARKQLERLGVEVHTGTPVTQIDVLGYQLGDTFVPARTVVWAAGVAASPLARTLGVPLDRAGRVLVEADLSVPGHPDIFVGGDLASVQQDGRPVPGVAPAAKQMGKHIAKAIRARQRGQTAPAFRYQDYGNLATIGRMAAIVHVGKLKLSGIVAWWFWLAAHVYFLIGFRNRFVVLVNWAMAYWSYQRAARIIFGGAADDPPPSSKDG

SEQ ID NO: 17012 - protein, 309 aa, Pseudotsuga sinensis
GATDKTYNFAEAELISRKVAAGLAKLGLKKGQVVMLLLQNCIEFAFVFMGASILGAIVTTANPFYKPGEIAKQAKAADARIIVTQAAYADKLADLQSDDVIVITMDGAPKEGCQHISVLTEADETQCPSVEIHPDDVVALPYSSGTTGLPKGVMLTHKGLVSSVAQQVDGENPNLYFYSEDVILCVLPLFHIYSLNSVLLCALRAGAATLIMQKFNLTTLLELIQRYKVTVAPIVPPIVLDITKNPIVSQYDVSSVRMIISGAAPLGKKLEDALRDRFPKAIFGQGYGMTEAGPVLAMNLAFAKEPFPV

SEQ ID NO: 17013 - protein, 382 aa, Coprinopsis cinerea okayama7#130
MGLQYVARLGRFWLLGDIDNSTTSTGPGESDHLKVLHRRTEGIDRHDPKFIVFVVLIPVLVLLSGLFAGLTLGYMSLDETQLNVLSVSGTPEQREYANRIKPIRENGHRLLVTLLLANMIVNETLPVIADPVLGGGVPGVVMSTVLIVIFAEIIPQSLFSRHGLYLGAKMAGLTTCLLYGLVCGLYFRITCLRESSWPHLPQSRQVYLPLWWSDTLSSECLELKELIAMHSASATHGGDLKADTVNIIGATLDLQEKVVKQIMTDIKDVFMLSIDAKLDYTLLKQICETGHSRVPVYEEVDIPLPPTSGDGASSHERKLTHRVRRIVGILLVKTLVVQSLAGTATPPSARESQLSAIKKTSNFLEQALPSDAILSPEDADHV

SEQ ID NO: 17014 - protein, 317 aa, Pseudotsuga sinensis
LIDGSTNKTYNFAEVELISRKVAAGLAKLGLKKGQVVMLLLQNCIEFAFVFMGASVLGAVVTTANPFYKPGEIAKQAKAADARIIVTQAAYVDKLADLQSEDVIVISIDGAPKEGCQHISVLTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLDITKNPIVSQYDVSSVRIIMSGAAPLGKELEDALRERFPKAIFGQGYGMTEAGPVLAMNLAFAKEPFPVKSGSC

SEQ ID NO: 17015 - protein, 336 aa, Ralstonia solanacearum GMI1000
MSNTYQRIVLASRPEGAVTPDNFRLETAQIPELQDGQVLVRNHFLSLDPYMRGRMNDSKSYAQPQPLGEVMIGGTVGVVEASRNPAYAVGDNVVGMFGWQEVGISDGRGMQKVDTRHVPLSAYLGSVGMPGVTAWYGLNRIMHPKPGQTVAVSAASGAVGSVVGQLAKLKGCRAVGFAGGKDKCDYVVNELGFDACIDYKAAKDPKELYAMLKEATPDGIDAYFENVGGDILDAVLRRMNPFGRIAMCGMIAGYDGQPLPLQNPQLILVSRLTVEGFIVSEHMDVWPEALRELGGSVAQGKLKFRESVAQGLASAPEAFIGLLKGKNFGKQLVKLV

SEQ ID NO: 17016 - protein, 341 aa, Chlamydia trachomatis
MTTWDLAMRIVINGFGRIGRLVLRQILKRNSPIEVVAINDLVAGDLLTYLFKYDSTHGSFAPQATFSDGCLVMGERKIRFLAEKDVQKLPWKDLDVDVVVESTGLFVNRDDAAKHLDSGAKRVLITAPAKGDVPTFVMGVNHQQFDPADVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAICEAVKHAANTSMKNIMYYTEEAVVSSDFIGCEYSSIFDAQAGVALNDRFFKLVAWYDNEIGYATRIVDLLEYVQENSK

SEQ ID NO: 17017 - protein, 285 aa, Rhizobium leguminosarum bv. viciae 3841
MPNYPTPPFPSQKQPMPGFTARMDPVPDHGEKSYRGSERLKGKRAIITGGDSGIGRAVAIAYAREGADLVLSYLDEDEDADETKRLVEQAGRKAILVSGDIQDPAHCRQIVETAVKELGGIDILVNNAAHQASFKSIDEISDEEWELTFKVNIHSMFYLTKAAVAHMKPGSAIINTASINSDNPNPTLLAYATTKGAIQNFTAGLAQLLAEKGIRANAVAPGPIWTPLIPSTLPEENVSNFGKQVPMKRPGQPAELATAYVMLADPLSSYVSGTTIAVTGGKPIL

SEQ ID NO: 17018 - protein, 293 aa, Brucella melitensis
MSYDVVVIGTGPGGYVAAIKAAQLGLKVAVVEKRKTFGGTCLNIGCIPSKALLHASEVFAEAGHSFDTLGVEVTPKLNLTKMLAHKDTTVKANVSGVEFLFKKNKITPYIGTGKIVGKGKVSVTSEDGKVEEIEAKNIIIATGSDVAGIPGVKVDIDEKVIVSSTGALSFDKVPGSLIVVGGGVIGLELGSVWARLGAKVTVVEYLDKVLGPMDGEVSKQFQRLLEKQGIAFKLGAKVTGVEKVGKGAKITFEPVKGGDAETLEADAVLIATGRRPYTDGLGLQEAGVAVDER

SEQ ID NO: 17019 - protein, 325 aa, Phalaenopsis hybrid cultivar
MESGSFPVINMELLQGSQRPAAMALLRDACENWGFFELLNHGISHELMNRVEAVNKEHYRRFREQRFKEFASKTLDSVENVDPDNLDWESTFFLRHLPTSNISQIPDLDDDCRATMKEFARELEKLAERLLDLLCEDLGLEKGYLKRVFCGGSDGLPTFGTKVSNYPPCPKPDLIKGLRAHTDAGGIILLFQDDKVSGLQLLKDGEWIDVPPLRYSIVVNIGDQLEVITNGKYKSVLHRVVAQTDGNRMSIASFYNPGSDAVIFPAPALVEKEAEEEEKKEIYPKFVFQDYMNLYIRKKFEAKEPRFEAMKSMEIVMSSQPIPTA

SEQ ID NO: 17020 - protein, 428 aa, Idiomarina baltica OS145
MSRSEQLFTQAQISIPGGVNSPVRAFNGVGGSPIFIERADGAYMFDADGQRYIDYVGSWGPMILGHNNQVVLDATITAAQRGLSFGTPTEVEITMAEKIRELVPSIEKVRMVNSGTEATMTAIRLARGYTGRDKILKFEGNYHGHADALLVKAGSGALTLGVPNSPGIPEDFAKHTLTVEYNNIDSVKDIFAQYGDQIACIIVEPVAGNMNCIPPVPGFLEGLRTICDDYSSVLIFDEVMSGFRAAPGGAQERYNVTPDLTTLGKVIGGGMPVGAFGGKKEVMDHIAPTGPVYQAGTLSGNPVAMSAGLAALSQLSQEGLYEQLYARVDQLLDGMQQLADEAGIPFTTNRAGSMFGFFFTKEKQVTSYKQATECNMEHFKAFYHSMLKQGVYLAPSAFEGGFMSAAHSEQDIEDTLAAAKIAFSELSA

SEQ ID NO: 17021 - protein, 172 aa, Aspergillus fumigatus
SMSQVFFDVEYAPVGTAETKVGRIVFNLFDKDVPKTAKNFRELCKRPAGEGYRESTFHRIIPNFMIQGGDFTRGNGTGGRSIYGDKFADENFSRKHDKKGILSMANAGPNTNGSQFFITTAVTSWLDGKHVVFGEVADEKSYSVVKEIEALGSSSGSVRSNTRPKIVNCGEL

SEQ ID NO: 17022 - protein, 223 aa, Zea mays
  misc_feature (50)..(50): Xaa can be any naturally occurring amino acid
  misc_feature (92)..(92): Xaa can be any naturally occurring amino acid
  misc_feature (103)..(103): Xaa can be any naturally occurring amino acid
  misc_feature (125)..(125): Xaa can be any naturally occurring amino acid
  misc_feature (131)..(131): Xaa can be any naturally occurring amino acid
  misc_feature (176)..(176): Xaa can be any naturally occurring amino acid
  misc_feature (209)..(209): Xaa can be any naturally occurring amino acid
  unsure (1)..(223): unsure at all Xaa locations
FASSLPKPYQSTNGVRELLARSLLRTPNPTQTRHPNRRSASVVSFPRRPXVACHVGACVSTDSPSPPPQPGLVAVGVPKHCFRGGDYDYLYXRAIAGWSDSKXLAESRPFYLYKKPQILRNCAAXRNALQXLRSIIVYAVRSNNKLTVLPVLRELACDSVLVSDNKLRLSPSRSDXSPGRSIFNGNEKTLEDLMLCADSAVFVNVDSEXDLKNIVTAARATGM

SEQ ID NO: 17023 - protein, 278 aa, Lactobacillus plantarum WCFS1
MQSKLAVIIGGTSGVGKHTAIDLANQNYHVIIVGSRADKGRQAQADISQATGNQAVQLALADLSTKTGVQQFAHQLAAMTDHIDILLNSIGVILPERHLSADGYDLNLVLNYLTHFWTIQALLPLLKHSDQARILLVGALPFVINHAKVSLPDFDAPATSKYNAMTVTAQATAARVLLTLALSERLTATNVTINIFHPGYVPDSNFGAGGSWVSRLAGRILGESFSRKNSPIGAWLATAPELTHTSGHFYDDRLRQVRLSKQYTRSKANDLWRLSSQY

SEQ ID NO: 17024 - protein, 168 aa, Zea mays
MEYGQQGQRGHGATGHVDQYGNPVGGVEHGTGGMRHGTGTTGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGAYATGTEGTGEKKGIMDKIKEKLPGQH

SEQ ID NO: 17025 - protein, 344 aa, Ralstonia solanacearum GMI1000
MRTWFNGYSDDSQIRTIVQLRPMPSLDPHVAQLLDLVARAKRPPLHHLAPADAKIAYEKSSPIVDIPPIPLDHVHDLTVPARDGYAIPVRTYAAREASWADPLPLLVYFHGGGFTVGSIRTHDALCRSLAAKSGAMVLSVDYRLGPDWKFPTAADDAFDVLQWVFDEAATIGADPARIAFGGDSAGGTLAAITAIEARNRGLAPVLQLLIYPGTTARETTPSHHAFAEGYLLTQAMIAWFFAQYLRSDADRDDWRFAPLDGGGQGADVRGVCPAWISVAGFDPIRDAGIGYADKLRAAGVPVTLKMYEGMIHDFFKLGRFVPAVEDAHYEAADALRRAFGTQAG

SEQ ID NO: 17026 - protein, 167 aa, Citrus sinensis
MFPMVTGFMNYGQQTIRAARYIGQSFMITLSQANRLPVTIQYPYEKLIPSERFRGRIHFEFDKCIACEVCVRVCPIDLPVVDWKFETDIRKKRLLNYSIDFGICIFCGNCVEYCPTNCLSMTEEYELATYDRHELNYNQIALGRLPMSVIDDFTIRTVLNSPQRKNV

SEQ ID NO: 17027 - protein, 228 aa, Larix gmelinii
EIAKQAKAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTALLELIQRYKVTVAPIVPPIVLEISKNPIVSQYDVSSVRIIMSGAAPLGKELEDALRERFPKAIFGQGYGMTEAGPVL

SEQ ID NO: 17028 - protein, 395 aa, Citrus sinensis
MSILATEKEKEFMIVNMGPHHPSMHGVLRLIVTLDGEDVIDCEPILGYLHRGMEKIAENRTIIQYLPYVTRWDYLATMFTEAITVNGPEQLGNIRVPKRASYIRVIMLELSRIASHLLWLGPFMADIGAQTPFFYIFRERELVYDLFEAATGMRMMHNYFRIGGVAADLPYGWIDKCLDFCDYFLTGVAEYQKLITRNPIFLERVEGVGIIGGEEAINWGLSGPMLRASGIEWDLRKVDHYECYDEFDWEVQWQKEGDSLARYLVRIGEMTESVKIIQQALEGIPGGPYENLEIRCFDRESDPERNDFENRFISKKPSPTFELTKQELYARVEAPKGELGIFLIGDQSGFPWRWKIRPPGFINLQILPQLVKRMKLADIMTILGSIDIIMGEVDR

SEQ ID NO: 17029 - protein, 232 aa, Arabidopsis thaliana
MDVLYSSNWLHQESIDEMRQNLQSTLFELETLKMEANEKSRTHREEVNQLLNLLKFTQQERDEARQQLSQFIFHTQQNPNSRSLTKSNSFSHSQDVSSSSSSELSTFLNIHPQPLTNLEDPTAHNHHQQIDPLDVLVMGKAFPETGKLLKAVVEAGPLLETLLLAGPLPKWINPPPQTQSQRFELPSISFRGSDVDSKCDSMTCSGSVNSFGFGSSLVIDQSMLTGKRQRLE

SEQ ID NO: 17030 - protein, 265 aa, Magnetospirillum magnetotacticum MS-1
MPTTIFHENERTMASKRVPTSPYPDQKPGTSGLRKKVPVFRQPHYVQNFVQAIIDCIPDHRGATLVIGGDGRFFNKEVAQIALKIAAANGFGRVLVGRDGLLSTPAASCVIRKHKAVGGIVLSASHNPGGPQGDFGIKFNGSNGGPAPESVTTAIYERTKAIGEYRISDAPDLDLGQIGTTVIDGMTVEVIDPVADYAALMRERSFRRLSNWSPPLPMASCAWGTGPCRGLRGLGPRRLTGPAVGPPTYAVPPYILGTVGLRGQL

SEQ ID NO: 17031 - protein, 223 aa, Larix gmelinii
AKAAGARIIVTQAAYVDKLADLQSDDMIVIAIDGAPKEGCQHISILTEADETQCPSVEIHPDDVVALPYSSGTTGLPKGVMLTHKSQVSSVAQQVDGENPNLYFHSEDVILCVLPLFHIYSLNSVLLCALRAGAATLIMQKFNLTALLELIQRYKVTVAPIVPPIVLEISKNPIVSQYDVPSVRIIMSGAAPLGKELEDALRERFPKAIFGQGYGMTEAGPVL

SEQ ID NO: 17032 - protein, 318 aa, Cryptococcus neoformans var. neoformans B-3501A
MTQPQQPLSLLESFLCGGLAGCGAVTITNIPETMKTRLQLQGELQRNDPSAPRVYRNVLDVFRKTWQHEGIRGLQRGLVPAYGYQTLLNGSRLGLYEPCRRLFNRAIGKDPNEGVFITAITAGAVTGCIGASLGSPLFLIKARMQAYSPHIPVGAQHYYKNSYDALRTILKSDGFFGLWRGVSTAILRTAMGSSVQLPSYNLSKYYLVSSAGMASDSFWTFLAASSVSGVCVCIAMQPPDTALTRMYNQNTIKDPITGKVRGALYTNPFDCLWKTFKAEGIAGWYKGTTAHFLRITPHTIFTLVFNELIMAEYTKWRG

SEQ ID NO: 17033 - protein, 272 aa, Ralstonia solanacearum GMI1000
MCLILTAWHAHPAYALVVAANRDEFYDRPAAPLAWWSDAPHVLAGRDLAQVVGHAGTWMGMTRDGRFAALTNYRAPSERRPDARSRGELVANFLAAEDASIPAYLDQLKARNGVYNGYNLLTATRDELWWTSNRAEAPRQLAPGVYGLSNALLDTPWFKVRHRVAAFAEALAADTGRHGNAIDVARYLDLLAETREAPLGALPATGVAPEWEKLLSAAFIRSPRYGTRASTVLRIRHDGCFDVTERRFDAQGQIGETRYLGVLDAVTQADTP

SEQ ID NO: 17034 - protein, 203 aa, Xylella fastidiosa
MSSPLECAKYLLSAHTTHQLPADDGSEVAFAGRSNAGKSSVLNTLTRQNALARVSKTPGRTQQLVYFTVTPQRYLVDLPGYGYAKVPKELQIHWQTFIDSYFHQRQALRGLVVVMDIRHPLKEYDLQMLAYARQRGLPAQALLTKADKLGRGQQAQTLQKVRNELTKHFADHINIQTFSSKSRQGVEQLHTVIETWLGLARLA

SEQ ID NO: 17035 - protein, 658 aa, Oryza sativa (japonica cultivar-group)
MTVPTMLWSTLVPLVLLAPLFSIPRHCRAQVLMNYSCNNGSSYAENSTYDSNVRAVLATLSASTPNATTGFATASAGRGADTVWGLALCRGDTDHACRGVRDVTVFYDRCIARFSYGDFTARPDNTEVLMVSPSKYQATVNAGHFDALVTRLAGALADWAAYNSTLRYAAGVMASSDGFPSTTGYMVHNIYGLVQCAPDLAPPACRACLQALIVDMPQAFGGRIGGQFNAVWCNLRYETSVFYDGDPAVRLVASPSLEGPNINGSTTLIIGNRRRRPNAATVVVSVLAAVIIALLSVLSIYLWRKLQAKQYTADQDVEAGSLLFDLATLRKATANFAEVNKLGHGGFGAVYKGFLRDGEEIAVKRLDKASGQGIEQLRNELLLVAKLRHNNLAKLLGVCIKGEEKLLVYEYLPNRSLDTFLFDPEKRGQLIWETRYHIIHGTARGLVYLHEDSHIKIIHRDLKASNVLLDSSMNPKISDFGLARLFDGNKTASVTSHVVGTLGYMAPEYAVLGLLSVKLDVYSFGVLVLEVVTGRRNTDVFGAVEESNNLLSYVWDHWVKGTPLAIVDASLLGDGRGPPESEMLKCIQLGLLCVQENPADRPTMLHILVMLHDVDATSFAAPSKPAFTFVNGGHTTGSSSNVAALSLNEVSISEFHPR

SEQ ID NO: 17036 - protein, 411 aa, uncultured epsilon proteobacterium
MNQFEEYCTAFVQGIGSKEGAVSPSVTSSASFAYGTPEIAEGIFDGSVKKPLYSRMGNPTTAKLEAIMADMDGGIGAVATSSGMAATTLATMSLLACGDEIISIGGLFGGTYALFSETLTRFGIKTYFFDVDEFENIKNAINENTKIIFLESVGNPNMRLPDIRKIAQIANDAGVALMVDNTTTPMSVSPLELGADITVYSTTKVISGNSSALGGCVVFRAINDGEDKFKTPRYQELHKFIKGVGKMALIANAKKRVMRDFGMSANANSSYLTMLGLETLPLRMDRIVESVTTVAKELSKNGLNINHPCLESHPHHDRYLSNFKNGCGSLLSIDMGTKEKAYQFLNKTKLATITANIGDNRTLALHMASTIYRDFDEETRKFLGITDGLIRVSIGLENPKDIIEDFLAAAN

SEQ ID NO: 17037 - protein, 237 aa, Triticum aestivum
AGRVREKPTQHPPPPSSKQVPSLSSSPPPPPSLLEMDPAVERLKTGFEKFKTEVYDQKPDLFEPLKAHQSPKYMVFACADSRVCPSVTLGLEPGEAFTVRNIAAMVPSYCKNKHTGVGSAIEYAVCALKVEFIVVIGHSRCGGIKALLNLKDGADDTFHFVEDWVRIGYPARKKVKDECSEMPFEEQCGVLEKEAVNVSLQNLSTYPFVKEAVANGTLKLVGGHYDFVSGKFDTWAL

SEQ ID NO: 17038 - protein, 559 aa, Idiomarina baltica OS145
MWTGKHMNDVDDKSYAEVNQESLYRIFTLPEAPDSTLSRIEKDLSENLLGFLGDHIVAKEKPLQDIERDFEKASIPENPQFVSDHTEFLLEKLVAHSVHTASPKFIGHMTSALPYFLMPLAKLMVGLNQNLVKIETSKAFTPLERNVIGMLHHLVYQRESSFYNRWMHSAQHSLGAFCSGGTVANMTALWVARNQLLKPDGDFAGIAAEGLAAGLAHYNYKRLVVLVSERGHYSLSKAADVLGIGRKNLVAVATDANNRIKIDALRQACQDVREQGGEVLSIVGVAGTTETGHIDPLADMADIAEQLGIHFHVDAAWGGATLLSNDYRHLLSGIERADSVTIDAHKQMYVPMGAGLVLFKDPAMVKAIEHHAEYIIRQGSKDLGSHTMEGSRPGMAMMVFSAMHVIGRRGYELLINNSLEKARYFSSLIAEQDDFEVITEPELCLLTYRFVPKRVKLALEAANVEQVERLTPHLNALTRYIQKRQRESGRSFVSRTKLTPEHYYRVPTVVFRVVLANPLTTHDMLREIIAEQREIAEKATSLRGALHTEMRELGLIRDA

SEQ ID NO: 17039 - protein, 424 aa, Zea mays
MAARAADENRRPAAGKPAPGVRDMASRRALTDIKNLVGAAPYPYAVAKKPMLQKSKRDEKQPALASSRPMTRKFAASLASKGQPECQPIVADPEPEVCQQKESVGDGTVDIDVELYELVDGSDSDIDMGATENKDIMNEDELLMDIDSADSGNPLAATEYVKELYTFYRENEAKSCVRPDYMSSQQDINSKMRAILIDWLIEVHYKFELMDETLFLMVNIIDRFLEKEVVPRKKLQLVGVTAMLLACKYEEVSVPVVEDLVLISDRAYTKGQILEMEKLILNTLQFNMSVPTPYVFMKRFLKAADADKQLELASFFMLELCLVEYQMLNYRPSHLAAAAVYTAQCAINRCQHWTKVCESHSRYTSDQLLECSRMMVDFHQKAGTSKLTGVHRKYSTYKFGCVAKILPAQFLLESGGTPPPSGAN

SEQ ID NO: 17040 - protein, 196 aa, Synechococcus sp. WH 8020
MTATIGHFLQNLCGEYSNQKQAFENPPLFAHIFLRYKPIEHLQPGSILLEQTYAVDPKHPYRLRVIRAEELTSGIIKLWNHTFKEPDRFSSATFDQDCREKIREEDLILLDHCHYQVRQLDDGFHGELEPGCRCIVRRDGKETYLVSSFHLQGDELSTLDRGHDPQTHDRCWGSIAGKFHFQRISHWAENIPETWL

SEQ ID NO: 17041 - protein, 134 aa, Brassica napus
MESYQNQSGAQLTHPQLDQYGNPVPIGTGAYGGAPVMAGHYTEGGGGLSGMLHRSGSSSSSSSSSEDDGLGGRRRKKGITAKIKEKLPGHHGSHQTSSATSTIPVYDATGTGAVHHEKKGIMEKIKEKLPGGHH

SEQ ID NO: 17042 - protein, 197 aa, Synechococcus sp. WH 8103
MITPNVRRFLNLLCGEYSNQQQAFDNPPLYAHIFLRYRSLPQLKPGSILLEQTYAVDPKNPYRLRMIRAEEQPSGAIKLWNHTFQDPARFAGATFDPALRRSIQTPDLISLDQCHYQVVEQSDGYHGAMEPGCQCIVRRDGKDTVLVSSFHLQGESLQTLDRGHDPITNERCWGSVAGPFRFKRTQSWAADLASAWL

SEQ ID NO: 17043 - protein, 179 aa, Brassica juncea
LRDYMSKFGDLEDCIVMKDRSTGRSRGFGYVTFASSQDAKEALKGEHFLGNRILEVKVATPKEEMRQPAKKVTRIFVARIPPSVSESDFRRHFEKYGEITDLYMPKDHNSKQHRGIGFITFATSDSVEDLMEDTHDLGGTTVAVDRATPKEDDPPPRPPPAARMQRPPVAVAGGFGAPG

SEQ ID NO: 17044 - protein, 336 aa, Vibrio fischeri ES114
MSEIRTLGEFIVAKQHDFPHASGELSSLIGSIKLAAKIVNREINKAGLVDITGASGEENIQGEQQQKLDVYANDKFKSALEARDQVCGVASEEEDEAVAFNKELNKNAKYVVLMDPLDGSSNIDVNVSVGTIFSIYRRISPIGTPATEEDFLQPGHKQVAAGYIIYGSSTMLVYTTGNGVHGFTYDPSLGVFCLSHENMQIPKDGNIYSINEGNYIRFPEGIKQYLKFCQESKPEDNRPYTSRYIGSLVADFHRNLLKGGIYLYPSTQAYPNGKLRLLYECNPMAMLIEEAGGKATDGEQRILDIKPSELHQRVPFFVGSTNMVNKVHAFLDEWRD

SEQ ID NO: 17045 - protein, 182 aa, Oryza sativa (japonica cultivar-group)
MPRLHLLLLAVLAVAAAAAEAAAEKKPTAYEVLESYDFPVGILPKGVTSYTLEATTGDFTATLDTGDDDDSSSSTCEFAIEGSYSLRYQRAITGRIATGHLTDLRGVAVKVLFFWLNIVEVTRRGDRLEFSVGIASADFTVDNFLESPQCGCGFDCDDDGISSSSSLPPPLEPSLLRLRGAF

SEQ ID NO: 17046 - protein, 467 aa, Xanthobacter autotrophicus Py2
MSYDLTIIGTGPGGYVCAIRAAQLGLKVAVVEKRGTHGGTCLNVGCIPSKALLYASELFEEAGHKFGEMGIGVPAPKLDLKAMLAFKDKGVDGNVKGVEFLLKKNKVDVYMGAGKILGTGKVEVTLNADGKVEVLETKNIVIATGSDVAPLPGVTIDEQRIVSSTGALSLPKVPGKLLVVGAGVIGLELGSVWRRLGAQVTVVEFLDRILPGMDSDVAKSFQRILDKQGFAFKLGTKVTGVDTSGKTLKVSVEPAAGGAAEVIEADVVLVAIGRIPYTAGLGLDEAGVAKDGRGRVVTDHHFATNVPGIYAIGDVIVGPMLAHKAEDEGVALAELLAGKAGHVNYDVIPGVVYTFPEVASVGKSEDDLKAAGVAYKVGKFPFTANGRTKVNNTTDGFVKIIADAATDKVLGAHIIGPEAGEMIHECAVLMEFGGSSEDLARTCHAHPTRSEAVKEAAMAVEKRAIHM

SEQ ID NO: 17047 - protein, 180 aa, Kluyveromyces lactis NRRL Y-1140
MADYLKLFQDSLKGLDTKFAGNQILSRIEAQTKLPRSYVIVGLVAVYFLLIFINVGGIGEILSNFVGFCIPTYYSLKALKTATSTDDTQLLTYWIVFSFLSVIEFWSKAILYWVPFYWFFKTVFLLYIAIPSFGGAQLVYTRLISPFSDKYLPIVEGKSGELAQKVEAAANNAKASGYSR

SEQ ID NO: 17048 - protein, 336 aa, Idiomarina loihiensis L2TR
MQSPIPVLSMRKLYLGASDRQQFIADLGRAARDVGFFYLEDHGISLAEQVKVLDTAKSFFALSDAEKKQVQMIHSPHFRGYSANYSELTAGRPDRREQFDIMDELPALSASAIHHEWQKLIGPNQWPRQLPAIKSQLLSWQDKLTEVSLQLLAALCESLEQPADALAETISNGPYRHTKLIKYPGSPEASGQGVGAHKDPGYLTLVLQDENSGLEVEYEQQWYKVAPRPGAFVVNIGELLELASNGYLKATNHRVSSPKTGVTRYSSAFFMAAQLNASVPVLKLPSHLAKHAKGPTSDPGNPLLHNVGENVMKGRKRSHPDVSARFYASEEKCSSC

SEQ ID NO: 17049 - protein, 409 aa, Xanthobacter autotrophicus Py2
MTTEIRVPTLGESVTEATIGKWFKKPGDTVKADEPLVELETDKVTVEVPAPAAGVLAEIVAKDGDTVGVGALLGSIGAGSGAAAAAPAAAAPAPAAAAPAPAPAPAAAPAASGSSVNGPAVGRIAAESGVDPSGVAGSGKDGRVTKGDMLAAVAAGAAAAPAAAPIAVRAPSAPIDAVREERVKMTKLRQTIARRLKDAQNTAAMLTTFNDVDMSAVMSLRAQFKDAFEKKHGTKLGFMGFFTKAVIAALKDLPAVNAEIDGQDLVYKNYYNIGIAVGTEKGLVVPVVRDADQLSVAEIEKAIAGFGRKARDGKLGIEDMQGGTFTITNGGIYGSLMSTPILNAPQSGILGMHRIEERPVAIKGQVVIRPMMYLALSYDHRIVDGREAVTFLVRVKETLEDPARLVLDL

SEQ ID NO: 17050 - protein, 87 aa, Oryza sativa (japonica cultivar-group)
MGCDDKCGCAVPCPGGTGCRCASSARSSGGDHTTCSCGDHCGCNPCRCGRESQPTGRENRRAGCSCGDSCTCASCGSTTTTAPAATT

SEQ ID NO: 17051 - protein, 441 aa, Blastocladiella emersonii
MAIKKVLARQIFDSRGNPTVEVDLITDKGLFRAAVPSGASTGVHEALELRDNIKSEYMGKGVKTAVANVNDIIGPHLIALSPPLDVTDQKKADEILLALDGTKNKSKLGANAILGVSLAIAKAGAAEKGLPLYAHIHALAYGKVADKYVLPVPAFNVINGGSHAGNKLAMQEFMILPTGASSFTEAMKMGSEVFHHLKSVVKAKYGQDATNVGDEGGFAPNIQDNKEGLELLKQAIAKAGYTEQIEIGMDVAASEFYKDGKYDLDFKNAESDPSTYLTGEQLAALYESFAAEYPIVSIEDPFDQDDWESWTHLNGKLREKTQIVGDDLTVTNPERIATAIEKKACSALLLKINQIGTITESINAALDARGDGWGVMVSHRSGETEDCFIADLVVGLCAGQIKTGAPCRSERLAKYNQLLRIESELGDRAVYAGKNFRHPKH

SEQ ID NO: 17052 - protein, 348 aa, Corynebacterium efficiens YS-314
MVRKESRKMKLAVIGGDGIGPEVTDEALKVLRALRADIETTDLDLGARRYLRNGELLTDEDLALLREHDAILLGAIGAPGSVPPGVLERGLLLKLRFALDHHVNLRPSKLYEGVESPLKNPGEIDFVVVREGTEGAYTGNGGAIRVGTPHETANETSVNTRYGAERVIRYAFELAQSRRRHLTLVHKTNVLVHGGGLWQRTVDEVAREYPEVTVDYNHIDAATIYLVTDPSRFDVIVTDNLFGDILTDEAGAISGGIGLAASGNIDATGTNPSMFEPVHGSAPDIMGKGIADPTAAILSAAMMLRHLGDEANAVRIEEAVARDVAGRDPEAPISTTEVGDRIAAAVVA

SEQ ID NO: 17053 - protein, 254 aa, Chlamydophila caviae GPIC
MERKSYVFGNWKMHKTAKEAKDFLSIFCPFVKEISPASLVGIAPAFTTLSACCESIKEMDSSIWLGAQNVHQDSSGAFTGEVSLPMLQEFHVNFVLLGHSECRHIFHEEDATIALKVGAAARSGVVPVLCIGETLEARENGTTKEVLSNQLMLGLAQLPETAPVIIAYEPVWAIGTGKVASTADVQEVHAFCREVLSRIFSKEKSEIISILYGGSVKADNAEGFARCPDVDGLLVGGASLDPQGFANVLRNFNL

SEQ ID NO: 17054 - protein, 308 aa, Abies firma
DGATGKTYCFAEVELISRKVAAGLVNLGLEQGQVVMLLLQNCVEFAFVFMGAALRGAIVTTANPFYKPGEIAKQAKAAGARIIVTQAAYVEKLADLQSDDVIVITIDGAPKDGCKHISVLTEADETQCPSVQIQPDDVVALPYSSGTTGLPKGVMLTHKSQVSSVAQQVDGENPNLYFHSEDVIMCALPLFRIYSLNSVLLCALRAGAATLIMQKFNLMSFLELIQRYKVTVAPIVPPIVLDITKSPVVSQYDVSSVRLIISGSAPLGKELEDALRDLFPQAIFGQGYGMTEAGPVLAMNLAFAKEPF

SEQ ID NO: 17055 - protein, 321 aa, Burkholderia sp. 383
MSQFPLDPGAARVVALARESGALGPEAGSPEQARVAFRTSRKALASQPVQVSSVRDLEVVHPDGKLGLRCYRGWGTDDGSQLPCLLFFHSGGWVSGDLDTHDNACRAIASTARISVMAVDYRLAPEHPFPAAIEDAQAAYAYILEHASSLNIDATKIAVGGDSAGGNLAAVLTHLLRDAGGHQPIAQVLLYPATDFAANTASLEQFSLGPTLTKASLDWFADQYLPVGEDRLDWKASPLRAPTFATLPAAYVVTCGHDPLCDEGAAYSARLRDAGVSVRHQHYPGQIHGFLTMGGLIPEATVLIGEVAVFLDQVFSRFRGA

SEQ ID NO: 17056 - protein, 302 aa, Glycine max
MSNEKAPSSASSSSYELSKGINGLDKVILRDARGSSAEVYLYGAHVTSWKNDHAEELLFLSSKFSNLGPLDSHGFARNQFWTIDDSPPPFPTSTSNKAFVDLILKPSEDDIKIWPHSFEFRLRVALGPGGDLLMTSRIRNTNIDGKPFSFTFAYHTYFSVSDISEVRVEGLETLDYLDNLQKRERFTEQGDALTFESEFDRIYLSTPTKIAILDHEKKRTIVLRKDGLPDAVVWNPWDKKAKAISDFGDDEYKYMLCVEAAAIEKPITLKPGEEWKGRLELSTVSSSYCSGQLDPKRVIQGS

SEQ ID NO: 17057 - protein, 383 aa, Streptomyces coelicolor A3(2)
MTPTTETTVGIGGAAESTDMVLNIGPQHPSTHGVLRLKLVLDGERITSAEPVIGYMHRGAEKLFEARDYRQIIMLANRHDWLSAFSNELGVVLAVERMLGMEVPTRAVWTRTLLAELNRVLNHLMFLGSYPLELGGITPVFYAFREREVLQNVMEEVSGGRMHYMFNRVGGLKEDLPAGWTTRARGAVAAVRSRMDVFDDLVLGNEIFRGRTRGVGALSAEAVHAYGVSGPVARASGVDFDLRRDEPYLAYGELQDTLKVVTRTDGDCLARFECLLAQTHNALDLADACLDRLAELAPGPVNQRLPKVLKAPEGHTYAWTENPLGINGYYLVSKGEKTPYRLKLRSASYNNIQALAELLPGTLVADMVAILGSLFFVVGDIDK

SEQ ID NO: 17058 - protein, 199 aa, Magnetospirillum magnetotacticum MS-1
MKRTARVERATSESSVLVELDLDGTGRTEISTTVPFYDHMLTALGKHSLIDLKVVATGDTHIDAHHTVEDVAITIGEALRVALGDKVGIGRFGDATVPLDEALALAVVDVSGRPYLVHSGEPEGQEYHLIGGHFTGSLTRHVLESIAHHAGICIHVRVLAGRDPHHIVEAQFKALARALRAAVAPDPRVEGVPSTKGAL

SEQ ID NO: 17059 - protein, 403 aa, uncultured epsilon proteobacterium
MINFKELAGEYKTPLYVYDLDYMSAQYNELKAAFKGRKSIMAYAVKANSNLSVVKHFADLGSGADCVSIGEVRRAFLAGIPSYKIIFSGVGKSDDEIREAIEKDILYINVESEAELGRVELIAKELNCTCRISIRVNPNIDPKTHPYISTGLHDNKFGVDLSSAKRMYIFAKNSENLDPVGIHFHIGSQLTQLKPIYESAEIVADLVRSLQNIKIELKFFDIGGGLGVKYDDEVTINPYDYAQAILGTLKGLDLTVVCEPGRFLTANAGYFLTKVLYEKQNGDKKFVVVDGAMNDLLRPALYGAYHKIEAITDNASEMQKVDIVGPVCESGDFFAKDYMLPKLEHNDLLVIHSAGSYGFGMGSNYNTRGRSAEVALKNGTAKVIRKRETFDDLVALELEFLEK

SEQ ID NO: 17060 - protein, 434 aa, Geobacillus stearothermophilus
MAFEFKLPDIGEGIHEGEIVKWFVKPGDEVNEDDVLCEVQNDKAVVEIPSPVKGKVLEILVPEGTVATVGQTLITLDAPGYENMTFKGQEHEEVKKEEKAETVSKKEMVETAAPSAPAAEAEADPNRRVIAMPSVRKYAREKGVDIRLVQGTGKNGRILKEDIDAFLAGGAKAAAEPTPQAAEEKAAPQAPAAKPVVPEGEFPETREKMSGIRRAIAKAMVHSKHTAPHVTLMDEADVTKLVAHRKKFKAIAAEKGIKLTFLPYVVKALVSALREYPVLNTSIDDATEEIIHKHYYNIGIAADTDRGLLVPVIKHADRKPIFALAKEINELAEKAREGKLMPNEMKGASCTITNIGSAGGQWFTPVINHPEVAILGIGRIAEKPIVRDGEIVAAPMLALSLSFDHRMIDGATAQKALNHIKQLLSDPELLLMEA

SEQ ID NO: 17061 - protein, 223 aa, Pseudomonas syringae pv. phaseolicola 1448A
MTQDQLKQAVAQAAVDFILPKLDDKSIVGVGTGSTANCFIDALAKHKAAFDGAVASSEATAARLKGHGIPVYELNTVSDLEFYVDGADESDEHLNLIKGGGAALTREKIVAAVAKTFICIADGSKLVPVLGAFPLPVEVIPMARSHVARQLVKLGGDPVYREGVLTDNGNIIIDVHNMSITNPVELEAQINAIVGVVTNGLFAARPADLLLLGTTEGVKTLTR

SEQ ID NO: 17062 - protein, 324 aa, Idiomarina baltica OS145
MKRLLPTLRADNAPEGLISVLNTIQIAAKEISFRLHQGALAGVLGSTLDENIQGETQKKLDVVANQLLKTLLLESPRVHAIASEEEDSIVLSPNSGEYLVAFDPLDGSSNIDINGTVGTIFSVLPKPENSANDESMFLQKGRNQVAAGYVLYGPSTMLVMTTGSHVRTYTLDQTVGEFLLTKDTASIPADTQEFAINMSNQRHWGTAVREYVEHLLLGEDGPRQKNFNMRWNAAMVSDVHRLVTRGGLFTYPWDARNPDKPYKLRLMYEAAPMAMIVEKAGGSASNGYVPILDIEPEQIHQRVAVVMGSTNEVQKCVEYHEKHG

SEQ ID NO: 17063 - protein, 476 aa, Burkholderia thailandensis E264
MSKEFDVVVIGAGPGGYIAAIRAAQLGKTVACIEKWKNAAGALKLGGTCLNVGCIPSKALLASSEEFENAQHHLADHGISVDGVKMDVAKMLARKDGIVEKMTGGIEFLFKKNKITWLKGHGKFAGKTDAGVQIEVSGEGETEVVTAKNVIIATGSKARHLPNVPVDNKIVADNEGALTFDSVPKKLAVIGAGVIGLELGSVWRRLGAEVTVLEALPAFLGAADEALAKEAAKLFKKQGLDIHLGVKIGEVKTSANGVSIAYTDKDGNAKTLDADRLIVSVGRVPNTDNLGLEAIGLKVNERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIGANASDLIAEAVVAMEFKAASEDIARICHPHPSMSEVMREAALAVDKRSLNS

SEQ ID NO: 17064 - protein, 606 aa, Candida glabrata CBS 138
MAQADQDLYPLALLMDDLKNDDISNRVEATKKIDQIAIALGPDRTRNELIPFLTEVAEDDEDEVFTVLAEKLGSFVPYVGGAEHASTILPVLDILAGAEETIVREKAVDSLNIVAEQMPDDELFKYFVPLLQRLASETWFSSKVSACGLFKSVFLRVKDVQSRVDLWNLFMTLVNDETPMVRRAVGKNLPILIDLLTENPEFCTDKDLEFISTTFQTVINDQQDSVKFLAVDCLISIVKFFNKKGYDTHSRDLLNSALSLAGDEAWRVRYVVADKFGELTEGFSSNPSYIEELLDPFLKLCEDSEGDVRKAIAKQVSYFSKFVNDSHVVLNKIVPVLQNLSMDENEDVRASLASGISDIVLLLPKEQVIEYVFPIFLNMLRDEIPDVRLNIIGKLKVVNEVIGIDMLTDSLLPAISELAKDSSWHVRLAIIEYIPILAEQLGVDFFNSQLSDLCLSWLWDAVYSIREAAIKNLQKLTNIFGSEWCNNEVVPRLLNLDSHMLENFIYRITLLQTFKALVSVLSPEFVANQILPHVMELANDQVPNIRFNVANTYPIIVEVLSKGGDQYKLLVTDTIYPSLKDLCEDPDFDVRYFANKSMKKCKEIIS

SEQ ID NO: 17065 - protein, 663 aa, Lactobacillus plantarum WCFS1
MSFDEMDTKAVNAIRALSIDMIEHAESGHPGMPLDAAPMAYVTYKKHLRIDPKHPNWPNRDRFVLSAGHSSSMLYAMLYLAGYGITVDDLKNFRRLDSLTPGHPELITPGVDAATGPLGQGLGMAVGMAMASKHLGTKYNVDDIKILNSRVYVIASDGDLMEGISHESASLAGHLKLNNLIVMYDSNDVTLDAQASKTLGDDAGERFKAYGWNYLRVEDGNNLDEIDNALKLAEAEQERPTIIEVKTVLGYGSPHAGENTVHGNPLTAGECRQTMHDLGWDYEPFEVPDEVHQRYAEILQEGQQRYVSWQNELHKLKKVNEELAQNFEVNFSNQAATGDISLQYNAGDTEAVRMTVHKLIQKSAHTPLNFWGGSADLSSSNKTYFENDDGFEPGQYQNKNVFYGVREFAQAAAVNGITLFGGSRTFGSTFFVFSDYMKNAIRMAALQRIPAIFAFSHDSIALGQDGPTHQPVEQLDGLRAMPGLTVFRPADAIETQSVWDYALNKNHGPVVIAMSRQALPVLEGSLKYAKECVKRGGYIVSPSGVSNSDGIIIATGSEVSISIEAQTKLKRQNINVEVVSMPSTELFLQQPKSYRDKVLDPTVRNRMSVEMGSTQSWYRFTGLDGVNIGLDHFGASGPVDEIIQRFGFSSENIAQTYLQHFRG

SEQ ID NO: 17066 - protein, 260 aa, Triticum aestivum
MAAEGGSREDRWTLAAATALITGGSKGIGYAIVEELAGFGARVHACSRNAAELEECRRRWEEKGLHVTVSACDVSVRADRERLMDTVRQTFNGKLDILVNNAGQLLVKPTAECTAEEYSKVMATNLESSFHLCQLARPLLVHAGGGSIINMSSIGGSIGFVGSAIYAITKSAMNQLTRSLAAEWAPNNIRVNGVAPGFITTDMIKDMDTESLEREHSKSPLLRSGKPVEIASAVAFLCMPAASFITGQVICVDGGRTISA

SEQ ID NO: 17067 - protein, 142 aa, Pseudomonas putida
MITPTPAALYPFWAPIRSQSLPAPHFSYTPVVRAGGCVFVSGLVALDPVLGTLIDEGMEAQTRQILNNFERLSAELELGLDQLMLARIYCADFAQFSAINQVWEEFFSERIPPARTSVGVSALPLGALVEIEFQFAIDPLKP

SEQ ID NO: 17068 - protein, 323 aa, Vibrio fischeri ES114
MDFKAIQALTADDMAIVNETILAQLNSDVALINQLGFYIVSGGGKRLRPVLAILSAKALGYEGKDHTMAAAFIEFIHTATLLHDDVVDESDMRRGKATANAEFGNAASVLVGDFIYTRSFQMMTSLGSIKILSLMSEAVNVIAEGEVLQLMNCNDPNTTEESYMQVIYSKTARLFEAATQIGAILNDAPQEIETALQNYGKYLGTAFQLIDDVMDYTSDGKDMGKNVGDDLAEGKPTLPLLHAMMHGNEEQNAMIREAIENGNGLDKLEPILACMKEVGSLEYTKQKADEEADKAIAELAILPESDYKEALKALAHLAVKRSK

SEQ ID NO: 17069 - protein, 452 aa, Burkholderia sp. 383
MNRTPVVDVQTFINEQPFGGFQWLVFLMCFVIVLLDGFDTAAIGFIAPSLLGEWNLTKPDLAPVLSAALFGLACGALVSGPLSDKLGRRSLLIGSVFLFGVACLMSAFSTTIGHLTILRFITGVGLGAAMPNAVTMMGEFCPDKRRATVINLMFCGFPLGAAFGGFLAAWMIPHFGWRSVLILGGVTPLLLGVLLLLKMPESVRFMVANHHAVDKIRSTLARISRDALNAGSFAMTEAAPQTGSKGLGVVLSRSYIVGSVMLWLAYFMGLVIFYASINWMPILLKDAGLTPKSATLISALFPLGGVGAVLCGVLMDRFNANRVIAVCYALTAVSVYAIGQAAGNVGLLVLVVFVAGVLMNTAQSSMPALAAAFYPTEGRGTGVAWMLGVGRFGGIAGSFLVAELTRRHFSFAGVFATIAVAGLLACVALLVKQMARPHGVTQPAGKIESLGH

SEQ ID NO: 17070 - protein, 145 aa, Glycine max
  misc_feature (103)..(103): Xaa can be any naturally occurring amino acid
  unsure (1)..(145): unsure at all Xaa locations
MANDSVLSLFFFVTLFTCLLSATSHDDHIFLPSQLHDDYSVSCTATDPSLNYKPVIGILTHPGDGASGRLSNATGVSYIAASYVKFVESGGARVIPLIYKEAXENLNKKLDLVNGVVFTGGWGWFLAHYLEYSWKTFLKKGLKEK

SEQ ID NO: 17071 - protein, 227 aa, Abies firma
IAKQAKAAGARIIVTQAAYVEKLADLQSDDVIVITIDGVPKDGCKHISVLTEADETHCPSVEIQPDDVVALPYSSGTTGLPKGVMLTHKGLVSSVAQQVDGENPNLYFHSEDVIICVLPLFHVYSLNSVLLCALRAGAATLIMQKFNLTSFLELIQRYKVTIAPIVPPIVLDITKSPIISQYDVSSVRTIMSGAAPLGKELEDALRDLFPQAIFGQGYGMTEAGPVL

SEQ ID NO: 17072 - protein, 491 aa, Pseudomonas putida
MKHYRNYVNGKWTESSRTFDDVSPVDGSLVAIVHEASRELVDEAVKSGHQALSGEWGRTTATQRVALLRRIADEMERRQGDFLAAEMADTGKPHSMASSIDVPRGIANFRTFADILATAPVDSHRLDLADGAYALNYSARKPLGVVGVISPWNLPLLLMTWKVAPALACGNTVVVKPSEDTPGTATLLAEVMEAAGVPPGVFNLVHGFGPNSAGEFISSHPDISAITFTGESRTGTTIMRAAAEGVKPVSFELGGKNAAIIFADCDFDKMLDTMMRALFLNSGQVCLCSERVYVERPLYDRFCAALVERIKGMKIDWPQDPATQMGPLISAKHRDKVLGYFELARTEGATFLAGGGVPHFGDSRDDGAWVQPTVITGLGDDARSVREEIFGPICHVSVFDNEQEVIARANDTRYGLAATIWTSNLGRAHRVSEAMRVGISWVNTWFLRDLRTPFGGAGLSGIGREGGMHSLNFYSELTNVCIRIDEEVADV

SEQ ID NO: 17073 - protein, 728 aa, Idiomarina loihiensis L2TR
MRCDIEGWQQDFIERLAQEDLPAPQSQHSNLNDSDLFALFHSQVLSRFIDIESRRLQRQGKSFYTIGSAGHEGNAAVAAALRVTDPAFLHYRSGAFFLQRAKQLEGSNSLYDLMLSFCASSEDPISGGRHKVLGSLALNIPPQTSTIASHLPKAMGTAYAIGLSKRLKQAGQWPDDAIVLCNFGDASANHSTAVGALNATGWSAYQGMPMPILYVCEDNGIGISTSTPRGWTAHQLQNYPAIRYYYADGANVSETYAVARQAAEYIRRTRKPAILHLKTQRFFGHAGADAEVAYRSNESIEQSFETDVLLQSAAQVIERELCTGIQLSEKAQCWLQRIRRVGTEASARPRLECAESVMASIVPKTLADDTQPLTSTQQQAVFAFDKRNFKKPQPLGKMINWALHEILARYQNTVVFGEDVGKKGGVYHVTHHLFDHFGANRVVNTLLDEQSILGLAMGMAQQGFLPIPEIQFLAYVHNAEDQIRGEAATLPFFSNGQYHNGMVIRIAGLAYQKGFGGHFHNDNSFAVFRDIPGVIVMCPSNGHDAVLMMRQAVQLAHCQKRLVIFLEPIALYMTRDLLAEGDKGWLHEFPSATAPLPALGEPSRYGEGDELVIITYGNGYYLSRQACSELALEKRIRILDLRYLVPLDIEKIVAAVGSAKHILVVDECRNRGSLSEELVTALYEHRRDWQRVDRITAKDSFIPLGSAAYKVLPGKEDIIHYLQEHLGQ

SEQ ID NO: 17074 - protein, 438 aa, Xanthomonas campestris pv. vesicatoria str. 85-10
MSTPQPAPDATGLVRVVSRWQIVGLSINDVIGSGIYLLPAATAALLGPMSLWAVMLAGLAVALLVLCYAQAGSYFDTPGGSYLYTREAFGPFVGFQIGWMIWLTRISSAAALSNGLADAVARFWPTASTDPWARLLVVVGSLGLLTAINVIGVKSAARTGIALVIGKLVPLLLFVAIGLFYVDWSWAFAGTAPDLRDLGNLGEAALLLLFAYAGFENIPAAAGEYRNPRRDVPFALITMIVTVTLIYAAVQVVAQGTLPNLAASPTPLADAASRFGGEALALILTVGATISILGTTSNTVMLGPRFLFALARDGYGPAFLARVHPRFHTPAAAVLTQGALSLALALSGSFTQLALLSMVTRLFAYIGTAAAVIVLARRYRQRTDTLRLPGGPAIPIAALVLSLGLLASASWQNLAAAGVALLVGWVFYLFPRKQVENG

SEQ ID NO: 17075 - protein, 240 aa, Dichelobacter nodosus
IRVNAADRFLHNKRVTDPEEKTPKLSGRLFIEIFDEESAQKLRTLNGGAGHDYPDVIESLVVKTAKAQVIKSHHNVGGLPEKMNLSLLEPLRMLFKDEVRQLGLALSLPQTMIYRHPFPGPGLGVRILGEVKAEYADLLRQADAIFIQALREYDLYDAVSQAFAVFLPIRSVGVMGDGRRYDFVVALRAVETIDFMTARWAKLPYDFLDEVSRRIINHVSGISRVVYDVSSKPPATIEWE

SEQ ID NO: 17076 - protein, 143 aa, Pseudomonas putida
MSTLSSNDAKVVDGKATPLGSFPHVKRAGDFLYVSGTSSRRPDNTIAGAELDSTGRVRPDIEVQTREVLKNIRDILRSVGAELDDVVEICSYLTNMNDFSQYNQVYAEFFDSSGPTRTTVAVHQLPHPHLVIEIKAVAYKPLR

SEQ ID NO: 17077 - protein, 224 aa, Abies firma
QAKAAGARIIVTQAAYVEKLADLQSDDVIVITIDGVPKDGCKHISVLTEADETHCPSVEIQPDDVVALPYSSGTTGLPKGVMLTHKSQVSSVAQQVDGENPNLYFHSEDVIMCALPLFHIYSLNSVLLCALRAGAATLIMQKFNLMSFLELIQRYKVTVAPIVPPIVLDITKSPVVSQYDVSSVRLIISGSAPLGKELEDALRDLFPQAIFGQGYGMTEAGPVL

SEQ ID NO: 17078 - protein, 392 aa, Chlamydophila caviae GPIC
MDYYDVLGVSKTASPEEIKKSYRKLAVKYHPDKNPGDAEAEKRFKEVSEAYEVLSDPQKRESYDRYGKNGPFAGAGGFGGMGGMGNMEDALRTFMGAFGGEFGGGGSFFEGLFGGLGEAFGMRGDPAGARQGASKKVHITLTFEEAARGVEKELLVSGYKTCETCLGSGAASEQGIKCCDRCKGSGQIVQSRGFFSMASTCPECGGEGRVITDPCSNCRGQGRIKDKRNVHVQIPAGVDSGMRLKMEGYGDAGQNGAPSGDLYVFIDVEAHPVFERRGDDLILELPIGFVDAALGMKKEIPTLLKEGMCRLTVPEGIQSGTILKVKNQGFPNVHGRGRGDLLVRVSVETPQNLSEEQKELLRKFATTEKAENFPKKRGFLDKIKGFFSDFAV

SEQ ID NO: 17079 - protein, 422 aa, Arabidopsis thaliana
MVGGRGGVGGGGGNRVEADQWLVTSEKLLASSDLQGAKTFAIRACEADPTRAEAADYILAICDILLAGETRLGDSNLPDWYAVLRLGRLAQNPEHVATQYRRLALLLNPSVNRLPFADRALKIVSDAWFVLSDPFKKSFYDRELQLSQLGQSGFHPQTQSHQNFQWEPSSSTAVYPPPRSQSQAGTSADPMATSFWTACPYCFVLFEYPKAYEECTLKCQECRRAFQAVTIPKPPVDKKDDEDVYFCSWALFPLGFSGEFQAPSWSPISPLFACPLQKLDGEPKKRKEPGKETYVRSNKKHGVEEVQNVESISSASNHAVSIASNAAAVGSSTGVMSKPGSYITRKRMGTGAKNLGRLDLNVEFSNEVEEPGVAGGGNAGNGIGSNREVDNMEGIGFFEGLDEFLNSLPILSVVGDDKIKAT

SEQ ID NO: 17080 - protein, 678 aa, Chlamydophila caviae GPIC
MVAIQHELRSSIKEVLKLVWTLRFAENKMLLLSRQSDSGGTFQLSCAGHELAGVIAGKSLIPGKDWSFPYYRDQGFPIGLGCDLSEILASFLARLTPNHSSGRMMPYHYSHKKLRICCQSSVVGTQFLQAAGRAWATKHAKSNEVVYVSGGDGSTSQGEFHEMLNYVALHKLPLVTVVQNNSWAISVPFKDQCSADLARLGESYRGLSVYEVDGGDYFGLVDVFSKAVDQARHASVPALILINVMRLEPHSNSDNHEKYRSRDDLDYCMNNDPLIRLERQMVEECGISPAEILEIKAEAEAEVARACELAEGVPFPSKGSTSHDVFSPHTISLIDYEGSLEAQRLRDTQPKVMRDAITEALVEEMNRDSGVVVFGEDVAGDKGGVFGVTRNLTDKFGVERCFNTPLAEATIIGTAIGMAMDGIHKPVAEIQFADYIWPGINQLFSEASSIYYRSAGEWEVPLVIRAPCGGYIQGGPYHSQSIEAFLAHCPGIKVAYPSNAADAKALLKAAIRDPNPVVFLEHKALYQRRIFSACPVFSSDYVLPFGKAAITHPGSDLTIVSWGMSLVMSMDVAKELAALDISVEVIDLRTIVPCDFSTVLESVKKTGKLLIAHEASEFCGFGSELAATVAEQAYSYLDAPIRRVAGLHAPVPYSKILENEVLPQKEKILQAAKSLAEF

SEQ ID NO: 17081 - protein, 567 aa, Shewanella sp. ANA-3
MSITGIIVSSGIAFGQALHLTQAEHHLDYRPIPLSRIPQQQSKFVKALQALQQQLSHSQTKLDPQSENYQLIEADLLLLEDEELIDQVKEAIRTLQLSASVAVERIFAHQANELESLDDPYLANRAQDVRCLGQRLVTAINGRLDQGLAQLTEPTILLAQDLTPAEFALLPKEQLSGIVLKTGGLTSHTAILARAAGIPAILSCQFDAEFIPNGTPLVLDALSGELFVNPAPELQARLTVTLHHEQARRAALQAYRDVPAKTQDGHLVGLMANVGNLNDITHVGDVGADGIGLFRTEFMLMHTSTLPDEKAQYNLYCEALHALGGKTFTIRTLDIGADKELPCLCQEVEDNPALGLRGVRYTLAHPELFKTQLRAILRAANHGPIRLMFPMVNQVEELDQIFALIAECQDALEEEEKGFGELSYGIVVETPAAVMNLASMLPRLDFVSIGTNDLTQYAMAADRTNPQLTRDYPSLSPAILGLIKMTVDQAKAAGVKVSLCGELASSPLMVPLLIGMGLDELSVNLSALLEVKAAVCQGQLTKFSALAHTAMQQNRISELQQCITSYK

SEQ ID NO: 17082 - protein, 269 aa, Burkholderia thailandensis E264
MRTFARRARPPAAILFSESMPSIPLSLPLARAAFFFDFDGTLVDLAPTPDAIQVPPDVPALVDDLRRLSHGAVAIVSGRGIDSIDAYLNLPDLPVAGLHGAERRDANGDTQRIGFDDPRLLRIERELAAVVDRHPGMLLEIKGAALALHFRNAPEREGVARAAAERLVADYPDAYVLQPGKMVFEIKPKGVDKGRAVAAFLNEPPFAGRMPVFAGDDLTDEQGFAVVNASGGLSIKVGAGDTAAHVRVDSVAAFREQLARWIDAGRALA

SEQ ID NO: 17083 - protein, 219 aa, Francisella tularensis
MNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGL

SEQ ID NO: 17084 - protein, 438 aa, Pseudomonas syringae pv. phaseolicola 1448A
MATPPETPSLRRAITAPMLTLFILGDVLGAGVYALAGTIAGRVGGAIWAPLLIALCFALLTAASYAELVTKYPRAGGAAVYAEKAFGKPLLSFLVGFSMVAAGVTSAAGLAVAFAGDYFQALVSWPAQWVCVGFLVIVALLNARGIKESLSANLVMTLIELSGLAMVIAAAVWFVSQGNGVPQRVFELDTNSPATAILAASLLAFYSFVGFETSANLAEEIKDVRRIYPRALFGALLIAGVVYMLVGVGAAMVLPVEQLKASQAPLMDVVSASGLGIPAPWFAVIALIAVANGALLTMIMASRLTFGMAREGLLPAVMGSVLPQRRTPGVAIFATTVVAIALSFTSTLTTLAETVVLLLLFVFLSVNIAVLVLKRDKVEAGHFQVHWVIPVLAILSCLLLLTQQGPETWLRAGMMLAVGVALYGLTRLGSSVLVSHPR

SEQ ID NO: 17085 - protein, 632 aa, Bacillus licheniformis ATCC 14580
MCGFVGVFNHRPSSETAAQEELIKQMNEMIVHRGPDDDGYYHDEHVGFGFRRLSIIDVENGGQPLSYEDDSYWIIFNGEIYNYIELKDELLSKGYEFKTDSDTEVLLATYRHYKQEAASKLRGMFAFLIWDKKEQLLYGARDPFGIKPLYFTKTDGHVYFASERKSLMAVDADLELNEKALQQYTSFQFVPEPETLDKKVQKVESGHQFTVRPGEDIQFKTYWKVQFKPVQTEEDKLVQEVRDAIFDSVKVHMRSDVPVGSFLSGGIDSSFIVSVAKQFHPNLKTFSVGFEHEGFSEVDVAKETADKVGVENFSAIISPEEYMNELPKIVWHLDDPLADPAAIPLYFVAKEAKKQVTVVLSGEGADELFGGYNIYREPLSLKPFERIPSPLKKMLLRVASAMPEGMKGKSFLMRGCTPLEDRYIGNAKIFEEGMKSKLLRQYDSNLSYCDVTKPYFEESRSYSEINKMQYVDIHTWLRGDILLKADKMTMANSLELRVPFLDKVVFEAASKIPEELKTKNGTTKYLLRKAAEGIVPEHVLNRKKLGFPVPIRHWLKNEMHDWAVNIIKESETDAYIHKDYVLQLLEDHCANKADNSRKIWTVLIFMIWHSIFVEKRFVPEELNHQPKEVIIV

SEQ ID NO: 17086 - protein, 363 aa, Bordetella parapertussis 12822
MSSPRTYRIAAIAGDGIGREVMPEGLRVVRAAARRFGLDLDIVTFDWAHCDYYREHGQMMPDDWKAQLAGMDAIYFGAVGWPATVPDHVSLWGSLLKFRREFDQYINLRPVRLFEGVPCPLAGRQPGDIDYLVVRENTEGEYTSAGGVIYEGTEREIVIQESVYSRYGADRVLHYAYALADSRPRRRLTVATKSNGIAISMPWWDKRADAVGQQYPGVAVDKQHIDILSARFVLQPDRFDVVVASNLFGDILSDLGPATTGTIGLAPSANLNPERKFPSLFEPVHGSAPDIYGQNIANPVAMIWSGALMLDFLTEGAGAGRAAHDAIVAAIEQVLAHGPRTRDLGGTASTDAMGEAIAARLAA

SEQ ID NO: 17087 - protein, 391 aa, Candida glabrata CBS 138
MGLLESDKFATKAIHAGAHEDIHGSVIEPISLSTTFKQSEPAKPIGTYEYSRSQNPNRENLEAAIASLEGGKYGLAFSSGSATTAVILQSLPQGSHAVSIGDVYGGTHRYFTKVANAHGVDTSFTNNLIEDLPKLVKDNTKLVWIESPTNPTLKVTDIQLVAENVKKINKDILLVVDNTFLSPYLSNPLKFGADIVVHSATKYINGHSDVVLGVLATNSKDIYERLQFLQNAIGCIPSPFDAWLTHRGLKTLHLRVRQASLNATKIATFLESNENVVAVNYPGLQSHPNYDVVKKQHREALGGGMISFRIKGGAEAAAKFSSSTRLFTLAESLGGIESLLEVPAVMTHGGIPKEAREASGVFDDLVRLSVGIEDGEDLLEDIKQALQKATA

SEQ ID NO: 17088 - protein, 453 aa, Synechococcus sp. CC9311
MATPYESGCDHVSPNRNLAPVSAELDDLGRLMVGGCRLSELAERYGTPLYVLDEVTIRASAQEYREALKRHYPGDSLAVYASKAHSSLALTGLVASEGLGLDAVSAGELLTALDGGMPPERMVLHGNNKSVEELALAYSHGVMVVADNQHDLDCLAELVPQGGGPVRLMLRFTPGIECHTHEYIRTGHLDSKFGFDPDQLQPVLTALAGCAWARVEGLHAHIGSQIFELDPHRDLAAVMADALKLARELGHPVRDLNVGGGLGIRYVESDDPPSIDAWVKVVAEAVTLACRERGLELPRLMCEPGRSLVASSGVTVYTVGARKVVPGIRTYVSVDGGMSDNPRPITYQSLYTACLADRPLAQADETITLAGKHCESGDVLLKDLSFPSCRSGEVLVVLATGAYNLSMSSNYNRIPRPAAVLVNQGEAELIQRREQPEDLLRYDLMPDRLRSVK

SEQ ID NO: 17089 - protein, 386 aa, Brassica napus
MMAPPGKKRKGEKAKNGAPPLDPEAIDCEWWDTFFLRNSSLSGVRVPLDEDDAFKYFFRASKTTFSYICSLVREDLISRPPSGLINIEGRLLSVEKQVAIALRRLASGDSQVSVGAAFGVGQSTVSQVTWRFIEALEERAKHHLRWPDSDRIEEIKSKFEGVYGLPNCCGAIDTTHIIMTLPAVQASDDWCDQEKNYSMFLQGVFDHEMRFLNMVTGWPGGMTVSKLLNLSGFFKLSESGQILDGSAKTLYQGAEIREYVVGGFSYPLLPWLITPHDTGDDPSDPVLAFNDRHEKVRSVAATAFAQLKGSWRILSKVMWRPDRRKLASIILVCCLLHNIIIDCGDYLEDDVPLSGHHDVGYSERYCKQSEPLGSELRGYLTEYLQR

SEQ ID NO: 17090 - protein, 558 aa, Oryza sativa (indica cultivar-group)
MDKLGANPANSCALTPLGFLERAATVFGDCPSVVYHDTVFTWSQTHRRCLRLASALVSSLGISRGDVVSVLLPNVPAMYEMHFAVPMSGAVLNSINTRLDARTVSVLLRHSGSKLIFVDPALLPVLRDALRLLPAGHTAPRVVLVEDPHEKEFPPAPAAALTYERLVEKGDPEFAWVRPASEWDPMILNYTSGTTSAPKGVVHCHRGIFLITVDSLVDWAVPPRPTYLWTLPMFHANGWSFPWGMAVVGGTNVCLRRVDAAEVFDTIARRGVNHLCGAPVVLNMLANAPEGVRKPLPGKVRILTAGAPPPAAVLYRTEAIGFEVSHGYGLTETAGLVLSCAWKGEWDKLPASERARLKARQGVRTPGMAEVDVVDGETGRSVPRDGSTMGEIVLRGGCITLGYLNDEAATKAAIRDNGWFYTGDVGVMHPDGYVEIRDRSKDVIISGGENISSVEVESVLYGHPAVNEAAVVARPDEFWGETPCAFVSLKQGGGAVTAADVVAWSRERMPRYMVPKTVIFRDELPKTSTGKIQKYVLRNIAKEMGPTTGTNTNRNSKM

SEQ ID NO: 17091 - protein, 312 aa, Oryza sativa
  misc_feature (148)..(148): Xaa can be any naturally occurring amino acid
  misc_feature (295)..(295): Xaa can be any naturally occurring amino acid
  unsure (1)..(312): unsure at all Xaa locations
MASSDDGVVALYGGGKVSCKPPAATFSVKVGLAQMLRGGVIMDVVTPEQARLAEEAGACAVMALERVPADIRAQGGVARMSDPALIRDIKRAVTIPVMAKARIGHFVEAQILEAIGVDYVDESEVLTPADDAHHINKHNFRVPFVCGXRDLGEALRRIREGAAMIRTKGEAGTGNVVEAVRHVRSVMGEIRALRNMDDDEVFSYAKRIAAPYDLVMQTKQLGRLPVVQFAAGGVATPADAALMMQLGCDGVFVGSGIFKSGDPARRARAIVQAVTHYSDPEILADVSAGLGDAMXGINLNDQNVERYAARSH

SEQ ID NO: 17092 - protein, 620 aa, Bradyrhizobium sp. BTAi1
MTTDHKRPIRNPQHWASAAMPPLQRFLAACHADFGPDHDGTVANYIPELGKADPVHFGISLAALDGHVYEVGDSRVPFTIQSMSKPFVFALALDTLGSDAVEQVIGVEPSGDPFNSIRLNANNHPFNAMVNAGAIACSGLILKARGADAFESIRDALGRFAGRRLDVDDAVFASEAATGDRNRAIAYLLRTSHVIKEPVEDVLAVYFRQCAVLVTARDCAVMAATLANRGVNPVTGEQVVTPYAVSRTLSVMTSSGMYDFAGEWIYRVGIPAKSGVGGGILASLPARLGLGSYSPRLDSHGNSVRGIKVCEALSAHYGLHMLNRSDDARASIIADYDIGANPSRRSRRAQERKILAAHPDAVRVLELVGTLSFSNVDYVSRQLAGRARPQFVIFDLHRVNAMTQAGLRLLAELFHELADFHVTVVLSGIRRSSPEWQEITARTGDIRNVRDFYLLDTAIEWAEDQIVYRHGGAIDFLETTELAEQPLLAGLTEGERDELAALATIRQYRQGERILSAGDAATSLFFLRSGVVHVTLPDGIRLATLTAGQCFGEMALLEPVRSADVVADFSASAFEITLPDFERFRSSHPHAGACIMRNLAQLLADRLTVANARLNLLAAD

SEQ ID NO: 17093 - protein, 338 aa, Pseudomonas putida
  misc_feature (5)..(5): Xaa can be any naturally occurring amino acid
  misc_feature (7)..(7): Xaa can be any naturally occurring amino acid
  misc_feature (15)..(15): Xaa can be any naturally occurring amino acid
  misc_feature (18)..(18): Xaa can be any naturally occurring amino acid
  misc_feature (71)..(71): Xaa can be any naturally occurring amino acid
  misc_feature (99)..(99): Xaa can be any naturally occurring amino acid
  misc_feature (118)..(118): Xaa can be any naturally occurring amino acid
  misc_feature (137)..(137): Xaa can be any naturally occurring amino acid
  misc_feature (148)..(148): Xaa can be any naturally occurring amino acid
  misc_feature (336)..(336): Xaa can be any naturally occurring amino acid
  unsure (1)..(338): unsure at all Xaa locations
ATTTXTXIQALRSAXDVXLERDDNVVVYGQDVGYFGGVFRCTEGLQTKYGKSRVFDAPISESGIVGTAVGXGAYGLRPVVEIQFADYFYPASDQIVSEXARLRYRSAGEFIAPLTLRXPCGGGIYGGQTHSQSPEAXFTQVCGLRTVXPSNPYDAKGLLIASIECDDPVIFLEPKRLYNGPFDGHHDRPVTPWSKHPHSAVPDGYYTVPLDKAAITRPGNDVSVLTYGTTVYVAQVAAEESGVDAEVIDLRSLWPLDLDTIVESVKKTGRCVVVHEATRTCGFGAELVSLVQEHCFHHLEAPIERVTGWDTPYPHAQEWAYFPGPSRVGAALKKVXEV

SEQ ID NO: 17094 - protein, 294 aa, Coprinopsis cinerea okayama7#130
MAGTYGVVYKARDTSTNTIVALKKIRLEAEDEGVPSTAIREISLLKELKDDNIVKLLDIVHADQKLYLVFEFLDVDLKRFIETGNQNRSPITPALVKVGSRPSDTGREPKFTHQLNSGLLYCHSHRILHRDLKPQNLLIDKHNNLKLADFGLARAFGIPMRTYTHEVVTLWYRAPEVLLGSRHYSTAIDMWSVGCIFAEMAMQGAPLFPGDSEIDQIFKIFRLLGTPNEDIWPGVSTLPDYKPTFPNWSRQDLAKAVPTLDEAGIDMLKRTLTYDSAKRLSGMLVSIFAICGCG

SEQ ID NO: 17095 - protein, 231 aa, Abies holophylla
IAKQAKAAGARIIVTQAAYVEKLADLQSDDVIVITIDGVPKDGCKHISVLTEADETQCPSVEIQPDDVVALPYSSGTTGLPKGVMLTHKGLVSSVAQQVDGENPNLYFHSEDVIICVLPLFHIYSLNSVLLCALRAGAATLIMQKFNLTSFLELIQRYKVTIAPIVPPIVLDITKSPIISQYDVSSVRTIMSGAAPLGKDLEDALRDLFPQAIFGQGYGMTEAGPVLVMNL

SEQ ID NO: 17096 - protein, 479 aa, Sphingomonas sp. tfd44
MTYPDTRLFIGGRWQDAADGRSLAVQNPATGLEIGRVAHCGRADLDRALDAAQRGFEIWRDLTPAERSKIMRRAAGLMRERADEIARLLTQEQGKPLHEAKIEAMAAGDIIEWFAEEGFRLYGRLVPHRTDIAIRQMVIKDAVGPVAAFTPWNFPINQVVRKISAALAAGCSMIVKAPEETPASPAELIRAFQDAGLPDGVLNLVFGDPAEISNYLISSPIIRKITFTGSTPVGKLLASLAGKHMKRVSMELGGHAPAIVCEDADIGLAVKSLSASKFRNAGQVCIAPTRFLVHSSIKHAFADALAAAARDLRVGDGFADGTQIGPLANSRRLAAMAEFQQDAIEKGATLLTGGNRVGDVGNFWAPTVLSDVPLEARLFNDEPFGPVAGIRSFDRLEEAILEANRLSFGLAGYAFTKSLATADILARRVEVGMLWVNSPATPTAELPFGGIKDSGYGTEGGPEALDNYINPRAVVVANV

SEQ ID NO: 17097 - protein, 398 aa, Burkholderia xenovorans LB400
MNSVTEPLVRLAARVDAIQPFYVMELAKEAALLERDGRDIIHMGIGEPDFTAPEPVIEAAASALRRGVTQYTNALGLHALREAISAHYADFYGVSVDPARIVVTAGASAALLLACAALVDRDDEVLMPDPCYPCNRHFVIAAEGKPVMVPSGPAERFQLTAADVERLWNERTRGVLLASPSNPTGTSIEPAELERIVKAVRARGGFTIVDEIYQGLSYDAKPISALSFGDDVITVNSFSKYFNMTGWRLGWLVVPPGMVSAFEKLAQNLFICASALAQHAALACFEPDTIAIYEARRLEFKRRRDFIAPALQSLGFSVPLMPDGAFYVYADCRTVAHPAAGDSAALTRAMLHDAGVVLVPGMDFGTHAPKDYIRLSYATAYPKLEEAVGRLAKLFGKD

SEQ ID NO: 17098 - protein, 158 aa, Glycine max
  misc_feature (114)..(114): Xaa can be any naturally occurring amino acid
  misc_feature (145)..(145): Xaa can be any naturally occurring amino acid
  unsure (1)..(158): unsure at all Xaa locations
ALSMIASITDTTVNLAGAGLDATSTGLKPMVGCPTMKTNNDITYIANNGGRAQCMQVWTPFGSKKYETLSYLPDLDEAQSAKEVEYLIKKGWITCLEYKLDHSFLYRELKMPPXYFEGLSWSLWKVPMFGSTDTSHVLNELQYAXTAYPDSQIRIIGF

SEQ ID NO: 17099 - protein, 257 aa, Francisella tularensis subsp. holarctica
MKDLYYVIGFPVKHSLSPAIQMRLAQQYNQDMLFTAIEVAPQDLEAKIQEFKTNPQVKGLSVTVPHKERVYALADDADTTAKAVQAASNIIFTAERKMIALNYDGLGIVNDIKNNYKIDFAGKKVLVVGAGGAAKAVVAAVLKESPLSLSITNRTLAKAKAIEELFKVDTEIKIIDFDNISDSFDIVINSTSSSIDGKLLPLKDSNFNKNAFAYDLMYADGGTIFTKWCQAYNIAAADGKGMLKELSIAVFKYWRGL

SEQ ID NO: 17100 - protein, 512 aa, Glomerella cingulata
MKRKNVKGLALTPAAPKPPPTAETSRHGYDPRDKDGGEQSAQLEIGIEYKLDLRPEDLEILKELGSGNGGTVSKVKHVLTGTVMARKVIHVEAKKEMRKRIVRELQIMHGCSSEYIVNFYGAFLNPHNDVIMCMEYMDVGSLDRVSKVFGPVRVDVLGKIAVATLGGLTYLYSKHHIMHRDIKPSNILVNSRGSIKLCDFGVSGELINSVADTFVGTSTYMAPERIQGEKYTVKSDVWSFGLSIMELAIGKFPFNASEQLSDGECAPAAFGSVTADCTEPGPKLPKSDAFPSILEDMIQKCLFKNPDERPTPQELFDRDPFVQAAKRTPVDLREWAVGLMERDNRKSHLAPQLSPATRDLLNSSDSPTYQGGSTNDRSLDTPTSGEIPIAGAGIISPREPATHSNRSPTRNGINAISSRQQAAGHPGMGQRIVTTNSIPKVGEYPNSAGPVSANAASFSLPVRPAPGGPLPPAPPRKGTPDETRRENRRQATFGMPPAPRSYASDVYNGTSN

SEQ ID NO: 17101 - protein, 321 aa, Malus x domestica
ILPFKLPAIGPNDVRIRIKAVGICGSDVHYLKTMKCADFEVKEPMVIGHECAGIVDKVGSEVKHLVPGDRVAVEPGISCARCQQCKGGRYNLCPDMKFFATPPVHGSLANQIVHPADLCFKLPKNVSLEEGAMCEPLSIGVHACRRANVGPETTVLITGAGPIGLVSVLAARAFGAPRIVIVDMDDKRLAMAKSLGADETVKVSTKMEDLDDEVAEIKKAMESEVDVTFDCVGFNKTMSTGLNATRPGGKVCLVGMGHGMMTVPLTPAAAREVDVVGVFRYKNTWPLCLEFLRSGKIDVKPLITHRFGFTEKEVEEASLEF

SEQ ID NO: 17102 - protein, 366 aa, Cryptococcus neoformans var. neoformans JEC21
MTIDQSQINFNVPSTYKLEEIVGEGAYGLVVAGTHLPSGTQVAIKRITPFDHTMFCQRTLREIKLLRHFHHENIISILDLIQPESYEVFNEVYLVQELMETDLHRVIRSQELSDDHCQYFVYQTLRGLKALHSADVLHRDLKPSNLLLNANCDLKICDFGLARSSAKPPPGTSDGGQGFMTEYVATRWYRAPEVMLSFQEYTKAIDLWSVGCILAEMINGKPLFPGRDYHHQLSLILQVLGTPTMDDFNEITSQRSKDYLRALEFTRRQDFSAICPKAKPAAVDLLKQTLTFSPSKRITVEEALMHSYVEAYHDPHDEPNAEPLKPGFFDFEFHQEKLSRDQWKRMIYDEVQDPVPTILSQWTESH

SEQ ID NO: 17103 - protein, 96 aa, Glycine max
MMLVQLFLKCVIILILNKQVDKIPGGARLGFITIGDGKTEVLVYIDCLVFPPTENSAPIFRAIRNGPLKDKAPPGEPRIMRSLLQALQKSVEIARL

SEQ ID NO: 17104 - protein, 397 aa, Burkholderia thailandensis E264
MNSLLDFLSNGLLRFSWWQVVLFTLAVTHVTIVGVTVYLHRCQAHRALDLHPVMSHFFRLWLWMTTGMLTGQWAAIHRKHHAKCETEEDPHSPQTRGIWKVLLEGAELYRAEAKNEETMRKYGHGTPNDWLERNLYSKYPILGVSLMMVIDVALFGVVGLTVWAVQMVWIPFWAAGVVNGLGHFWGYRNFNAADASTNLFPWGIVIGGEELHNNHHTFATSAKLSNKWYEFDIGWMYIRIMSAFGLAKVKKIAPTPRLAARKTVLDQETLQAVLSNRYEVMARYAKTLKRAYRQELVHLKELGAREKYQLMRGARKWFHKEEAGLDEPQKRMLPEIFANSQKLHTFFQLRTELAAIWERSNASRDQLLAQLQDWCHRAEQSGIKALQEFATRLRRYA

SEQ ID NO: 17105 - protein, 497 aa, Oryza sativa
MGTRRRRNPVIFLFLWFVMAFELCASLNHEGVALMRFKEMIDADPFDALLDWDEGNASPCSWFGVECSDDGRVVALNLPNLGLKGMLPQEIGTLAHMRSIILHNNSFYGIIPTEMKYLHELKVLDLGYNTFSGPFPSELRNILSLKFLFLEGNKLSGSLPIEYELASMDQTSLNKISTERKTSTVVPFSPTASGQLHTATLGGITKFKRSELETACEGFSNIIDTLPRFTLYKGTLPCGAEIAAVSTLVTYASGWTTVAEAQFKDKVEVLSKVSHKNLMNLVGYCEDEEPFTRMMVFEYVSNGTLFEHLHVKEADQLDWQSCLRIAMGVMYCLNYMQQLNPPVLLRDLSTSCIYLTEDNAAKVSDISFWGDKKEDEKSEASDEHITVYKFALLLLETISGRRPYSDDYGLLILWAHRYLIGDKPLMDMVDPTLKSVPEEQVRELTKLVKLCLSEDPMERPTVAEVTAWMQEITGISEEEAIPKNSPLWWAELEIITS

SEQ ID NO: 17106 - protein, 188 aa, Zea mays
  misc_feature (82)..(82): Xaa can be any naturally occurring amino acid
  unsure (1)..(188): unsure at all Xaa locations
LAVQRISAPEAGMLPADFSPFVLGSSGRLKDREYETVTVPHDLYSKGNSADESRLWCTTQDSVYDAVKSMTQHNVGALVAVXLNMNRSIAGIVTEREYLLKIIGQGTPSKSTKVGDIMTEENKLITVNPDTKVLQAMQLMTENRVRHIPVIDGTGMLGMVSIGDVVRAVVAEHREELNRLNDYIQGGY

SEQ ID NO: 17107 - protein, 143 aa, Shewanella sp. ANA-3
MAIERTFSIIKPDAVAKNHIGAIYNRFETAGLKIVAAKMLHLTKEQAEGFYAEHSERGFFGALVAFMTSGPIMVQVLEGENAVLAHREILGATNPAQAAPGTIRADFAESIDENAAHGSDALESAAREIAYFFSAEELCPRTR

SEQ ID NO: 17108 - protein, 297 aa, Magnaporthe grisea 70-15
MASSGSAVSAVEQAQLIEMAKKAAAFTAVKDHLDPRYTHVGIGSGSTVVYVVEAIKELHPEASKDMTFYPTGDQSKGLIKAGGLRAAPIEDRPQGSLLDVYFDGADEADADLNLIKGGGGCLWQEKIVAVASRTFVCIGDFRKLSRNLGTQWKQGIPIEVLPKAADHVLAELERLGAHSPRLRSGSGKAGSVVTDNGMHIIDAPFTPLLLAGDEGGTGENGIWSVDRLAAKLKSLVGVCEIGLFYGRSGLDAKDEGGAQKPVAAYFGMADGSVQILNQGSPPVTLTTSSTGGSDGSK

SEQ ID NO: 17109 - protein, 230 aa, Lactobacillus plantarum WCFS1
MAKLVLIRHGQSEWNLSNQFTGWVDVDLSEKGVEEAKAAGQKVKEAGLEFDYAFTSVLTRAIKTLHYVLEESDQLWIPETKTWRLNERHYGALQGLNKKETAEKYGDDQVHIWRRSYDVLPPLLSADDEGSAVNDRRYADLDPNIVPGGENLKVTLERVMPFWEDQIAPKLLDGKNVIIAAHGNSLRALSKYIEQISDDDIMDLEMATGEPVVYDFDEKLKVLGKEKLGK

SEQ ID NO: 17110 - protein, 650 aa, Corynebacterium efficiens YS-314
MQAHRHRHSSKSPLPQPPHGGNFHAHAGNALVLTAVPTGARARAEIALIAARAPFEPVRLVPAKEERNGAMTPTQNEIHPKHSYSPIRKHGLEVPETEIALDDSPSGPNEPFRIYRTRGPETDPTLGLPRLRTPWITARGDVTEYTGRERLLIDDGRSAMRRGQASAEWKGQKPAPLKALPGKRVTQMAYARAGEITREMEFVALREHVDPEFVRSEVARGRAIIPNNVNHPESEPMIIGRKFLTKINANIGNSAVTSSIEEEVSKLQWATRWGADTVMDLSTGDDIHTTREWIIRNSPVPIGTVPIYQALEKVNGVAADLSWEVFRDTVIEQCEQGVDYMTIHAGVLLAYIPLTTRRVTGIVSRGGSIMAGWCLAHHRESFLFEHFDELCEIFAQYDVAFSLGDGLRPGSLADANDAAQFAELKTIGELTQRAWEYDVQVMVEGPGHVPLNMIQENNELEQKWAADAPFYTLGPLVTDIAPGYDHITSAIGAAHIAMGGTAMLCYVTPKEHLGLPNRNDVKTGVITYKLAAHAADVAKGHPGARAWDDAMSKARFEFRWNDQFALSLDPDTAIAYHDETLPAEPAKTAHFCSMCGPKFCSMRISQDIRDMFGEQIAELGMPGVGASDSTEGMKEKSREFVAGGGEVYRE

SEQ ID NO: 17111 - protein, 251 aa, Arabidopsis thaliana
MIFKKEVSKEDVECVETLLMMSNSKPTREEYNKLQLCILRRNKSSTITTPSTVMESKSHIHDHSLRESPTRRSRNRHDLPPMSPPMEQRKSKKAKRSTDASSSKTREPTPGWLISLMRSKNGGDVEDNSKKIIDKELFQTDVDPHQSRLSIPVSQIVELEFLNHEEKRAIEEDANRVRKEGVDAILVDSHLREFPVNLRLRDMRGILLYNLVAGWNQVVTDCLLEENTNIRLWSFHADDTLYFALVPLYAN

SEQ ID NO: 17112 - protein, 224 aa, Abies holophylla
QAKAAGARIIVTQAAYVEKLADLQSDDVIVITIDGGPKDGCKHISVLTEADETQCPSVQIQPDDVVALPYSSGTTGLPKGVMLTHKGQVSSVAQQVDGENPNLYFHSEDVIMCTLPLFHIYSLNSVLLCALRAGAATLIMQKFNLMSFLELIQRYKVTVAPIVPPIVLDITKSHVVSQYDVSSVRLIISGSAPLGKEQEDALRDLFPQAIFGQGYGMTEAGPVL

SEQ ID NO: 17113 - protein, 241 aa, Medicago truncatula
MRATIYILPFLVFFFFFFALFIVLESSGDCSDFDHAQMATPLGGIQDSPSSENSLEIESLARFAVDQHNAKQNSLLEFARVVKAREQVVAGTLHHLTLEAIDAGEKKIYEAKVWVKPWMNFKELTEFKHAGDGHAPSFTTSDLGVIKDGHKPGWQSVPAHDPQVQDAANHAIKTIQQRSNSLVPYELHEVTDAKAEVIDDTAKFNLLLKVKRGQKEEKFKVEVHKNSEGNFHLNQMEADNS

SEQ ID NO: 17114 - protein, 229 aa, Abies beshanzuensis
IAKQAKAAGARIIVTQAAYVEKLADLQSDDVIVITIDGAPKDGCKLISVLTEADETQCPSVQIQPDDVVALPYSSGTTGLPKGVMLTHKGQVSSVAQQVDGENPNLYFHSEDVIMCTLPLFHIYSLNSVLLCALRAGAATLIMQKFNLMSFLELIQRYKVTVAPIVPPIVLDITKSHVVSQYDVSSVRLIISGSAPLGKELEDALRDLFPQAIFGQGYGMTEAGPVLAM

SEQ ID NO: 17115 - protein, 263 aa, Sphingomonas sp. tfd44
MKDEVFVVVGGGQAGGWIIKTLGVEGFSGRIVLIGDERHPPYERPPLSKNALRDAEAVSETALLSIENLAEAKVESWLGEEVVKIDRSAQTVRCASGRENRYDRLFLATGSRPRVPDWMAGQKSDRIHLLRTIDDAAALRSSLSGTKHLLIVGGGWIGLEVAATVRSLGIAVTVVEAAPRLCQRSVPEPVSDWLRSLHEGHGVAFVMGRSVDQLVEQPDGIMLELDDGTARMADRVLVCVGAIPNVALAELAGLDVSNGILVD

SEQ ID NO: 17116 - protein, 737 aa, Aspergillus oryzae
MAPTLELLEEPAGNLPVKAVSAIRNGNSADDLKLESPEKHQRVMNVFRAFIADICQQYGEGHAGSPMGMAAIGIALWKYVMKYSPNNCNYFNRDRFVLSNGHACLWQYLFLHLVGVKSMTLEQLKSYHSTKLDSVCPGHPEIENEGIEVTTGPLGQGLANAVGLAMATKNLAATYNKPGHEVVNNMTWCMVGDACIQEGVGLEALSLAGHWRLNNLCVIFDNNSVTCDGTADVANTEDINTKMRATGYNVVDVYNGDSDVAAIVNALVAARSSDKPTFINIRTTIGFGSALAGTADVHGAALGVDEVANVKRSFGLNPDEHFHIPQDVYDFFSDIPGRGEAHEASWQAALVKYHEEDPVLAAEFELRVMGKLPEDWSKCIPRKEEQPTASTASRKSAGVITNALGQNINSFLVGTADLTPSVNVAYKNKVDFQSPELRTACGLNGNYSGRYIHYGIREHAMCAISNGLAAFNKGTFIPMTSTYFVFHLYAAAAVRMAALQGLQQIHIATHDSIGVGENGPTHQPVAVAALYRAMPNVLYIRPCDAEEVAGAYIAAIQATETPTIISLSRQGLTQYPQYSSREGTLKGAYVFVEDNDFDVTLIGVGSEMGFAMQTRELLFKEHGIKSRVVSFPCIRLFEQQSREYKHSVLKPRAGKPTVVIEAYPSYGWERYADASVSMNSFGKSLPSKEIYEHYGFSPESIAPKVKDLVEEVRRDGIEILRGDFRDFNGGLRIGLEH

SEQ ID NO: 17117 - protein, 387 aa, Rickettsia sp. Rf31
SNNNDSEFAELKIRGKIFKLPILKASIGEDVIDISRVSSEADCFTYDPGFMSTASCQSTITYINGDKGILRHRGYDIKDLAEKSDFLEVAYLLIYGELPSIEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACVSTGIASLWGPAHGGANEAVINMLKEIGSSKNIPKYIAKAKDKNDPFRLMGFGHRVYKNYDPRAVVLKETCKEVLKELGQLENNPLLQIAIELEAIALKDEYFIERKLYPNVDFYSGVIYKAMGIPSQMFTVL

SEQ ID NO: 17118 - protein, 389 aa, Rickettsia sp. RF2125
TNGNNNDSEFAELKIRGKIFKLPILKASIGEDVIDISRVSSEADCFTYDPGFMSTASCQSTITYIDGDKGILRHRGYDIKDLAEKSDFLEVAYLLIYGELPSIEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACVSTGIASLWGPAHGGANEAVINMLKEIGSSENIPKYIAKAKDKNDPFRLMGFGHRVYKNYDPRAAVLKETCKEVLKELGQLENNPLLQIAIELEAIALKDEYFIERKLYPNVDFYSGIIYKAMGIPSQMFTVL

SEQ ID NO: 17119 - protein, 520 aa, Zea mays
  misc_feature (320)..(320): Xaa can be any naturally occurring amino acid
  unsure (1)..(520): unsure at all Xaa locations
MTIARRLLRSNASAQAISLLKHVTGTASLQGHAHSPLDASVRHFSSAPSAQSDTTEENGFKGHGMLAPFTAGWQSNDLHPLIIERSEGSYVYDINGNKYLDSLAGLWCTALGGSEPRLVKAATEQLNNLPFYHSFWNRTTKPSLDLAQEILSMFTAREMGKVFFTNSGSEANDSQVKLVWYYNNALGRPDKKKFIARSKAYHGSTLISASLTGLPALHQKFDLPAPFVLHTDCPHYWRYHLPGETEEEFATRLATNLENLILKEGPETIAAFIAEPVMGAGGVIPPPKTYFDKVITAFGRLGTMFGCDYYNIKPDLVSLXRLGTMFGCDLMYNIKPDLVSLAKALSNAYVPIGATLVSPEISEVIHSQSNKLGSFAHGFTYSGHPVACAVAIEALKLYRERDIPGHVKQIAPKFQDGIRALADSPIIGEIRGLGMIMGTEFTNNKSPTDLFPAEWGVGAIFGEECQKRGMLVRVAGDAIMMSPTLIMTPGEVDELVSIYGEALRATEERVSDLKMKSEKN

SEQ ID NO: 17120 - protein, 228 aa, Brassica napus
LRRAKKALVDLAIGMLDEKETSLAHRNRSFGRVKDSHNHHRSMGHFRSLSWSVSRSWSASKQLQALASNLNTPRQNDVVASNGLAVPVYTMASVLLFVMWVLVAAIPCQDRGLQVNFFVPRQFQWAAPVMSLHDKIVEESKRRDRKNCCGLLKEIGRIEKSSRVMNELIDSIHFPMSEEKEIEVKQRVEELVEVHEALKNGLDPFERKVREVFHRIVRSRTENLDSLC

SEQ ID NO: 17121 - protein, 1066 aa, Xanthomonas campestris pv. vesicatoria str. 85-10
MNAQLDPLASTSVARPLLAPELPAAPGALRAAITAAWLKDEAEHVRELLDQARLPAAEQAKVQAVAADLVTRVRARAQDQGAIEAFMRQYDLGSEEGVLLMCVAEALLRIPDQDTADKLIRDKLGDADWKKHMGGSDSVLVNASTWGLMLTGQLVQLNDLTRADVPGAFKRLIGRVGEPVIRLAVRQAMKIMGHQFVMGRTIGEALSRSRKGDNANYRYSFDMLGEGALTMKDAQRYLQAYRDAIHAIGRSGNFVGTDVLAAPSISIKLSALYPRYEHAKRARVMAELVPGVLELAQLAKSYGIGYTVDAEEADRLELSLDIIEATFSDPSLDGWEGYGLAVQAYQKRTPYTIDFLADVARRVGRRIPVRLVKGAYWDAEIKRAQIEGHPGYPVFTRKQNTDVSYLACARRMFAHSDALYPMFATHNAQTIAAVRAIAAGKTYEHQKLHGMGDDLYAEVIPADRLDLPCRVYAPVGSHEDLLPYLVRRLLENGANSSFVNRITDEDVAIEDLIRDPVEAVTSFTSIPHPKIPLPADLLRSQNQNRKNSMGANLANDNDLRQLAEQLNAAIKPWKATPLVPGALISTPGQTVLNPADRRETVGQWHPADPDTVQKSLASAAAAQPAWNRTPAASRATILEHAADLLETRMPDFMAICVKEAGKTLPDAVAEVREAVDFLRYYAGQARAQFGAPERLPGPTGESNELQLHGRGVFVCISPWNFPLAIFLGQVAAALAAGNTVIAKPAEQTNLIGFAAVKLLHEAGVPEAVVQFLPGDGATVGAALTNDPRVAGVAFTGSTETARIINRTLAARDAAIGVLIAETGGQNAFIADSSSLPEAVVKDAISSAFISAGQRCSAARVLFVQDDIADKVMTMLAGAMGELKIGDPGLLSTDVGPVIDADALKILDDHAARMDRQARLIGSTTLDASTAHGSFFAPRAYELTSLSQLQREIFGPVLHVIRWKADQLDAVIEQINATGYGLTLGVHSRIDETIDRITSRVAVGNVYVNRNQIGAVVGVQPFGGQGLSGTGPKAGGPHYLLRFATEKVVTVNTTAAGGNASLLTLGD

SEQ ID NO: 17122 - protein, 544 aa, Schizosaccharomyces pombe
MGSDGSSLSPKVSQPGHTEIVDHVSEKVITNGKNVNKKVNSEVDGKSMVEKVKTHEENAEDYHYGGYHPVYIGEEFHHRRYVVERKLGWGHFSTVWLAYDRAAKRRVALKVVRSAEHYRETSIDEIRILQKIREGDEKHLGKKHIISLLDYFVHRGPNGAHVCMVFEVLGENLLSLIQSYGHRGVPVGIVKQIAYQLLIALDYLHRECGIIHTDLKPENVLICIDQDALQHIEAPATTSSPTSNTSSSKTRNNTGYTAKAPIIKRGQSVDNSAQERKTFAKNPTKNSKPAGQVIPSSPFTSTLSRFPSLEGAVSEISLRDSQKHNSHPNSPFSSGDNSLILDGVNGSQEPVPKITVKIADLGNACWTRKHFTNDVQTRQYRSPEVILGCRWGASADCWSFACIIFELLTGDYLFDPRNGNSYSKEDDHIAQIIELLVNYPKQMALSGKHSRDLFNRRGELRNIHKLKFWPLKDVLEQKYHFSAELAQQISDFLSPMLCFDPAKRTNAGYMSNSPWLREVADPTFKIETTGATGEDVPGWATEIR

SEQ ID NO: 17123 - protein, 223 aa, Solanum melongena
LYLKHDDVVLCVLPLFHIFALNSVLLVSLRAGATVLLMQKFEIGALLELIQKHRVSVAAVVPPLVLALAKNPMVDSFDLSSIRLVLSGAAPLGKELEEALHRRVPQAIFGQGYGMTEAGPVVTMCPSFAKQPFSTKSGSCGPVVRNADLKVVDPETGASLDRNQPGEICIRGSQIMKGYLNDDEATARTIDVDGWLHTGDIGYVDDDDEIYIVDRVKELIKFK

SEQ ID NO: 17124 - protein, 223 aa, Solanum melongena
LYMHSDDVLMCVLPLFHIYSLNSVLLCGLRVGAAILIMQKFDIAQFLELIQKHKVTIGPFVPPIVLAIAKSPLVDNYDLSSVRTVMSGAAPLGKELEDAVRAKFPNAKLGQGYGMTEAGPVLAMCLAFAKEPFDIKSGACGTVVRNAEMKIVDPDTGCSLPRNQPGEICIRGDQIMKGYLNDPEATTRTIDKEGWLHAGDIGYIDDDDELFIVDRLKELIKYK

SEQ ID NO: 17125 - protein, 186 aa, Oryza sativa (japonica cultivar-group)
MAVVRQLLVHRLSCSGLPASRCKTSCWSSGERLPGLKSRVRLLAVAIKPPRAAAGKDEIVRADDDDDGVSLGTVKLPANIDIARFETLLFQWGNSLCQGATLPLPVPLRVDKVEGGVRLGFMAVDDGVTQVLVYIDCLVSPATAASGPVFRAIRNGPMKDQEPPGEPRIMRSLLEALQKCIQYAQV

SEQ ID NO: 17126 - protein, 306 aa, Cryptococcus neoformans var. neoformans JEC21
MSYLLSVPAGRAFRRENSKWVDPQPEKGLIQMKLEDDLMQLSWKSRETNRVEDELIIFPGEATFEKVSQDPTGRTHILKFSSSNQKYFFWFQRLSREGDLRAQVDINELLQDPSYQPGSADLPAQQLERDWPPTPGAPRLTNPQPAPAANADANADANADAGSSSNPETSRKNMARLLAEWARGGALGQPEDDARLTDVLSPSNISALISSDPALISTITPLLPPGLSLPENPTAEDITPILSAPQFTDAIASLDNALRSGGLPGGMMRELGLPESAGSSVKGFLDGLVALGNKEAEDQDDKMEED

SEQ ID NO: 17127 - protein, 561 aa, Bacillus cereus ATCC 10987
MEKPWLKNYPEEIPSTISYDIQPLHKYVEQMASRYPEKKALHFLGKDITFSDFHDKVKRFANYLQKLGVEKGDRVAIMLPNCPQAVIGYYGTLLAGGIVVQTNPLYTERELEYQLHDSGAKVILCLDLVFPRVTNVQSVTKFEHIIVTRIADFLPFPKNLLYPFVQKKQSNLVVKVSESETIHLWNSVEKEVNTDVEVPCDPENDLALLQYTGGTTGFPKGVMLTHKNLVSNTLMGVQWLYNCKEGEEVVLGVLPFFHVYGMTAVMNLSIMQGYKMVLIPKFDMKMVFEAIKKHKVTLFPGAPTIYIALLNSPLLKEYDISSIRACISGSAPLPVEVQEKFETVTGGKLVEGYGLTESSPVTHSNFLWEKRVPGSIGVPWPDTEAMIMSLETGEALPPGEIGEIVVKGPQIMKGYWNKPEETAAVLQDGWLHTGDVGYMDEDGFFYVKDRKKDMIVASGFNVYPREVEEVLYEHEKVQEVVTIGVPDPYRGETVKAFVVLKEGTECSEEELNQFARKYLAAYKVPKVYEFRDELPKTTVGKILRRVLIDEEKRKNEDEQTG

SEQ ID NO: 17128 - protein, 250 aa, Burkholderia thailandensis E264
MNTNDHPLSHLFDNNDAWVRRKLADDPHYFSRLADQQAPEYLWIGCSDSRVPANQIIGLPPGEVFVHRNIANVVVHTDLNCLSVIQFAVDLLKVKHIMVVGHYGCSGVNAALHSRRVGLADNWLHHVQDVREKHAALLEDWPLGEARYRRLIELNAIEQVVNVCRTTIVNDAWARGQSLTVHALVYGVHDGRMRNLGMAVSHAEQLDATYRRAVGALSANGAHSADNDVVAADAADLIAQTIKETKHDDC

SEQ ID NO: 17129 - protein, 1216 aa, Oryza sativa (indica cultivar-group)
MAATAAALAVTDELALPLRAVGDLAAAAGVSREEVVVITQCASLGGKLPFDDASVGSVLAVIKKVENLGDLFITEISRVLKAGGMVLIQSSPSDQDPNNSIQRKLLLGGFVDVQASAASSQDSEHSVTIKAKKVSWSMGSSFPLKKATKGLPKIQIDDDSELIDEDSLLTEDDLKKPELPVVGDCEVGATRKACKNCTCGRAEAEEKVEKLNLTSEQINNPQSACGNCGLGDAFRCGTCPYRGLPAFKPGEKEIDFGAPVVLGQEIDFASVMTSLPDRGVSSSSSDPLCEGNIAPCSSSSEQKEDCSLKQSKTSILSCVFNSPFNIFEAHQDSSANKSPKSSSGSYDWLRVLRRIVCSGSMWRFLGTSKVLTSSDVWFLGKCYKLSSEESSSDSDSESGHATFLEDFSSRIWITYRRGFDAISDSKYTSDVNWGCMVRSSQMLVAQALIFHHLGRSWRRPSEKPYNPEYIGILHMFGDSEACAFSIHNLLQAGNSYGLAAGSWVGPYAMCRAWQTLVRTNREQHEVVDGNESFPMALYVVSGDEDGERGGAPVVCIDVAAQLCCDFNKGQSTWSPILLLVPLVLGLDKINPRYIPLLKETFTFPQSLGILGGKPGTSTYIAGVQDDRALYLDPHEVQMSATVIIWLFLQYPFYAWNPFCYGSYSGVFSTSQAVDIAADNIEADTSSYHCSTVRDLALDLIDPSLAIGFYCRDKDDFDDFCSRATELVDKANGAPLFTVVQSVQPSKQMYNQDDVLGISGDGNINVEDLDASGTDAGGVGVTYGMRGTNMPPPADVARFLSRDTIFDRVRLLDADPRALRAFAGTGLAVDVTVPNADVPRLAASRASARRWVRASVAPYAEATNVSRVLVGDEVISQANRTLLLSLVPAMRNLHAALAAVLPPSPRRREIIKVSTPHSLGILAASTPPSAGRFHDGYDTAVVKPLLGFLRATGAPFMVNAYPFYGGLTNDTLDYALFRVNDGVTDDATGLLYANMLDAQLDAVHSAMRRLGFGDVDVVVSGTGWPSAGEYWEVGAGADLARNYNKNAIRHLGSGVGTPLMPNRTFELSIFSLFDENLKPGPVSERNFGLYHADMTPVYDAGILTAPQEIVGTKVTPAPAPALAPAADGRRRWCVPKPAADEVALQVNIDFVCGQGGIDCGAIRAGGSCYDPNNVQAHAAFAMNLYFQSNGQHEFDCDFGQTGVITTVDPSYKSCKFT

SEQ ID NO: 17130 - protein, 408 aa, Idiomarina baltica OS145
MKLSQFGPGALVAAAFIGPGTVVTASLAGAEFGYALLWALMLSTVICAVLQEMASRIGVITGKGLGENIRSQMTSPWLRILFFTLIIAAIVVGNSVYQGGNLSGATLGAQEVLGQVPLLSDWFAQGGPLVFGVLAAAILWQGKAKFIEYALITLVLLMSLAFIGTFLLTDPNWLGVADSLLRWRWPSDSIITVIALVGTTVVPYNLFLHSASVANKWSGDDGVKQARIDTFISIPLGGLISMAILATAASAFFAQGIVIESAGDLAVALAPLFGDSAKYLMALGLCAAGISSATTAPLASAYALCGIMGWKQSLTGFAFRAIWATILVLGVVISSLDLSPIKVIWFAQVANGILLPVIVGFIWWLCNQSTMGRMKNSVVGNAFAAIIMLTSILLSWKSLHHVWLSITS

SEQ ID NO: 17131 - protein, 163 aa, Oryza sativa (indica cultivar-group)
MDPYVILTCRTQEQKSSVAKGAGSEPEWNETFVFTVSDDVPQLNVKIMDSDAFSADDFVGEANIPLEPVFLEGSLPPAVHRVVKEEKYCGEIKVALTFTPAAVKTLTSVSCNIDGVVAIVSEHLVGVCDANVLDTRISSGNSPSSQPRERGGGLQQLELIACY

SEQ ID NO: 17132 - protein, 338 aa, Chlamydomonas reinhardtii
MRGQARPSVSAARRSAVSAHRAVNVVASSVADLNKKHGIPGSVEFKEGKSGSPVVVLKHACGASAEMYLFGACVTSWKQPSGDEVLYVRPDAVFDKSKPISGGVPHCFPQFGPGAMQQHGFARNLDWAVSTTSADPNPDEKDPSVEVVLTESDYTLKMWPHKFKAVYTVSLHGEQLNLQLRVINTDDKPFDFTAALHTYIEVLEIAKAKVTGLKGLTYLCKAVDPKVPETKKEDRDAVTFTGYTDSVYLNSPAHVELEVGTGAAVALDSTGWEDTVVWNPHLTMKDCYQHFCCVENAKFGKAATVKPGESWTATVTMSVVDVSKLKHDLECTPEPAPM

SEQ ID NO: 17133 - protein, 379 aa, Bacillus licheniformis ATCC 14580
MKEQCVAMLLAGGKGSRLNALTKNLAKPAVPFGGKYRIIDFALSNCANSGIHHVGVLTQYQPLLLNSYIGIGEPWDLDRNDGGVSILSPYAEASEVKWYKGTASAIYENRHFLKELQPEHVLILSGDHIYKMDYGKMLEYHAEKQADATIAVIEVSWAEAGRFGILHTNDKMEITSFEEKPKYPKSNLASMGVYVFKWSVLEDALERDEKNSASSHDFGKDVIPALLEENKRLNAYPFKGYWKDVGTVRSLWEANMDLLGDHPPLDLFERNWRIYSVSPNLPPQFVADLAEIKESLVSEGCTVYGSVTRSVIFQRVAIGRHSAIKRSVVMHDVSIGEYVEIENAIVSAGIRIPDGFCAKPEDGEVLLITEEYVKKHKVV

SEQ ID NO: 17134 - protein, 533 aa, Triticum aestivum
MDLELLWSGRPALSALPWICGGLVATVLLWQAARLLDQLWWRPRRLERALRSQGLRGTRYRFLLGDVNDYARQTKEASSGPPMPPRCHDVGPRAMPFLYSTIQEHGAPCISWFGPVPKVSITDPALVREVMSSKLARDVEKFKFPALTRLLADGVGNYEGDRWAKHRRILNPAFHTEKLKLMLPAFAACCEELVGRWERSLGPDGSWEVDVCPELQSLTGDVISQTAFGSSYLEGRRIFQLQTEQIGRFMAAVSKIMIPGYMSFPTKNNRRMHQINNEIESILRGIIAKRMQAMQEGESTKDDLLGLLLESNMSDTDENGQSTLGMSADEVMEECKLFYFAGMETTSILLTWTMIVLSMHPEWQDRAREEVLGLFGKHKLEYEGVNRLKIVTMILYEVLRLYPPATVFTRKTYKKIEIGGITYPAGVMFEMPVLYIHHDTDIWGEDVHQFKPDRFAEGISKASKDPGAFFPFGWGPRICIGQNFALLEAKMALCMILQHFEFELAPSYTHTPHSVMMLRPMHGAPIRLHTISS

SEQ ID NO: 17135 - protein, 186 aa, Solanum melongena
NDQPSGNVQGYGSKLANNGCGQLEWEDYFFHCVFPEDKRDLAIWPKTPADYILATSEYAKQIRNLATKIFAVLSIGLGLEEGRLEKEVGGMEDLMLQMKINYYPKCPQPELALGVEAHTDVSALTFILHNMVPGLQLFYEGNWVTAKCVPNSIIMHIGDTVEILSNGKYKSILHRGVVNKEKVRIS

SEQ ID NO: 17136 - protein, 479 aa, Cryptococcus neoformans var. neoformans JEC21
MPPINKAQAEQVGEYDYFVIGGGSGGLASARRAGSYGAKVGLVEVSPRLGGTCVNVGCVPKKIMWYTADVAENLRKSAQYGFGKEGEGYKLAADFNWTELKHKRDAYIHRLNGIYESNLEKDHVDHHQGWASFVDANTVAIEPPNGDKYTVKAKNIVIAVGGRPTVPSEKDIPGASYGITSDEFFELETQPKRVAVIGAGYIAVELAGVFNTLGSETHLVIRHNQLLRTFDPMMSEVLVPCMEKAGMKIHKKTHVKKVEKTSSGSLLVHLDSSSEPIEVDCLLWAIGRHADTAKLGLDKAGVKYDKKGDVIVDDYQNTNVPGIYAVGDVGGRMLLTPVAIAAGRRLSNRLFGPEKYKNDKLSYDNIPSVVFSHPTIGSIGLSEPEAREKFGDDNIKIYKTSFRAMSFAMLDEDHKQPTAYKLICTGPDEKVVGLHIIGEGSDEMLQGFGVAIKMGATKEDFDACVAIHPTSSEELVTLR

SEQ ID NO: 17137 - protein, 474 aa, Zantedeschia aethiopica
ALRRASRALPCPRLMPSGRFVRRGFSVVAAAASAGFANENREFVIVGGGNAAGYAARTFVEHGMADGRLCIVSKEAVAPYERPALTKGYLFPPDKKPARLPGFHTCVGSGGERQTPEWYKEHGIEVLYEDPVTSLDIQTHTLKTSSGKNLKYGSLIIATGCTAVRFPEGSGGSLPGVHYIRDVADADSLVSSLEKARKVVVIGGGYIGMEVVAACVGWKLDATIIFPENHIMPRLFTPSIGQKYEELYQQNSVKFLKGVLIDKLEAGSDGRVAAVRLKSGSVIEADTVIVGIGAKPVVSPFEAVGLNDSVGGIQVDSLFRTSVPGIFAIGDVAAFPLKIYDRMARVEHVDHARKSAKHCIGSLLSARTHPYDYLPFFYSRVFEYEGSSRKVWWQFYGDNVGDTVEVGNFDPKLAAFWLDSGSRLKGVFLESGSAEEFELLPKLARGQPLIDRSKLMSAPSVESALELARSSLHA

SEQ ID NO: 17138 - protein, 575 aa, Zea mays
PATFPEGLKSLDLSGNRLSGGIPPGLGSCATLRRLRLSSNWLAGTIPPRIGELARLRVLDLSGNRLTGGVPPELLHCRGLVRMDLSRNLLHGRLPSGLAQLKNLRFLSLSGNNFSGEIPSGLGQLGSLEFLNLSNNSLSREVPADLVALRNRTVLLLGNNKLSGEEEITAAAPGSPVHVVTAHSVTGELFPVSPIATAIRKLIDTGPGTSNGSTTTTSSSNGGDGGLGTKEIAAIASASAIVVLLLVALTLCICTRKWRLKPSERSFASKEVKVFADVDIGAPLTYETVVRATGNFNASNCIGNGGFGATYRAEVAPGVLVAIKRLAIGKQHGDKEFQAEVRILGQCRHPHLVTLLGYHINESEMFLIYNYLPGGNLERFIQERGRRPISWRRLHKIALDVARALAYMHDECVPRVLHRDVKPNNILLDNECNAYLSDFGLARLLRNSETHATTDVAGTFGYVAPEYAMTCRVSDKADVYSYGVVLLELISDKKALDPSFSPYGNGFNIVSWAVRLIQRGRVREFFVEGLWEKAPHDDLVEFLNLAVRCTQESLASRPTMKHVLRCLRELRPPSY

SEQ ID NO: 17139 - protein, 461 aa, Burkholderia xenovorans LB400
MNSAQQQDGLKRGLKNRHIQLIALGGAIGTGLFLGSASVLQAAGPSMILGYAIGGVIAFMIMRQLGEMVAQEPVAGSFSHFAYKYWGDFPGFLSGWNYWVLYVLVSMAELTAVGTYVHYWWPGVPTWVSALVCFAAINAINLANVKAYGETEFWFAIIKVAAVIGMIVFGGYLLISGHGGPQASISNLWAHGGFFPHGFHGLFMMLAVIMFSFGGLELIGITAAEADEPQKSIPKAVNQVIYRILIFYICSLTVLLSLYPWNEVAAGGSPFVMIFSQIGSTLTANVLNVVVLTAALSVYNSGVYANSRMLYGLAEQGNAPRALMKVDRRGVPYMAIGLSALATFTCVIVNYLIPAEALGLLMALVVAALVLNWALISITHLKSRKAMVAAGETLVFKSFWFPVSNWICLAFMALILVILAMTPGLSVSVWLVPAWLVVMWAGYVFKRRRAAVQGGARVVGR

SEQ ID NO: 17140 - protein, 440 aa, Oryza sativa (indica cultivar-group)
MGDHQMMHAAPAAMYNGGGGGGTTSSHGVWWSNAVGVPAAATCSTTTELAGYTAWSSALAAGYDGMVADNGGKQAKSTTTASSESPGNNSSVTFQEPASIPDPAAVAAVPQPGLAGFTDWTQPFMNNGAGLHEFLQDGHHDMSASSLMNHSSNNLALQQAGHHHELLSSFGSDLLLSPTSPYGGFQSSLLRSLMEPTAKQQQQQQPALAGLQQYHQYQQQMGHTPAAAAKFAQAVGARDSLQFTNDAPFWNPSAGFGMPAAVAVAAAAAQDQASVRSAKRSSPAPPRAAATLALKTAMEGVGDSSSVITKKETAFKKPRLETPSPLPTFKVRKEKLGDRITALQQLVSPFGKTDTASVLHETIEYIKFLHDQVGALSAPYLKNGAHQVPHLKNSSPDKSKHGEISLKGRGLCLVPISSTFAVASEVPVELWTPFGANFIR

SEQ ID NO: 17141 - protein, 865 aa, Thermus thermophilus HB8
MAKRVYLLSEARGLSRDLLGGKGHGLAEMAAAGLPVPPAFIVTTEACRQYLKAGEVPGLWGEVRAGMAALEGLTGKRFGRGEGKAPPLLVSVRSGAPVSMPGMMDTVLNLGLTLEGVEALARATGNPRFAWDSLRRLLAMYGEVVLGEGPEVFEGMLSALKAERGVGTDAALGPEDLEELAYRYLRHLEARGTPFPLDPWAQLQGAIEAVFRSWQNPRARTYRRIYGIPEDLGTAVVVQAMVFGNLGEDSGTGVGFTRNPATGEKGLYGEYLRNAQGEDVVAGVRTPEPLERLKGYAPGLYEELLQVAERLERHFRDMQDFEFTVERGRLFLLQTRAGKRTAQAAVRIAVEMAEEGLISREEAVMRVEANALPGLLRPSVDRDQAPRPLLKGLPASPGAAVGHAAFTNEAVERFHAQGLPAVLVRPETTPEDITGMYLAKGILTARGGLTSHAAVVARGLGVPAVVGAEALRVFPGEGRALAEGVEIREGDLLTLDGGTGEVYLGAVPLVEAGGEALLEKLLSWAEPHRRLGVRANADTPEDAQRARAFGAEGIGLCRTEHMFFREDRLPWVRRLILAETPEEEALALERLFHFQKEDFKEILRAMDGLPVTVRLLDPPLHEFLPPLEALARRAEEGDEEAGRLLRRAEALKEANPMLGFRGARLLLLRPGVFRMQLRALLEAARELKEAGHDPRPEVMVPLVADPKEVERARALAEELFREYGPIPFGTMVETPRAALLAAEIAPLVDFFSFGTNDLTQMAFGLSRDDAGKFLPRYVEEGLFPFDPTERLDEKGVGRLLRMAAEEGRKANPRLKLGLCGEHGGEAGSVRFVADLLDYTSASPFRVLTARLAAAQAGLSRALKPA

SEQ ID NO: 17142 - protein, 553 aa, Solanum lycopersicum
MGGCFSKKYTQQDANGHRAGRRVNQAYQKPPQPQPERPYQPQPQQERPYQPPPQPAYQPPPQPKPQPQPHPVPVTVQSGQPQDQMQGPHMNNILGKPFEEIRKLYTLGKELGRGQFGVTYYCTENSTGNPYACKSILKRKLVSKNDREDMKREIQIMQHLSGQPNIVEFKGAYEDRQSVHLVMELCAGGELFDRIIARGYYSEKDAAEIIRQIVNVVNICHFMGVMHRDLKPENFLLTSKDENAMLKATDFGLSVFIEEGKVYRDIVGSAYYVAPEVLRRSYGKEADVWSAGVILYILLSGVPPFWAETEKGIFNTILKGEIDFQSDPWPSISNSAKDLIRKMLTQEPRKRITSAQVLEHPWLRLGEASDKPIDSAVLSRMKQFRAMNKLKKLALKVIAENLSEEEIKGLKAMFHNIDTDNSGTITYEELKSGLARLGSKLTETEVKQLMEAADVDGNGSIDYIEFITATMHRHRLERDEHLFKAFQHFDKDHSGFITRDELENAMKEYGMGDEATIKEIIAEVDTDNDGRINYEEFCAMMRSGTTQPQQKLF

SEQ ID NO: 17143 - protein, 453 aa, Arabidopsis thaliana
MTSCIIMHNMIIEDERDIDAPIEERVEVPIEEVEMTVLWLEMPLEEILSRLPLKSTRAVRSTCKKWDSLFKNRSFISKAAAAREGESQMVVLMDHNLHLVSFFFGSDTSVEIKGKRICLNDDSDSEQVKISQVFHCEGLLLCILKDDNFSLVVWNPYWGQTRWIKPRCSFEIPQGCDMYRYAIGYDNKRRNHKILRFIDYEFHYPRDNVVLWYEIYDFESDLWTTLDVTTPHWLINCGNRGVTLKGNTYWCAKKRNSDLFLNADHIICFDFTSERFGPLLLLPFSDLDGVVTLACVREEKLAALVCHEDVVEVWITIKIEANEVLWSKFLTVNVDLGDEIPSSLTYGSFFIDEEKKVAMIFDKTLDRGDTVHIMGEAGYGGQVDLGEPVNKRRCPLVCSYVPSLVQIKKPAGFQRKQQSKLEKRQYVRNISKLRALKTQSSWTLSMSLECHQQ

SEQ ID NO: 17144 - protein, 572 aa, Staphylococcus epidermidis ATCC 12228
MSKLIKGIAASDGVAIAKAYLIVEPDLSYDSNEKVTDIESEVEKFNDAIEASKIELTKIRNNAEAQLGADKAAIFDAHLLVLDDPELIQPIQDKIRNDKVNAATGLDEVTTQFISIFESMDNEYMKERAADIRDVSKRVLAHILGVDLPNPSLINESAVIVGNDLTPSDTAQLNKEFVQGFVTNIGGRTSHSAIMSRSLEIAAVVGTKSITEEVKQGDMIIVDGMSGDVIIDPTEDELIAYQNKRERFFEDKKELQKLRDADTVTVDGVHAELAANIGTPDDLSGVIDNGAQGIGLYRTEFLYMGRDQMPTEEEQFEAYKKVLETMDGKRVVVRTLDIGGDKELPYLDLPKEMNPFLGYRAIRLCLAQPEIFRPQLRALLRASVYGKLNIMFPMVATIKEFRDAKSMLLEEKENLLREGYEVSDDIELGIMVEIPATAALADVFAKEVDFFSIGTNDLIQYTLAADRMSERVSYLYQPYNPSILRLVKQVIEASHKEGKWTGMCGEMAGDQTAVPLLLGLGLDEFSMSATSILKARRQINGLSKNEMAELANRAVECSTQEEVVDLVNQLAK

SEQ ID NO: 17145 - protein, 453 aa, Trichophyton rubrum
MSNLPSEPEFEQAYKELAYTLENSSLFQKHPEYRTALTVASIPERVIQFRVVWEDDNGNVQVNRGYRVQFNSALGPYKGGLRLHPSVNLSILKFLGFEQIFKNALTGLNMGGGKGGADFDPKGKSDNEIRRFCQAFMAELHKHIGADTDVPAGDIGVGGREIGYIFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAVMAIKEARQSLTSFQHAGHLKWIEGARPWVHVGKVDVVLPCATQNEVSGEEAKVLVANGARFVAEGSNMGCTLDAIELFEAHRNEHKRDQGAVWYAPGKAANAGGVAVSGLEMAQNSQRLTWSAEEVDGKLQAIMKECFETGLRTANEYTEVEDDKLPSLVAGSNIAGFIKVSEAMRDHGDWF

SEQ ID NO: 17146 - protein, 276 aa, Candida maltosa
MISRTLLKRTVPASRLLRSFTTSNVRLSAHEEDLVNVNNLPRPKPTENYVPLINPTEKYKVQIEELHKFGTYIMSCLPKYIQQFSVWKDELTIYVAPSAIRPVMSYLKNHTSCQFKAVMDITAADYPSRTNRFDVVYNLLSDRHNSRIRVKTYANETSPVPSVTPLFNGANWYERETYDLFGVFFVGHPDLRRIMTDYGFEGHPLRKDFPTTGYTEVRYDEEKKRVIYEPLELTQAWRNFTVGSSVWEPVGEGKDFTPESFKLPTPQPEPEQEEKK

SEQ ID NO: 17147 - protein, 352 aa, Borrelia burgdorferi
VKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINIARQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIKIHIPKGINNEEQILIKNAGMPILQTEKFGNLILITKIKTPKNLNSNAINFLKTWAKN

SEQ ID NO: 17148 - protein, 232 aa, Oryza sativa (japonica cultivar-group)
MRGEEEPAVAAAAYTTASKAGLLMELSPPNHESSPPTAGGGGGGGGDGAGGSSSAGASSSAGGGAATPQTPSRYEAQKRRDWNTFGQYLRNHRPPLGLAQCSGAHVLEFLRYLDQFGKTKVHTAACPFFGHPNPPAPCPCPLRQAWGSLDALVGRLRAAFEENGGRPESNPFAVRAVRLYLREVREHQARARGVSYEKKKRKKPQPADTSGGGGHPHPPPPPPPPPSAGAAC

SEQ ID NO: 17149 - protein, 441 aa, Cryptococcus neoformans var. neoformans JEC21
MATIHPSRMRLVPGAAQQRLPPPSSAELPSREDELKKSLMERRSRDDGAGSRSDMERGNRDDRDRAYERDRKDSGYDRDRRDRRDGNDGRQRDEPPHQERRASPSYQPYHSHDMTGSAPAPSGPPGAGHGYGYGRRDDIPRGPPGSGGAAPVFRGSWQNPPPRFNGPIDFERRRQERNDSTFSIWPASPKGPHRDEDEIEAERKKSKSKSSRKSKSKRSKRSKYSDSDSTDSEEERRRRRRRREKEREKDRGKDRERERRHDSDDEERERRKRRRSEKTDDDQWVEKGHERQSKGKEVIPAPVKEQVVENDDDDVEVGPQLPKEINEKRGRSAFANMLPGEGEAIMAYAESGQRIPRRGEIGLDSEQIAVYESSGYVMSGSRHQRMNAVRMRKENQVINEAEKRAILKLQREERMKKEGAIVSQFKEMIDENLRKQGLDGQ

SEQ ID NO: 17150 - protein, 567 aa, Aspergillus oryzae
MATPSVMSSLSRRSLSTRPQVLRSARPLRSSGFSQQPVQRTARRSYADAAPAPKPKKGFRFLRWTWRLTLLSGLGLTGYVAYSIYELRHPIEQIAPDPKKKTLVILGTGWGSVSLLKKLDTENYNVVVISPRNYFLFTPLLPSCTTGLVEHRSIMEPIRNITRQKNAYVKFYEAEATKIDYEKRVVYISDDSEIKGDISQTEVPFDMLVVGVGAENATFGIKGVKEHSCFLKEVGDAQKIRTRIMDCVETAIFKDQTEDEIKRLLHMVVVGGGPTGVEFAGEIQDFFEEDLKKWVPEIKENFKVTLVEALPNVLPMFSKQLIDYTESTFKEEAITIRTKTMVKNVTDKYIEAEVTKPDGTKELETIPYGLLVWATGNAVRPVVRDLMSQLPAQKNSRRGLAVNEYLVVNGAENVWAVGDCAITNYAPTAQVASQEGAFLARLFNTMAKTEAIEDDLKQLSEAQAQAKSPEERNQIFDEIRERQKQLRRTKQIGPFQYSHQGSLAYIGKERAVADISWLSGNIASGGTMTYLFWRSAYLSMCFSTRNRVLVAVDWVKAKMFGRDVSRE

SEQ ID NO: 17151 - protein, 393 aa, Treponema denticola ATCC 35405
MFLEVPKFLHWEFLVPASKRDYYEVLGVDKKASNDDIKKAYRKLAIKYHPDKNQGDKAAEEKFKEATEAYEILIDEKKRSMYDQFGHAGVDGMSGGGGYDPSAFQGFEDIFGGSFSDIFENLFGGGFSSRSSGFGGRHAGPVRGSNLRYDLQISFVDAVYGKKAELSYTRNEKCSECHGTGSESGSSKRMCPDCKGTGQVRQSTGFFSISRPCPTCGGEGSIIEKPCKKCGGNGLERKKQRIIVTIPAGVENGKRITIPSQGNAGQAGGDYGDLFVFIFVQAHPYFERNGIDLYCAVPISMTQAALGGEINIKSLDEKTLRLKIPAGTQNGKLLRIRGEGVPTGIGRKGDLYIQIQVQIPSKLSSNSKKLLQEISAIEGENENPNLIPLKDLP

SEQ ID NO: 17152 - protein, 407 aa, Idiomarina baltica OS145
MTDNSAKMAVTREMFSDVMVPNYNPAQMVPVKGEGSRVWDQAGKEYIDFAGGIAVNCLGHCHPAMVNALHEQSQKLWHLSNVFTNEPAIRLAKKLTDATFADRVYYANSGAEANEAALKLARRWAIDVHGEQKQKIIAFNKGFHGRTFFTVTVGGQPAYSDGFGPKPGAIEHVPYNDADALAKLIDDETCAVMMEPLQGEGGVVPPEQDFVKQVRELCDKHNALLIFDEVQTGFGRTGTLYAYEQLGVTPDILTSAKSLGGGFPIGAMLTTAAIAEHLKPGTHGSTYGGNPLACAVSEAVLEVVNTETVLEGVKQRETMIKEHLAAINDKYNVFKEVRGMGCLIGAELTEQFEGRARDFLLAGQEHGVMVLVAGASVIRFTPSLIIPEEDIKEGLKRFEHAVAQVVG

SEQ ID NO: 17153 - protein, 436 aa, Saccharomyces cerevisiae
AVSKVYARSVYDSRGNPTVEVELTTEKGVFRSIVPSGAATGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 17154 - protein, 544 aa, Oryza sativa
  misc_feature (172)..(172): Xaa can be any naturally occurring amino acid
  unsure (1)..(544): unsure at all Xaa locations
MASAEAECAAAAVGGGGRAEIDTSAPFESVREAVDRFGGSAAWSSHLIRRMFAPPNPKEQSEESKQPVDIKEQAAQLEHDLIIKEKETLDVLKELESTKKIIADLKQRIQKESNETSPSAVKSDDQSEIPITESEEQKPENVNIDMDMEGLDEHPQPLSGSVLLELEQAKAXLNRTTGDLAAVRAAIELLHNSIAKEKLLLERSREKLSSNTALASSLEDELDQTTQKLQTLKDLQARREDPSDIFIEIKKMASEVQQLRGMANASKSEAMMLAAEIEQTKASIGTAEIRCIAAKKMEEAARAAEALALAEIKALLSSESSSECGSSVCDGVTLSAEEYFTLCSKAQEADENSRKEVEEAMLQVDVANSSETDSVKKLDDARLEVEECKRALQEALKRVEAANRGKLAVDEILRRWKSENGHKRRSIGGSPKFKNAAQRRKDSHSMDIISDASTNSCKQTLSIGQILSMKLMGPEGYDKTIWDDKTSEMPNVSLGQILNRGRVLSREETAVRKRVSGKRKKFALTGLSVLLAKQAKNKKKRESL

SEQ ID NO: 17155 - protein, 137 aa, Ostreococcus tauri
MKCGPTYATVDDRVIIEPNLRSHFVVGRATREYERLVQAIPNCFVGSYAQLTEIVHFVSQHMNASFRERGLDVPPWRRPSALTSKWTLRAPGSSVPPSPRDHARRIRTSRLHETKIHSFNIRLRTKLRGAGVLTRSI

SEQ ID NO: 17156 - protein, 367 aa, Silicibacter pomeroyi DSS-3
MSNPSLLILPGDGIGPEVMAEVRKIIGWFGDKRGLNFDVSEDLVGGAAYDVHGVPLADETMAKAQEADAVLLGAVGGPKYDDLDFSVKPERGLLRLRKEMDLFSNLRPAQCFDALADFSSLKKDIVAGLDIMIVRELTSGVYFGEPRGIFEEGNERVGINTQRYTESEIERVARSAFELAMRRSKKLCSMEKANVMESGILWREVVTRVAKDYPEVELSHMYADNGAMQLVRAPKQFDVILTDNLFGDILSDCAAMLTGSLGMLPSASLGAPMANGRPKALYEPVHGSAPDIAGQGKANPIACILSFAMALRYSFDQGAEADRLEAAVEQVLADGVRTADLLGTEGVTPVSTTEMGAAILAKLDASL

SEQ ID NO: 17157 - protein, 498 aa, Bacillus licheniformis ATCC 14580
MRNEEAAFMSQTLFIDGKWVGAKKGETRQIINPYNQEHIETVSEGDREDAVRAIAAARRAFDDGEWANTPGLERGNIVLKIAELIRRDHEELAELESLDTGKTIEESRADMDDIANVFQYYAGLADKDGGEVISSPIPDSKSKIVREPVGVCGQITPWNYPLLQASWKIAPALAAGNTIVVKPSEITPLTTIKIFKLMEEAGVPEGVANLVLGPGATVGDELARNKDVDLISFTGGIETGKKIMQAASTNVKKIALELGGKNPNIVFKDADFDVAVDQALNAVFFHAGQVCSAGARLLVEESIQDEFVAELVKRAKKIKLGNGFHEETQSGPLISAEHRSKVEKYVEIGLQEGAKLETGGKRPEDPELANGFFYLPTIFSSCTSDMRIVKEEVFGPVLTVETFKTEEEVVSLANDTIYGLAGAVWSKDIEKAERVASKLRMGTVWINDFHPYFAQAPWGGYKQSGIGRELGRMGLEEYTEVKHVYRNTKPAAVNWFKA

SEQ ID NO: 17158 - protein, 837 aa, Oryza sativa (indica cultivar-group)
MSGQSNSPDMIFQVYTPRKRKFLNSVHYSESNRAVSHGSGLVTSAKDSHQGEESFLNGPAGLSSILSNSQGFAPQDILSGTTELSGIRYSTDQSQTAVAHKLLFSCEKGDQSIVAMVHPSQSSLEKIQQKQGISSYEAKHDVQGSTKADDSSSILSPHSLDDEIMSVVGLLSPSAYESLCDAEKKNHDITWPKIIEIKGRVKLDAFEKFVQELRRCQTRSLMVISLCWKFGTSKAGLLGMKEVAENFEASQKVGFADVCDGSNLYVCPRSDAVITILAKCGFFKGMSAADTNQDSLIGCIVWRRNPLSKIVDHSRSETIGKGSPCVPHVGARHPTSLPFSDGHQATSCSNNPGMDSRTNTGNIQNDIDQMQEIQSNSVKTHPVATGLLSQCGHAKSTGERDPTEKVVPHSLFKLASKLTPQPPFKAPSLIGCQLSQVSPFELASHEVPEIQQHVQSIIDSHSGSFGVWHPTSHSQGLSLKSLHVQQRTTHYDLAAQKNHMAEAFSGSITQEYASNAVESSKQQETNPFFLQPDTYGAHRANDIDDLPKVDFANLHRVELKFDVHPINRETTITSDVLICPRLSDKKSNSPFQQSSQPSFRVEGIKNHEKVEVKENVTDMISREITNQVSHRKAEIENFKSKDDIDAEDMPECHFQGLDNEKLHQSGSSKHTSPSLKNSTGSKAPSQVFPPITQKSYTPLEVEDISSGHDPNMPSGCLNIPRDQGSFPRILHLHKGINGQDLYPWRPPFHANQGPFPRHAPPHPCPPFTPGHVRPPSNFAPPGPWRPVLHPGQEHHHHHYGHPGRSNGPSGSGNKPGYHNPSYGNGPGGCRPPHQAQG

SEQ ID NO: 17159 - protein, 585 aa, Thermus thermophilus HB8
MAGLVDRVSGARLDPAAEAEIRYLEAMIARLEAGEEDPEDFRVFRLKNGIYGIRGRPEHHMIRIKLPVGRITPEGLRVLADVAERYAENRLAHVTTRQAVQLHHVHRRDVPKVLRAVNAVGLTTREACGHSIRAITCCPYAGVSPEEPFDVTPYAEAAYRYFLRHPVGQNLPRKFKIAFEGCAADHARTPIHDIGVVAALEGGKRGFRVYVGGGLGAAPMSAELLEAFTPEEDLLPTMLAIVRLFDRYGNRKVLTQARLKFLVKKWGIAAFREAVREERRLVKLTASGEDLEAWAPPPEPEPPRLPSPPKKPFSFAPGFDAWRRTNLFKQKQEGFYTVTVRLPLGDITPEGLRALAAIAETYAAEVRSAISQNLLLRFVPEEALGGLYEALLEAGLALPEAHTLLDITRCPGADTCNLAITRSRGLAQALEAHLATLPLAQDPGAKAIGVKISGCPNSCGQHHIADIGFYGSSRKVGEREVPHYVLLLGGRTREGEARFGQVVGRLPARRVPEAVERILKRYLEERQNGESFQAYLDRVGAASFKPLLQELQEVPPYEEAPEFYQDLGAEGEAFSVQLGRGECAV

SEQ ID NO: 17160 - protein, 259 aa, Triticum aestivum
LHRTSLYKKAGWYRSGIPGISSTHASDKGEIAAVFLEPVVGNAGFIPPQPAFLNALREVTKQDGALLVFDEVMTGFRLAYGGAQEYFGITPDVTTLGKIIGGGLPVGAYGGRKEIMEMVAPAGPMYQAGTLSGNPLAMTAGIHTLKRLMEPGTYEYLDKVTGELVQGILDAGAKTGHEMCGGHIRGMFGFFFAGGPVHNFDDAKKSDTAKFGRFHRGMLEKSVYLAPSPVRGRFLQALAHTTLDIEKTVEAAEKVLQRI

SEQ ID NO: 17161 - protein, 435 aa, Thermus thermophilus HB8
MTQLEAARKGKITEEMAYVAEKEGVSPEFVREGVAAGRIVIPRNPNHKTLTDFKGIGEGLSVKVNANLGTSYDYVDVEEEVEKARVAIQYGADTVMDLSTGGDLKAIRKRILEVATVPLGTVPIYEAEFRAARRKNFFDMSADELFQVIEEHGKEGVDYITVHVGVTLKNLEVYRNSPRTTGIVSRGGGLMAAWMLHRGEENPLYARFDDLLDIARTYDMTLSLGDGLRPGSLADSTDRAQIAELLTIGELVERARRAGVQAMVEGPGHIPLNEVAANVQIQKKLTGHAPFYILGMLPVDTAAGFDHIAGAIGGALAGWWGADMLCYLTPAEHLGLPTPEHVKQGVIAFKIAAHAADVARGNKRALERNRRMSEARYRLDWEGQFALALFPEEARRLKEERGSKTKACSMCGPFCPMNLVEAVLKGKGRMELPVA

SEQ ID NO: 17162 - protein, 325 aa, Staphylococcus epidermidis ATCC 12228
MAQMTMVQAINDALKSELKRDEDVLVFGEDVGVNGGVFRVTEGLQKEFGEDRVFDTPLAESGIGGLALGLAVTGFRPVMEIQFLGFVYEVFDEVAGQIARTRFRSGGTKPAPVTIRTPFGGGVHTPELHADNLEGILAQSPGLKVVIPSGPYDAKGLLISSIQSNDPVVYLEHMKLYRSFREEVPEEEYKIDIGKANVKKEGNDITLISYGAMVQESLKAAEELEKDGYSVEVIDLRTVQPIDIDTLVASVEKTGRAVVVQEAQRQAGVGAQVAAELAERAILSLEAPIARVAASDTIYPFTQAENVWLPNKKDIIEQAKATLEF

SEQ ID NO: 17163 - protein, 910 aa, Synechococcus sp. CC9311
MSPDVSQLFPFPLDGFQLESIDALNQGHSVVVSAPTGSGKTLVGEYAIHRAIAHGQKVFYTTPLKALSNQKLRDFREQFGAENVGLMTGDLSVNREARVVVMTTEIFRNMLYAEADEHDDPLADVESVVLDECHYMNDSQRGTVWEESIIHCPPSVQLVALSATVANAGQLTDWIEKVHGPTRLVLSDFRPVPLQFSFCSAKGLHPLLNEQGTGIHPNCKVWRAPKGHKRKGRSPRPPQPEAPPISFVVAQMAQREMLPAIYFIFSRRGCDKAVRDLGVQCLVTEAEQSIIRERLEAYTVANPEAVRDGQHADALLRGIASHHAGVLPAWKELIEELFQQGLVKVVFATETLAAGINMPARSTVIASLSKRTERGHRPLMASEFLQMAGRAGRRGLDTQGYVVTVQSRFEGVREAAQLATSPSDPLVSQFTPSYGMVLNLLQRHDLAKARELVERSFGRYLASLDLVEEEEHLGELRMQLAQLQGTAGDVPWEDFEDYEKQRGRLREERRLLRILQQQAEETLAHELTIALQFASVGTLVSLKSPRLRGGVTPAVIVEKCDGPGQFPLLLCLTLDNVWMMLPCQGVVSLHAELSCLQVDGVKSPDLSRSGELRHGDQDSGRLALAVAHMARRHDMTTAQYDLAGEVLSQVRLVQELEDQLEGHPAHRWGDRKQLKKHRRRMEDLQHEIRERQQLLHHRSNRHWEIFLALIEILRHFGCLDDLEPTEIGRTVAALRGDNELWLGLALMSGHLDELPPAELAAVFEAISTEVNRPDLWSAFPAPPLAEEALHDLSGIRRELLRAQERFKVVVPAWWEPELMGLVEAWAKGTSWNDLIANTSLDEGDVVRIMRRTVDLLAQVPYCEAISEQLRKNARAALIAINRFPVAEADQVLKAAAAESSGLNAATERAA

SEQ ID NO: 17164 - protein, 174 aa, Triticum aestivum
MAAAGDAGEKKMITLKSSDGEEFEVEEAVAMESQTIRHMIEDDCADNGIPLPNVNSKILSKVIEYCNKHVQAKPADGAAAAAGASDAAAPTAPAEDLKNWDAEFVKVDQATLFDLILAANYLNIKGLLDLTCQTVADMIKGKTPEEIRKTFNIKNDFTPEEEEEIRRENQWAFE

SEQ ID NO: 17165 - protein, 468 aa, Staphylococcus epidermidis ATCC 12228
MVVGDFPIETDTIVIGAGPGGYVAAIRAAQLGQKVTIVEKGNLGGVCLNVGCIPSKALLHASHRFVEAQNSENLGVIAESVSLNYQKVQEFKTSVVNKLTGGVEGLLKGNKVEIVRGEAYFVDNNSLRVMDEKSAQTYNFKHAIIATGSRPIEIPNFEFGKRVIDSTGALNLQEVPNKLVVVGGGYIGSELGTAFANFGSEVTILEGAKDILGGFEKQMTQPVKKGMKEKGIEIVTEAMAKSAEETENGVKVTYEAKGEEQTIEADYVLVTVGRRPNTDELGLEELGLKFADRGLLEVDKQSRTSIENIFAIGDIVPGLPLAHKASYEGKVAAEAIDGQAAEVDYIGMPAVCFTEPELAQVGYTEAQAKEEGLSIKASKFPYAANGRALSLDDTNGFVKLITLKEDDTLIGAQVVGTGASDIISELGLAIESGMNAEDIALTVHAHPTLGEMTMEAAEKAIGYPIHTM

SEQ ID NO: 17166 - protein, 285 aa, Xanthomonas campestris pv. vesicatoria str. 85-10
MSTNDNWYIEHFQPTGSAIGFRISGKLDEVQSPFQKIEIYQTTDWGKLMLIDGAVMLTSRDNFFYHEMISHPALFTHPAPKRVVIIGGGDCGTLREVLKHPGVESATQCDIDEQVTRMSEKYFPELCDANHDARAELLFDDGVAYMANCPAGSVDIVIVDSTDPVGPAEGLFNKAFYESCFKALKDEGILVQQSESPLALLDLINEMRTEMGKAGFQSFKTLPFPQPCYPTGWWSVTMASKQANADFAFRQADAQAKGFDTLYYTAHLHTGVLVAPPFVAKALGE

SEQ ID NO: 17167 - protein, 443 aa, Medicago truncatula
MERQTTRRLDTDFYLPDDCLESIFKFIITTNSYRSLNSLYLNSLSLVSKQFLSITNSLRFSLTIRSSTPIPSLPCRFQRFTKLTSLNLKYFNSDIDALLCQISHFPLNLTSLNLSNKLTIPVNGIQAFSQNITTLTSLTCSRIYSFNGTDLFLIADCFPLLEELDLSKPIMLENYKSLHNGVEALSTALYKLWKVNLTSHHYIKDQSLFHLFNNWKLLEEVVIRDCYGITKPGIAHSLRDRSTLRSFSFSGLNFKWEDCDVSAQLKFLEVTCNSWLTYDNIKMFASIFPNLQLLDLRCCHNISEEGICQVLRCSEIRHLNFTGCLHVKLRGMNFEVSNLEVLNLSCTRFDDETLYVISKSCSGLLQLLLVSCKYVTEKGVKHVRKNCIQLREINLRGCDQVHADIVDKMVFSRPSLRKITAPPRYDFSDKKRKLFLRHGCLVS

SEQ ID NO: 17168 - protein, 399 aa, Pseudomonas fluorescens PfO-1
MSGNRGVVYLGAGKVEVQKIDYPKMQDPRGRKIEHGVILRVVSTNICGSDQHMVRGRTTAQVGLVLGHEITGEVIEKGSDVESLKIGDLVSVPFNVACGRCRSCKEQHTGVCLTVNPARAGGAYGYVDMGDWTGGQAEYVLVPYADFNLLKLPDRDKAMEKIRDLTCLSDILPTGYHGAVTAGVGPGSTVYIAGAGPVGLAAAASARLLGAAVVIVGDVNTIRLAHAKAQGFEIVDLSKDTPLHEQIAALLGEPEVDCAVDCVGFEARGHGHDGVKSEAPATVLNSLMGVVRVAGKIGIPGLYVTEDPGAVDAAAKMGSLSIRFGLGWAKSHSFHTGQTPVMKYNRQLMQAIMWDRINIAEVVGVQVISLDQAPEGYGEFDAGVPKKFVIDPHKLFSAA

SEQ ID NO: 17169 - protein, 175 aa, Brassica napus
ESLNTEPPFGSPQHGNAVKEEVAASDSGAVSNIKSPSRSPKEACESVSPKTELQKAIVTSPKPDVGVKLGVDVSKPEEEAPLVTSSKEEHIWGGLLQLSASSVVSVTGIFKSGEKAKTSEWPTMVEVKGRVRLSAFGKFVQELPLSRSRVLMVFEVHYLHHHCSRSIIIKFTLLF

SEQ ID NO: 17170 - protein, 193 aa, Zea mays
MTTKRDTESDGEGSNPVGGGATPPPLAAAPVVCLLRSAGDFGGGAFVGSIFGYGQGLITKKGFKGSFSNAGSSAKTFAILSGVQSLVLCLLRRLRGKDDIVNAGIAGCCTGLALGFPGAPQALLQSCATFAAFSCIMEGLNKQQAAMARTLGGTAAMAVHEKCGVLPPFTLPPILDASDALASCCLALVKPKH

SEQ ID NO: 17171 - protein, 202 aa, Zea mays
MASDTASAVPSSVVSAAEETLGYTESVGDHLSHLLAAAAADPDAVAELPPLLRARAFLALAQAATSLLGVRLRCSGVDPDEHPIRKEFERLSLMQEKLNQFENWDKAPLRPSTTLNTQAAARFIGHSLSHLTSDQKRSMHEISRGERRSWSGQKRKPEPSVEKKSVRAAAEEFLAKASQELIGHSDSRVKGPVILISDEDED

SEQ ID NO: 17172 - protein, 207 aa, Magnaporthe grisea 70-15
MASLRSSSTAAARLLRSASWQQTRAVVAGRRHESSLVRSEKSGPALPDTDAKPANQPDYQSAFDKATSTFSPVPKRVLDGSEPTEALPAAVLSGAPMELQARTVRIYRPSKPATQSGTHGLRQWRMDWDVLGKGHRWENPLMGWQSSGDFMQGSHIYFKSKEEAIAFAEKQGYEYFVQEPNERKITPKAYANNFLYSDKKLKHIRTK

SEQ ID NO: 17173 - protein, 450 aa, Idiomarina baltica OS145
MSRHYDYLAIGAGSGGIASANRAAIRGAKAAVIEANAVGGTCVNVGCVPKKVMWYGAHIAEAVKYSSAYGFDLDQKGFDWATMVKNREAYIERIHGGYHRGFQGNGVEFIEGFAKFVDHRTVEVNGEKITADHITIATGGRPMIPDVPGAEHGIDSDGFFALKEQPKKAAVVGAGYIAVEIAGVFQALGTDTHLLVRRDRPLRSFDRYITDGLLERMEQDGPTLHTETVVKEVVKEQNGTLTLHFENGETMKDVDCLVWAIGRVPATDKINLETTGVELDAQGFIKVDKFQNTSVQGIYAVGDNTGATALTPVAIKAGRQLAERLFNDMPNAHMDYENIPTVVFSHPTIGTVGLSEEDAIVKYGKSNIKVYTSSFAAMYNAVTPHRALSYFKIVCYGKEERVVGIHGIGEGMDEILQGFATAMKMGATKADLDSTVALHPTSAEEFVTMR

SEQ ID NO: 17174 - protein, 339 aa, Synechococcus elongatus PCC 7942
MAQSTTSETHTRDLDRDCTTLSRHVLEQFQSFSPEAQDLAALMQRIGLAAKLIARRLSHAGLVDDALGFTGEINVQGEASKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFCSGPKVSPVHPGNASPRRLQRRYSGALVADFHRILMQGGVFLYPETVKNPTGKLRLLYEAPPMAFLAEQAGGKASDGQKPILLRQPQALHRRCPLIIGSAADVDFVDSLLG

SEQ ID NO: 17175 - protein, 333 aa, Streptomyces coelicolor A3(2)
MTRPVVEGGPAVVCLGETMAQIVPIDGLRLHEASACAFGVAGAESNVAISLSRLGTAAFWAGFVGDDPMGLRVLGELRRHGVVTKLARTMPGRRTGVYFKDPAPEGSDIYYYRSGSAATLMDGEYAERIAAVRPRWIHLTGVTPALSENCREAVISLIELAGDTGASVSFDVNYRPSLWPARDAAAQSLMAIADRCNVVFVGLDEAQTLWKSCTAGAVRDHLPSPDVVVVKDGGREAVAFRGGRRTAVPALPVDVVEPVGAGDAFAAGWIHGALVGLDEAGCLRLGHLLAGAAMTSLSDVADLPTAPAALVARAKHGNEWPGHGSPAEASPHP

SEQ ID NO: 17176 - protein, 483 aa, Triticum aestivum
  misc_feature (20)..(20): Xaa can be any naturally occurring amino acid
  unsure (1)..(483): unsure at all Xaa locations
VAAPATTPSQDKLLGGLLSXAAFDESSCQSRYKSSLYRKPSPFPLSPYLVKKLRKYEAYHKKCGPGTQRYRTAVEQLQAGRNADSAECRYVVWFPCNGLGNRMLTIASTFLYALLSGRVMLLNVPPEQEGLFCDPFPATSWVLPGGFPEGNPMKLNVGAPESYVNMLNNGVIRHDTPAASLPAHVYLHVEQTRLRLSDNIFCDDDQRLLRKFTWMILKSDSYFAPALFLTPMYEKELARMFPQKEATFHHLGRYLFHPTDRVWGIVRRYYEAYLARVDEKIGFQIRIFPEKPVKFENMYDQLTRCIREQRLLPELGEPASPAANATGNDGKVKAVLIASLYSGYYDKIRGLYYESPTKTGEIVAVYQPSHEEKQEYASNEHNQKALAEIYLLSYCDKIAMSAWSTFGYVAYGFAGVKPWILLRPDWNKEVSDVACVRSTSVEPCLHSPPILGCRAKKEVDVARVKPYVRHCEDVGFGLKLFDS

SEQ ID NO: 17177 - protein, 355 aa, Salmonella enterica subsp. enterica serovar Typhi str. CT18
MSQKYLFIDRDGTLISEPPSDFQVDHFDKLAFEPEVIPVLLKLQKAGFKLVMITNQDGLGTQSFPQADFDGPHNLMMQIFTSQGVCFDEVLICPHLPADDCDCRKPKVKLVERYLAEQAMDSANSYVIGDRATDIQLADNMGITGLRYHRETLNWTMIGEQLTKRDRYAHVVRNTKETQIDVSVWLDREGNSKINTGVGFFDHMLDQIATHGGFRMEITVKGDLYIDDHHTVEDTGLALGEALKLALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 17178 - protein, 199 aa, Triticum aestivum
MLQTQKVRITNFLDERSAYLTKFTKDADTEFDMIGQNAMKELDQIGDQIMERLDSKMQSYEETAEMQRQEIEMNERVLEDFEDWIEEEKNEGMFFKSLGKVQKPQNPQAIKVKARIEAQKVTEITKESAGSKARMNIYLALMAILSLTIANAVFATPEVEWRKVPALGLIFIGLVAQLIYAAKIYPHQQLQGCKKKKKG

SEQ ID NO: 17179 - protein, 450 aa, Idiomarina baltica OS145
MSYVKETIDMLKRTSPAQNEFYQAVEEVLESIEPLLEEHPKYRQQAIIERLVEPERQIMFRVPWQDDKGQVHVNKGYRIEFNSALGPYKGGLRFHPSVNAGIIKFLGFEQIFKNALTGLPIGGGKGGSNFDPKGKSDAEIMRFCQSFMTELHRHIGPHTDVPAGDIGVGTREIGYLFGQYKRLKNRFEGVLTGKSLRWGGSHARKQATGYGAVYFAQCLLGDRGEKLSDKRCLVSGSGNVAIYAMEKLYELGATPVTCSDSNGMVYHKSGIDLDLVKQIKEENHERLKTYLDTHDDAEYIAREDYPEDGHSVWRYEGDIAFPCATQNELTEQDAQALAENGCLAVLEGANMPSTQAAVDFFVEQKIGYGPGKAANAGGVATSQLEMAQNAGMQQWSFDEVDRKLQEIMKTIYSDCKRTAEQFGSPNNLVLGANIAGFKKVADAMIEQGVV

SEQ ID NO: 17180 - protein, 203 aa, Salmonella enterica subsp. enterica serovar Typhi str. CT18
MLTEQQRRELDWEKTDGLMPAIVQHAVSGEVLTLGYMNPQALDKTIESGHVTFFSRTKQRLWTKGETSGHVLNVVSIAPDCDNDTLLVLANPVGPTCHKGTSSCFGDASHQWLFLYQLEQLLAERKTADPASSYTAKLYASGTKRIAQKVGEEGVETALAATVNDRFELTNEASDLMYHLLVLLQDQDLNLTTVIDDLRKRHQ

SEQ ID NO: 17181 - protein, 109 aa, Zea mays
  misc_feature (55)..(55): Xaa can be any naturally occurring amino acid
  unsure (1)..(109): unsure at all Xaa locations
MWTYRDEDPRLHDIKTKIRVVPNFPKPGIEARGFIFGSPIALAIRAKFVPLRKPXKKLPGKVISQEYILEYGRDCLEMHVGAVEPGERALVGDDLIATGGTLCADMDLL

SEQ ID NO: 17182 - protein, 498 aa, Zea mays
MALAGTGVFAEILDGEVYRYYADGEWRTSASGKSVAIVNPTTRKTQYRVQACTQEEVNKAMDAAKVAQKAWARTPLWKRADVLHKAAAILKEHKAPIAECLVKEIAKPAKDAVSEVVRSGDLVSYTAEEGVRILGEGKLVVSDSFPGNERNKYCLSSKIPLGVVLAIPPFNYPANLAGSKIGPALIAGNALVLKPPTQGAVAALHMVHCFHLAGFPKGLISCVTGKGSEIGDFLTMHPGVNCISFTGGDTGIAISKKAGMVPLQMELGGKDACIVLEDADLDLVSANIVKGGFSYSGQRCTAVKVVLIMESIADAVVQKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCIFTRDINKAILISDAMETGTVQINSAPARGPDHFSFQGLKDSGIGSQGITNSINMMTKVKSTVINLPSPSYTMG

SEQ ID NO: 17183 - protein, 689 aa, Magnaporthe grisea 70-15
MLSVGHQSRRLQGSARLITGARSQLLLNPLHTRSIASPRLHVRHALATPKITNAHARFRFDSVHQRQFVRYLSDVPVPRQRSRAWIIAYRAAAWFGSSIAFVGLGVVGFFLYDASTYKESGTHEEIDVARTALNPRRGGPKNLPILEAYLDDNESPTARERKEKPRLVILGGGWGGVAILKELNPEDWNVTVISPANYFLFTPMLPSATVGTLELKSLVEPIRRILHRVGGHFLHANADDVDFSHKLVEVSQKDSSGNLQRFYVPYDKLVVAVGSSTNPHGVKGLENCFFLKDIRDARKIRNQIVQNLELACLPSTSDEERKRLLSFVVSGGGPTGVEFAAELFDLLNEDLTLHFPKLLRNEISVHVIQSRGHILNTYDETVSKYAEERFARDQVDVLTNSRVSEVKKDRIIFTQKGPDGKLITKELPMGFCLWSTGVSQTEFSKKIAERLGEAQGNRHALETDSHLRLLGTPLGDVYAIGDCSTVQNNVADHIITFLQAYSWKHGKDPQTLQLHFSDWRNVAADVKKRFPQAASHLKRLDKLFAEFDKDQSGTLDFGELRELLRQIDSKLTSLPATAQRAHQQGQYLAHKLNKLARAAPGLRANDIMDGDVDAAVYKAFEYKHLGSLAYIGNSAVFDWGEGWSLTGGLWAVYAWRSVYFAQSVSFRTRMLLAMDWLKRGLFGRDLMAY

SEQ ID NO: 17184 - protein, 357 aa, Synechococcus sp. CC9311
MQPTTYLAGDLGGTKTLLAIYSDQNGELKQEHVQRYVSAEWTSLDSMLNHFLQARPDTNSTPQTSCFAVAGPVKNRAAELTNLGWTISQESLKQSAGLEQVELVNDFAVLIYGLPHFSDSQQITLQAGSTKNSENTQSEPGPVAILGAGTGLGMARGLPSNKGWIALPSEGGHREFAPRSDDEWGLVQWLKRDLSLERISVERVVSGTGLGHVMHWMLQQSKDAKHPLQEKAKAWRWNKPDHPDYHDLPASTCQYAKAGDQLANAAMTLWLSAYGAAAGDLALQELCTGGLWIGGGTAEKNQDGLKSIHFLNAMRQKGRFQPFLEGLTVRAVIDPEAGLFSAACRARELAESSGTLA

SEQ ID NO: 17185 - protein, 500 aa, Saccharophagus degradans 2-40
MTAPELPTSLYTSEQVKQLDALAIEQANIAGIVLMKRAGRAAFELLLEQWPQVESVVVLCGAGNNGGDGYVIAALAAQKKLNVHAVAIADPAGLSGDALKAYNYAQQEGVTVIAGSELNTVQIDASTVIVDSLFGTGLSREVEGDYSRAIAWANNSAAPVLGVDLPSGLCGNTGKVWGDAIKCAATITFIGVKRGLLTGRGPAFTGDVYFDDLGVPASIYDAIKPEVTRTSRLALMPSLPEREADAHKGQFGYVLVVGGDVGMGGAAAMAGEAAARTGAGLTGIATQPIHVAPILARCPELMVIGVASGQAIEPVLAKPTVVVLGPGLGRDSWSEQMLQQATLTDLPLVMDADALNLLAEGRVVRKTQRDNWVLTPHPGEAARLLDCSVAEIQADRFAAARAIQTKYGGVVVLKGAGTIIAGADQLVVANVGNPGMATGGMGDVLSGVIGALIAQGLTLFEAAQLGVCAHGDAADLAVQEAGVRGVMATDLIPFIRELLN

SEQ ID NO: 17186 - protein, 75 aa, Brassica napus
  misc_feature (15)..(15): Xaa can be any naturally occurring amino acid
  unsure (1)..(75): unsure at all Xaa locations
VDPRVRCRAEDILEXVQSPPFRQQVDAFTYVLRTGQIDLTQFGIDPSKYKFTVVSFLEALEDSVSSQSNDAMDES

SEQ ID NO: 17187 - protein, 453 aa, Staphylococcus epidermidis ATCC 12228
MGVILLNSNNNNHEQQRSLDEINNTINFNHNDSASQKFLAFLGPGLLVAVGYMDPGNWITSMQGGAQYGYTLLFIILISSLSAMLLQSMTVRLGIATGMDLAQMTRHFLNKPVAIMFWIIAELAIIATDIAEVIGSAIALDLIFGIPLIVGALITVFDVFLLLFIMKFGFRKIEAIVGTLIFTVLAIFVFEVYISSPHIIDMLNGFVPHKEIITNQGILYIALGIIGATIMPHNLYLHSSIVQSRKYDRHSIHEKAQAIKYATIDSNIQLSIAFVVNCLLLTLGAALFFGTKTEDLGGFYDLYLALKTEPALGATLGGIMSTLFAVALLASGQNSTITGTLAGQIVMEGFLKLSIPNWLRRLITRSLAVIPVIICLIVFKGNTEKIEQLLVFSQVFLSIALPFSLIPLQLATSNQNLMGPFKNKTWINIISWLLIIVLSGLNVYLIIQTFQEL

SEQ ID NO: 17188 - protein, 329 aa, Bacillus halodurans C-125
MVSKDVVKQQKTEKRTMYYGKGDVFVYRTNASPLEGIKAIPESSFSGRKNVILGMDLKVALKGDAFLSSFTDGDNSLVIATDSMKNFILRKAAFFNGSTMEDFLQFISKEFLNTYSHISSVSLSGDQLLFHEVPIPSTSGFQTSDLLFQQEESVKPFAKVEVRRMDTEYKVMEQLSGIQGLRLIKVKESSFYGYIQDEYTTLPEAYDRPLFLYLNMFWAYENPEDATGIKPDRYVSAEQVAAIAYTVFHEMNCPSIQNLLYQIGLRVLMRFPQLVEISFESNNRTWETVVEEAKDERGGKVYTEPRPPYGFQGFSMTREDLLAAERAEK

SEQ ID NO: 17189 - protein, 361 aa, Glycine max
MTGCCFPVTFHRSGSRRVSFRLVRSSSSGSSKHRGRESHKGPLVVCFGEMMINLVPTVARVSLADATAYKKFPSGATANVAVGICRLGGSAAFIGKVGNDEFGHLLSDILKQNGVDNSGLLFDDHARTALGFYALKSNGEPEFMFYRNPSSDVLLRPDEIDMDLIKKATIFHYGSVSLIKEPCRSAHLAAMNAAKVSGCFLSYAPNLALPLWPSKEAARQGIMSVWNYADIIKVSVDEIRLLTEGDDPYDDTVIMKKLHHYNLKLLIVTEGARGCRYYTKDFKGWVAGFEVEAIDTTGAADSFVGGLLSIVAAHNHIYKDEKRLREALDFANACAAFTVTGRGAIPSLPTKDAVLRIMFSY

SEQ ID NO: 17190 - protein, 472 aa, Aspergillus nidulans FGSC A4
MPPVETKQYDYIVLGGGSGGSGSGRRAAGWYGAKTLIVESGRAGGTCVNVGCVPKKMTWNFASITESIEAGRHYGYDLPHNIDVNYTHFKKLRDSTIERLNGVYEKNWGNEGIDLVHGRARFVEKKTIEVTNQDGSRTRYTAPHILIATGGRPSLPDIKGSEHGISSDGFFEIEELPPKLAVVGAGYIAVELAGVMGTVGVDTHMFIRGETFLRKFDPMIQKTMTERYEAVGIHVHKKHPGIKEVQLLRDGKGKDKLLKLIMNDGSEMEVNELLWAIGRVPEVEDLHLEIPGVELNKSGHVVVDEYQNTNVEGIYAIGDVTGQAELTPVAIAAGRQLGNRLFGGPQFKNAKLSYDNIPTVVFSHPEVGTVGLTEPQARERFGDENVKVYHTRFPAMFYSVFPPEEKAKNPTEFKMVVAGPEEKVVGLHLLGLGVGEMTQGFGVAVKMGATKKDFDSCVAIHPTSAEELVTLR

SEQ ID NO: 17191 - protein, 524 aa, Corynebacterium ammoniagenes
MTQPATTPRPVLVVDFGAQYAQLIARRVREASIYSEVVPHSATVKEIKAKNPAALILSGGPSSVYADGAPQLKPELLELGVPVFGICYGFQAMNHALGGNVAQTGDREYGRTEITHTGGVLHDGLEENHKVWMSHGDAVDKAPEGFTVTASSAGAPVAAMECVAKQMAGVQYHPEVMHSPHGQEVLVRFLTEVAGLEQTWTSANIAQQLIDDVRAQIGPEGRAICGLSGGVDSAVAAALVQRAIGDRLTCVFVDHGLLRAGEREQVEKDFVASTGAKLITAHEADAFLSKLAGVTDPEAKRKAIGAEFIRSFERAVAQALEESPEDSTVDFLVQGTLYPDVVESGGGDGTANIKSHHNVGGLPDDVEFELVEPLRLLFKDEVRAVGRELGLPEEIVARQPFPGPGLGIRIIGEVTEERLEILRQADLIARTELTNAGLDGDIWQCPVVLLADVRSVGVQGDGRTYGHPIVLRPVSSEDAMTADWTRVPYDVLEKISTRITNEVNDVNRVVVDITSKPPGTIEWE

SEQ ID NO: 17192 - protein, 287 aa, Cryptococcus neoformans var. neoformans JEC21
MSKAVLAAAEKTKSKDKAGPSEGVKPRKDKVLMLSSRGVTQRMRHLMRDLEALLPHVKRDSKLDTKSSLHLLNELADLHSCSNTLYFEARRHEDLYLWLSRSPNGPSVKCHVQNLHTMDELKMTGNCLKGSRGLVCFDGSWEGEHWSLMKEMFTHAFSVPKTSRKLKPFIDHILLFSLLDNKIWFRNYQIIEKDPLTPSGPPQSSLVEIGPRFVLTPIKIFEGSFGGPTLFSNSEFITPAAMRASVKRIAGEKYRVRKEGEKDREERRKRVREDVEEDELARKKVFA

SEQ ID NO: 17193 - protein, 426 aa, Methanocaldococcus jannaschii
MTQMDDAKNGIITEEMKIVAEKEKIDIEKLRKLIAKGYVVILKNVNRDTNPVGIGQSLRTKVNANIGTSPDCVDIELEIKKAKIAEKYGADAVMDLSTGGNLEEIRKAIMDAVKIPIGTVPIYEVGKLAREKYGRVIDMNEDLMFKVIEKQAKEGVDFMTLHCGITKQSVERLKRSGRIMGVVSRGGAFLTAYILYHNEENPLYKNFDYLLDILKEHDVTISLGDGMRPGCLADNTDRAQIEELITLGELVERCREKGVQCMVEGPGHIPINYIETNIRLQKSLCKNAPFYVLGPIVTDIAPGYDHITAAIGGALAGYYGADFLCYVTPSEHLRLPTIEDVKEGVIATKIAAQAADVAKGNKLAWEKETEMAYARKNHDWEKQFELAIDKEKARKMREEIPSKEEKACSICGDYCALLMVEELGKR

SEQ ID NO: 17194 - protein, 469 aa, Glycine max
MDKVNRVCAKDEERPLRITRARARALRGITPYSRPSLKNEQKNVLRANSKRAASSGNKTFAVVPAVVQQKGRAVLSDISNMCAKPHDKCTKASKFQAKGVCTKKNTKLAASSVSTDVSSSHDDVRAKLAEELSTIKMVESNDTLREGVTADTSLSMQNSVKSDELRNSPNKDIDIICEKLGASDSLTIVDIDSELKDPQLWSFYAPDIYSNIRVTELQRKPLTNYMDKLQKDINPSMRGILVDWLVEVSEEYKLVPDTLYLTVNLIDRYLSTRLIQKQKLQLLGVTCMLIASKYEEMCAPRVEEFCFITDNTYTKEEVLKMEREVLNLVHFQLSVPTIKTFLRRFIQAAQSSYKAPYVELEFLANYLAELALVECSFFQFLPSLIAASAVFLAKWTLNESEHPWNPTLEHYTKYKASDLKTVVLALQDLQLNTKGCFLNAVREKYKQQKFNCVANLSPKSVQSLFQNQV

SEQ ID NO: 17195 - protein, 398 aa, Burkholderia xenovorans LB400
MLNSLLDFLAHGLLHFSWWQLVLYTAIVTHITIIGVTVYLHRCQAHRALELHPVVSHFFRFWLWMTTGMLTGQWAAIHRKHHAKCETEEDPHSPQTRGIWKVLLEGAELYRTEAKNEETMRKFSHGTPNDWMERNVYTKYPILGVSLMMVLNVALFGVVGLTIWAVQMVWIPFWAAGVVNGLAHFWGYRNFNSADASTNIFPWGIIIGGEELHNNHHTYATSAKLSNKWYEFDIGWMYIRIMSAFRLAKVKKVAPTPRLTTGKLVLDQDTLQAVLANRYEVMARYGKALKRAYRQELAHLKEVGAREKYQLMRGARSWFHKEEAGLDEPQKRQLPQIFASSQKLKTYIDMRNELAAMWERSNASRDQLLVQLQDWCHRAEQSGIKTLQDFAMRLRRYA

SEQ ID NO: 17196 - protein, 472 aa, Mycobacterium avium subsp. paratuberculosis K-10
MNVHPAGPRHAEETRHPESPPRPQSPEELLLLAPNVWPRNATRNEAGVATIAGVAVTELAREYGTPLFVVDEDDFRSRCREIASAFGGGNNVHYAAKAFLCSEVARWIDEEGLSLDVCTGGELAVALHADFPPERITFHGNNKSVAELTAAVKAGVGHVVLDSMTEIERLDAIAADAGIVQDVFVRLTVGVEAHTHEFISTAHEDQKFGLSVASGAALAAVGRVFDTEHLRLVGLHSHIGSQIFDVAGFELAARRVIGLLHDAVEQFGVEKTAQIATVDLGGGLGISYLAADDPPPMGELAGKLSAIVQHESAAVGLPTPRLVVEPGRAIAGPGTITLYEVGTVKDVDVSATAHRRYVSVDGGMSDNIRTALYDAQYDARLVSRVSDAPAELARVVGKHCESGDIVVRDTWVPGDLRPGDLIGVAATGAYCYSLSSRYNMVCRPAVVAVRDGRARLVLRRETVDDLLSLEVR

SEQ ID NO: 17197 - protein, 384 aa, Burkholderia vietnamiensis G4
MRSAITHRSKLPDVGTTIFTVIGQLAAQHDALNLSQGAPNFAPDPALIDGVARAMRDGHNQYAPMAGVVSLRERLAEKTEALYGARYDPGTEITVIASASEGLYGAISALVHPGDEVIYFEPAFDSYAPIVRMQHATPVAIKLSPEHFRVDWDEVAAAITPRTRMIVVNTPHNPTATVFRADDLERLAQLTRNTDIVVLSDEVYEHVVFDGAQHQSVARHRELAERSVIVSSFGKSFHVTGWRVGYCVAPAALMDEIRKVHQFMTFSADTPMQVAFAQMLARPESYLGLSAFYQAKRDLLARELAGSRLQLLPSEGSFFMLARFRHLSDERDSDFVLRVIRDVRVATIPLSAFYADGTDTGVIRLSFSKDDATLIEGARRLRSL

SEQ ID NO: 17198 - protein, 336 aa, Shewanella sp. ANA-3
MTIKIGINGFGRMGRLALRAAWGWNDVEFVQINDPAGDAPTLAHLLTFDSVHGRWQHEANSEGDDIIIDGKRIRCTRNKTIAETDWSACDVVIEASGKMKTKAVLQAYLDQGVKRVVVTAPVKEEGVLNIVMGVNHQLYDKAIHPIVTAASCTTNCLAPIVKVIHENLGIVHGSMTTIHDITNTQTILDAPHKDLRRARACGLSLIPTTTGSATAITHIFPELKGKLNGHAVRVPLANASLTDCVFEVSRKTTEAEVNRLLKEAAEGPLKGILGYEERPLVSVDYKTDPRSSIIDALSTMIINGTQVKLYAWYDNEWGYANRAAELARMVGLMDKA

SEQ ID NO: 17199 - protein, 296 aa, Thermotoga maritima MSB8
MRTLKELERELQPRQHLWYFEYYTGNNVGLFMKMNRVIYSGQSDIQRIDIFENPDLGVVFALDGITMTTEKDEFMYHEMLAHVPMFLHPNPKKVLIIGGGDGGTLREVLKHDSVEKAILCEVDGLVIEAARKYLKQTSCGFDDPRAEIVIANGAEYVRKFKNEFDVIIIDSTDPTAGQGGHLFTEEFYQACYDALKEDGVFSAETEDPFYDIGWFKLAYRRISKVFPITRVYLGFMTTYPSGMWSYTFASKGIDPIKDFDPEKVRKFNKELKYYNEEVHVASFALPNFVKKELGLM

SEQ ID NO: 17200 - protein, 216 aa, Magnaporthe grisea 70-15
MAQSGTGAYNNPLKKFKLVFLGEQSVGKTSLITRFMYDSFDGMYQATIGIDFLSKASKPPAHPHRSSESTVRLQLWDTAGQERFRSLIPSYIRDSSVAVVVYDISNAKSFQNTRKWIDDVRAERGNDVIIVLVGNKTDLNDKREVTTQQGEEEAKKNNLMFIETSAKVGHNVQPLFKRIARSLPGMEGTEAAQQAASQMIDVKTNNTQAQQEGCAC

SEQ ID NO: 17201 - protein, 383 aa, Bacteroides thetaiotaomicron VPI-5482
MKHTNPQVEQMTSFIVMDVLERANELQKQGVDVIHLEVGEPDFDVPACVAEAAKAAYDRHLTHYTHSLGDPELRREIAAFYQREYGVTVDPDCIVVTSGSSPSILLVLMLLCNSDSEVILSNPGYACYRNFVLAAQAKPVLVPLSEENGLQYDIEAIRKCVTPHTAGIFINSPMNPTGMLLDESFLRSVASLGVPIISDEIYHGLVYEGRAHSILEYTDKAFVLNGFSKRFAMTGLRLGYLIAPKSCMRSLQKLQQNLFICASSIAQQAGIAALRQADSDVERMKQIYDERRRYMISRLREMGFEIKVEPQGAFYIFADARKFTTDSYRFAFDVLENAHVGITPGIDFGTGGEGYVRFSYANSLESIREGLDRISQYLSRCGF

SEQ ID NO: 17202 - protein, 1533 aa, Magnaporthe grisea 70-15
MAAAPGSISTPEEAVARIAYISSDVVISVQPSLATETDFSRYLKSAAARKEPSLVAKNPNNVPEIQSVRHNADPLLSVFTPIRSGRFVSVTTTSNILLPSIAHLYKLAEYPVVIHVALHPDRFPDFSSITAIRNSGWTFLQSESIQEAQDMAMTAHALAIRSGKGVIHFYSPWVLSNDEPVEREGLAVIREILDIDSVRRYQSAPISASGLYADDGRTVLASDQPEQVPSGAASAPLNGLSSGAISHATSQANSSQVSVKSSENSTSATPHSTSSATTIEAPPTAVSSDDIYKYVTSIWAQLESLSGRKYSPFEYSGPPTPENCLFVFGADAGLLGSAIDEAKSGDVYAKAGILTPRLYRPWLGAKLLEAIPKSVKKIAVLEQISKRTTKWGPILIDVLTSVKSGPGGVETIVGYHVGYINNETVKQALRGICQNLALDKPVQNLEVGSREGPQKADKYALEKPKLETAYTKILDQLFGTRLYTANAIDSDNAGISATISATPEFGFGALLARKEHRHRFVSEAKEAATSGVFLTEKPKRLLTNWAIHSDDPKKIDAAAEDLISELTLENSTAARKLLKNQAFFRRQSLWLVGSDAWAYDLGNSGVHHVLASGENVNMLIIDSQPYSEHTAADANKRKKDIGLYAMNFGNAYVASVAAYSSYTQVLQAMDEADKFNGPSIVLAYLPYNGEHDSPLTVLQETKKAVDLGYWPLYRWNPDNEKQGLPTFSLDSERIKKELKAFLDRDNHLTQLMKKEPSFGASLAQDFGTEVRAQQKRRARDAYNQLLEGLFGAPLTILFGSDNGNAQSLAKRLGNRGRQRGLKTTVMAMEDYPVEDLPTEENIVILTSTAGQGEFPQNGKPFWDAIKDSTELDLASVRFSVFALGDSHYWPRKEDKIYYNKPGKDLDRVLANFGAQRLAEIGLGDDQDPDGYQTGYAEWEPKIWQALGVDNVEGLPEEPAPITNEDIKLASNYLRGTIVEGLNDNSTGAISAADGQLTKFHGTYMQDDRDVRDERKAQGLEPAYSFMIRCRLPGGVSTPQQWVQMDDIATKLGNETMKLTTRQTFQFHGVVKGKLKPAMQAINRALMTTIAACGDVNRNVMCSSLPTQSEYHREVYACSQKISDHLLPSTTAYHEIWLTDDNDKKTMVAGDAVQDFEPLYGPTYLPRKFKITIAIPPHNDTDVYAHDIGLIAIKGKDGHLEGFNLLAGGGMGATHNNKKTYPQTGRSFGYVSKDQVHIACEKVMLVQRDHGDRKNRKHARLKYTIDDMGVDVFRGKVEELWGQKFEEARPFHFDSNIDTFGWQRDEKGLNHFTLFIENGRIEDTAEFQMKTGLREIAKVHKGEFRLTGNQHVILSNVADEDLDNMKALLKKYKLDNIQFSGLRLSSSACVAFPTCGLAMAESERYLPVLIDKLEACLEENGLKQDSIVMRMTGCPNGCARPWLAEVAFVGKAYGAYNMYLGGGYHGQRLNKLYRSSIKEDEILAIMKPLLKRYALEREEGERFGDFCIRAGVIKATTDGQNFHNDVAEEESDEE

SEQ ID NO: 17203 - protein, 504 aa, Silicibacter pomeroyi DSS-3
MKDIVMTAETVMQQLGLGAADLTGGSIRVTSPIDGRVLGEVHETPLSEMAAVLDRAKSAFKIWRSVPAPRRGELIRLLGEELRASKEALGALVSWEAGKITSEGLGEVQEMIDICDFAVGLSRQLYGLTIASERPGHRMMETWHPAGPVGVISAFNFPVAVWSWNAALAIVCGDPVIWKPSEKTPLTALACQKIFERALARFGDAPDGLLQTLIGGADLGRTLVESEDVPIISATGSTRMGRAVAPIVAARFGKCILELGGNNAMIVGPSADLEMAVRAIVFSAVGTAGQRCTTLRRLIAHNSIKDELVARLKKAYAGLPIGNPLAEGTLIGPLVDEASGNAMTDALKSAKAEGGMVFGGARVSEGVPAGGVYMQPAIVEMPAQSATVKTETFAPILYVMGYDSFEEAVHIQNDVPQGLSSCVFTLNMREAEQFLSASGSDCGIANVNIGPSGAEIGGAFGGEKETGGGRESGSDAWKAYMRRQTNTVNYSAELPLAQGVKFDI

SEQ ID NO: 17204 - protein, 490 aa, Triticum aestivum
  misc_feature (245)..(245): Xaa can be any naturally occurring amino acid
  unsure (1)..(490): unsure at all Xaa locations
MAAAAKLTRSFSRQLSSGAARVWRQLSLEPHTPRRGAAAATGAVAAAGPTRFGLARQSSLDPTPAPDDGAVLAMPENLDATMRLLYAACQGDAAGVEELLREGVDVDSIDFDGRTALHIAACEGRGEVVRLLLGWKANINARDRWGSTPAADAKHYGHFEVYNLLRARGAKLPKTKKTPMTVSNPKEVPEYELNPLELEFRRGEEVTKGYYVAKWYGSKVFVKILDKDSFSDGDSISVVISTQRXFKHELTLLEKARHPNLVQFVGAVTQNVPLMIVSEYHQKGDLASYLETKGRVQSYKAIRFALDIARGLNYLHECKPEPIIHGDLSPKNIVRDDEGKLKVAGFGSLDLTKVSQDKLQMVQPVSNFDSVYIAPEMYRNEAFDRSVDTFAFGLILYEMIEGSPAFHPKPQEEAAKMICSEGLRPLFKNKPKSYPEGVKELIQECWDPTPSVRPTFSDIIERLNKISASCSKQTRWRDNFKLPWKQAVHK

SEQ ID NO: 17205 - protein, 207 aa, Zea mays
  misc_feature (46)..(46): Xaa can be any naturally occurring amino acid
  misc_feature (77)..(77): Xaa can be any naturally occurring amino acid
  misc_feature (106)..(106): Xaa can be any naturally occurring amino acid
  unsure (1)..(207): unsure at all Xaa locations
KRLKNFNDKEDLLLVSAWLNISTDPIEGRNQKRSAYWARIYDFFHXRTKEIILDRSQNSLMRRWFTIQESVNKFCGXRIEGRNESGKTFENKVIHYVLNLDNRSFXFIHCWNILRNEPKWNDKLNQLAANKSCSLETREPRTYFLALDLTTNFNGENGTLVNNENACPEGDATKRPNGRKKAKQMLSHGGGDSCIETVDHLWEKKKG

SEQ ID NO: 17206 - protein, 325 aa, Arabidopsis thaliana
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFVGALLNQIVDDRSVLEDEERLRKVLRFANACGAITTTKKGAIPALPSDAEVRSFLEKK

SEQ ID NO: 17207 - protein, 326 aa, Bacillus halodurans C-125
MKTVKFPAQMTEKKLVDLFKQMWLIRYFEEKVDEFFAKGMIHGTTHLAVGQEASAVGSIAVLEERDKLTSTHRGHGHCIAKGADVNRMMAELFGRETGYCKGKGGSMHIADVERGNLGANGIVGGGFSIATGAALTSKMKKEGYVVLCFFGDGASNEGSFHEAVNLASIWKLPVVFICENNQYGMSGSVKEMINIEHISDRAAGYGIPGMVVDGNDVFAVMNVVGRAVDRARRGEGPTIVEAKTYRWKGHSKSDAKKYRTREEEKEWREKDPIARLRATLVKEGIVTEEEADSIQEEAKQKIEDSVQFARNSPEPEIESLLEDVYA

SEQ ID NO: 17208 - protein, 404 aa, Sinorhizobium meliloti 1021
MAKKKVAMLTAGGLAPCLSSAVGGLIERYTDIAPDYELVAYRSGYQGLLLADRIEITPAMREKAHVLHRHGGSPIGNSRVKLTNTADCVKRGLVKEGENPLRVAAERLASDGISILHTIGGDDTNTTAADLAAYLGANGYDLTVVGLPKTVDNDVVPIRQTLGAWTAAEYGARFFDHVSNEQSAAPRTLVVHEVMGRHCGWLTAATARAYIHLAGNKEYVDGFMMNAQLKNIDGLYLPEMAFDLEAEAARLREVMDRAGFVTLFVSEGACLDAIVAEREAAGETVKRDAFGHVKIDTINVGNWFSKQFAALLGAERSMVQKSGYYARSAPANVDDLRLIQSMVDLAVESALNKVSGVTGHDEDQGGRLRTIEFPRIKGGKHFDTSAKWFGEVMDVVGQKWQTAD

SEQ ID NO: 17209 - protein, 419 aa, Burkholderia xenovorans LB400
MRLHGFLIGQTETLLAEVLKLNGPADATTSRFFRAHPKLGHGERGVIAEAVFAVLRRRMEFAHLAEGGAGSPARRMALLGLMQTAGRNALKPFVSEQELSWLEHVSKIDPESLPLRIRLNLPDWIYQALSKRFEPDELAQLAAALNYPAPLDLRTNPIKASRDDVLNALSKAGIEAGATPFAPFGVRVVGKPPLTKLDAFQHGWVEVQDEGSQLLCSLVAPKRGEMIVDFCAGAGGKTLALGAAMRSTGRLYAFDVSERRLAKLKPRLARSGLSNVNPVLIDSEHDSKIKRLAGKIDRVLVDAPCSGLGTLRRNPDLKWRQSPESVAELAPKQASILASAARLVKKGGRLVYATCSILEAENEAVVEQFLAGHPDFALVPARDVLAEQRIDLEMGDYLSLWPHRHATDGFFAAVLERQS

SEQ ID NO: 17210 - protein, 354 aa, Bacillus cereus ATCC 14579
MEKRIVCLAGDGVGPEVMESAKEVLHMVERLYGHHFHLQDEYFGGVAIDLTGQPLPQRTLAACLASDAVLLGAVGGPRWDSAKERPEKGLLALRKGLGVFANVRPVTVESATAHLSPLKNADEIDFVVVRELTGGIYFSYPKERTEEVATDTLTYHRHEIERIVSYAFQLANKRKKKVTSIDKANVLESSKLWRTVTEEVALRYPNVEVEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGYAIEEAVSAVLKSGKCTADIGGTETTTSFTKAVIQEMEEQALVGRGR

SEQ ID NO: 17211 - protein, 228 aa, Oryza sativa
MAMATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIINISSIASVVAFCSLPNAVYSAAKGQNKQPLLSWTYFKNIFYLKRIYNGVCSSIPASRFFHDNLYLAFDICSTKCLLEN

SEQ ID NO: 17212 - protein, 194 aa, Bacillus cereus ATCC 14579
MRQSSQARETTETKIKLNLQLDESTNVSIQTGVGFFDHMLTLFARHGRFGLQVEAEGDVFVDAHHTVEDVGIVLGNCLKEALQNKEGINRYGSAYVPMDESLGFVAIDISGRSYCVFQGELTNPKLGDFDTELTEEFFRAVAHAANITLHARVLYGSNTHHKIEALFKAFGRALREAVEKNANITGVNSTKGML

SEQ ID NO: 17213 - protein, 926 aa, Triticum aestivum
  misc_feature (825)..(825): Xaa can be any naturally occurring amino acid
  unsure (1)..(926): unsure at all Xaa locations
NKFAQKSRLVPVRNSRDIAAGRAGRGEEEGVVEAPAPPPAAAGVCAVCFRPTTFRCKQCKAVKYCSFKCQISHWRKGHKDECHPPSANAKPDDGAAISVAKEGNVEHRRASEENVVAGVQPVAEISVPVAAESETSGTNHVVKSSNDKRKDTPFEEVSATTEIPEKGNSDNVVKLGQITPQVASFDSKRAESNTKSTNFVGNSSYVKDLDDILVHKSQASAPKMSGLTSSIHEDIYVHCKDHGNAEDADVSKDCSRINHIRKPADRSYSQMAATAVPAPKSSRTSLRVEVEPCKIKATGEEKSQGLKLVTPVLAVDKVSSIHGGRSVAPNPSRRADNPTDRGGSAANNLATSLKKIVRQQTTPKVVRHYPSELTLFPYDVFIKLYDKVELRPFGLHNLGNSCYANVVLQCLMFTRPLTTYLLGGLHSKNCSKKAWCFMCEFERLIVEGKQGKTALSPTGILSHLHEIGSSFGPGKQEDAHEFLRHSIDAMQSVCIKEARKGGAHCLAEETTLVQLIFGGYLRSKIKCTRCHISSEQYERMLDLTVEIDGDISSLEEALQRFTSTEVLDGDNRYQCSRCNSYERAKKKLTISEAPNVLTIALKRYQSGKFGKISKAIRFPETLNLSCYMNSTDDNSPVYSLYGMVVHHDVMNAAFSGHYVCYVKDTHGKWYKIDDSQVKPVSLENVMSKCAYMLLYARCSPRAPNSVRHAMMVNDPSYAKKAKHKPNLEQTPLQRGSLNRHQGGELHSDHITDNLTRRFDEFGDAPYPAAESPSPSESSSLFSNSDAGSHSTVSTDSSESTRNSTSTDDYEQYFFGSSDQMYLGGXRGAHEEIGYMSYSRSRSALGTSSSGQEVDEERSVEQRFEVSRGGWLEGGESSPLSYTDQSKQHLLTEQYRQFGGSEHDPGEARGSVLLRRSAREKTAQTFY

SEQ ID NO: 17214 - protein, 395 aa, Rhodococcus sp. RHA1
MTQQEWIERDFYADLGVPSTASAEDIKRAYRKLARQLHPDANPHDQAAGERFKAVSEAHAALSDPATRAEYDRTRQLYRSGAFRRAGTRSGAGGGGPAGGMGGFDLSDLFGGGSSSFTSGEAGFGDVFGDLFRRSGTRTTASRPRRGSDVEAQTRLPFRQAVTGVVLPLQVSGPTVCTSCHGSGARPGTQPRRCPSCGGAGTLTRNQGGFGFSESCDDCRGTGVIVDSPCTDCQGTGVGHRTRTINVRIPPGVTDGQRIRLPAHGEPGLRGAPSGDLYVTVGVDPDPVFGRDGDDLTVTVPVGFAELALGTTISVPTLDGRVSVKIPAGTPSGRTFRLQGRGVPLRGRAPGDLRVTVQVAVPAGLNQRAIDALRAYEKAEKAAGFDPRTTWPGRR

SEQ ID NO: 17215 - protein, 306 aa, Zea mays
MAENFQLQGRHGKSRVRVSRVWRRPAAAGGDVIVEWNVAVSIVSDCLPSYTSSDNSAIVATDSIKNTVYVKAKECTEVVSMEEFAVILGRHFTSLYPQVSEATVTIVERPWERVTVDGKPHSHGFKVGVEKHSTEVIVKKSGSLLINSGIQGYSLLKTTQSGFEGFVTDRYRLLPDTRERIVATEVTAWWRYPFEHVSQLPSKPFCFTQRYQDVKKVLAETFFGPPDVGVYSPSVQNTLYLMAKEVLTRFPDISSVQLRMPNLHFLPVNLGTKEAPLVKFADDVYLPTDEPHGTIEATLSRPMSKL

SEQ ID NO: 17216 - protein, 297 aa, Thermus thermophilus HB8
MEGGMEKGTFQIKTGFAEMFKGGVIMDVTTPEQAVIAEEAGAVAVMALERVPADIRAQGGVARMSDPKIIKEIMAAVSIPVMAKVRIGHFVEAMILEAIGVDFIDESEVLTPADEEHHIDKWKFKVPFVCGARNLGEALRRIAEGAAMIRTKGEAGTGNVVEAVRHARTMWKEIRYVQSLREDELMAYAKEIGAPFELVKWVHDHGRLPVVNFAAGGIATPADAALMMHLGMDGVFVGSGIFKSGDPRKRARAIVRAVAHYNDPEVLAEVSEDLGEPMVGINLDQLKEEERLAKRGW

SEQ ID NO: 17217 - protein, 693 aa, Oryza sativa (japonica cultivar-group)
MATAAEDGCCGGGARQRQSEVEAKMAMLGDGGGGDAAQRMDGGQIRVPDNMESGSGRRRPGGGASQRRRSATVGTEAEMAARLADGDGARRRRRDGHGAHPEFYCILCSSLISFTRGAGDVNLFKQHQALLYFDYERLYKMCMMGLTFLLVLKNRASGLIFDHVIFDIKSCLFGRSVMIKQILGRLPKKEKPGKSGEKDLAGVGSSLPDARTTTDLTMSSRIANPNNYTAAVTNPGQNYTVKNAHHGGAGVSNGFLAPPVFEALPSLRDAPAPEKPSLFLRKVVMCYVVFDFTDPTKDVKEKEIKRQTLLELVDYVTSATGKFPEPAVQEVIKMVSTNLFRVPNPAPRENKPLESFDMEEEEPVMDPAWPHLQIVYELFLRFVQSPETDAKLAKRYVDHGFIIKLLDLFDSEDPREREYLKTILHRIYGKFMVHRPFIRKAINNIFYRFIFETEKHNGIAELLEILGSIINGFALPLKEEHKLFLVRALIPLHKPKCVSMYHQQLSYCVTQFVEKDCKLADTVIRGLLKYWPITNSAKEVMFLGELEEVLEATQPAEFQRCMVSLFCQIARCLNSSHFQVAERALFLWNNDHIEVLIKQNSKVILPIILPAIERNTKEHWNQAVQSLSLNVRKIFMDHDPVLFEECLKKFEEDEAKETALRSKREATWKRLEEIASSKTISSEPAVPPEATVH

SEQ ID NO: 17218 - protein, 551 aa, Paracoccidioides brasiliensis
MSAGAPSIPKVALLPARLLHTSRHCSTQCAVIRPQIQPKFFQNDCRAYHDRRPRIEPLNDRSRHPFCKAFHASSPSQATRDPYRVLGVGKNASAAEIKRAYYGLAKKYHPDTNKDANAKEKFAEAQSAYELLSDAEKRQAYDRYGSAAFDQNGGFNPGAHDGTGGPFSGAATGGFHGFGGGFPGGGFSANINFEDLFGAFAGGSGRRGRSKGGPFRSTVVEGDDIEVQTNISFMDAAKGTTKEVFITPLVQCRTCDGEGTKQGTKRAQCKTCNGTGSQVHFIQSGFHMESTCSSCGGAGVSIPRGSECNICGGDGVIRERKTVHVNIPGGVEDGMRLRVPGEGDMPPVEPGAQMRRGDLYVFIKVAPDSRFSRSGSDVLYTAQIPLTTALLGGEVTVPTLDNEVKVKVATGTGTGDKITLSGMGMRKLEGRRGQQGDLKIEFKVAMPKYLTANQRTILEVLADEMGDDTARRMMNVHKYDKPSSPGSSSSGKKDSSNSSTASSDSHKNEGFLKSAWHKLMQHNNGNKDTGSDGNTSDGNKTDESKKASGSG

SEQ ID NO: 17219 - protein, 327 aa, Bacillus halodurans C-125
MREITYLEAIREAMTLEMRKNEDVFILGEDIGVYGGAFGVTRGMIEEFGSERVRNTPISEAAISGTAIGAALTGMRPILELQFSDFITIAMDNMVNQAAKLRYMYGGKAKVPMVLRTPAGSGTGAAAQHSQSLEAWMTHIPGLKVVQPATAYDAKGLLKAAIDDNNPVIFYEHKLCYRTKCHVPEEEYSIPLGKADVKRKGTDVTVVATAVMVHKALEAAVELEKEGISVEVIDPRTLVPLDEETIIRSVKKTSRLIVVHEAVKRGGFGGEIASIIAESEAFDYLDAPIKRLGGKPVPIPYNPTLERAAIPQVPDIIEAVKETLNWS

SEQ ID NO: 17220 - protein, 436 aa, Bacillus halodurans C-125
MAKEIFMPKLSSTMQEGTLLQWFKEEGDRVEVGEPLFEIMTDKINIEVEAYEEGTLLKRYYGEDDEIPVNHVIGYIGTPDESVPTEPPGASEITASSTDEAGDHRTTAVKKAPSSDRENVRATPAARRIAKEKRIDLRQVEGSGPEGRVQAVDVATFKKKGQKATPLAKKVAEVKGVALEKVQGSGPYGKVYREDVEHAQAASPVEDKGNRVKLSGLRKVVAKRMVDSAFSAPHVTITTEIDMSSTIKIRSQLLGMIEQETGYRLSYTEIVMKAVAHALMSHPTINASFFENEIVYHEDVHIGLAVAVEGGLVVPVVKHVDKKGLAQLTNECKTVAMAARDNRLSQEMMSGGTFTISNLGMYAIDVFTPVINQPESAILGVGRIQEKPVGIDGQIELRPMMTASLSFDHRVIDGAPAAAFLTDVKSMLEQPFQLLM

SEQ ID NO: 17221 - protein, 462 aa, Bacillus halodurans C-125
MKSYDIVVIGGGPGGYVAAIKAAKLGKKVALVEAKDLGGTCLNRGCIPSKTLLHQGEIIEKIKQAKEWGIETGAVTLSLPKMLARKNEIIQKLRAGIHFLLKQGKIDVYFGYGEIERDRSVKIKMKETAEIVSVRTENMIVATGTEPTIPPVPGLAEAVVDTSDTIFELDSIPQSIVIIGGGVIGVEIACIFSSLQVDVTIVEMGKRILPQEDEEAAKVLAKALAAKGVHLLTNTKVTAVLQGDKQKVEIETSTGDRDWLEGERILLAVGRTPNLSVVKELGLGMAGPFLKVDDQMRTSDPSIYAIGDVIGGWQLAHVASAEGLVAAANASGKVEIINRQVIPRCIYTQPEIASVGLTEQEAKEKGYSYKVVKVDLRANGKAMALGETTGFVKMIADPNYGEILGVTMVGPHVTEMIGEPAAFIHLEGTVDELKAMIHPHPTVSEALYEAAASWLGQGVHQP

SEQ ID NO: 17222 - protein, 140 aa, Sulfitobacter sp. EE-36
MALERTFSIIKPDATRRNLTGKINAKFEEAGLRIVAQKRIHMTKAQAGVFYAVHAERPFYDELCEFMASEPVVVQVLEGEGAIAKNREVMGATNPADAAEGTIRAEFAESVGENSVHGSDAPETAAVEIAYFFSGLELVG

SEQ ID NO: 17223 - protein, 209 aa, Arabidopsis thaliana
MEAYDICKFWKLDMLEEFSQIVLKGKKKIILDIPSPSQQNKSDIVSLCPADSPETCNSSIPDWLVKVMRKENGYDPKLIIKRRVLCTTDLRKNQGCLSMHLSKLEKSDFLTEDETRFLDEDFLKAKRDGLKVFLVDPESDKHVVYLKKWNGNTVWKYVLSHGWNNVIDKKIFKVNDVIEIWSFRDGSGKLCFALSSPTRCGRSSSGHSS

SEQ ID NO: 17224 - protein, 451 aa, Bacillus halodurans C-125
MTSNDLLAKSKKHLWLPFTQMSDYEKDPLIIESGNGVYLKDIEGNTYLDGYSSLWLNVHGHRKKEIDEAIEKQLQLIAHSTLLGAANIPSIQLAEKLVELAPEAITRVFYSDSGAEAVEIAVKMAYQYWQNRGYENKKSFVTLSNGYHGDTVGTMSVGSIELYHKVYTSLLFDAIVIPFPASKEEQTESDLCRESLKQLRELFEAKHEEIAGITVEALIQGAGGMNLMPKGYLKGVEQLCKEFHILLIVDEVATGFGRTGKMFAVEHENVQPDIMTVAKGITGGYLPIAATLTQEHIYEAFYGEYTDLKTFFHGHSYTGNQLGCAAALANLEIFEKENIIQQVEEKALFLEEQLKHVAELEFVGAVRQLGLMCGIQLVQHKRTSEPFPWEQRVAYRSTLKMRALGMLTRPLGDVIVLMPPLAATNDQLKQMVDIMKEGIMEAATECLEQQV

SEQ ID NO: 17225 - protein, 386 aa, Aspergillus nidulans FGSC A4
MATATVLEKPNIGVFTNPKHDLWVAESKPTLEEVKSGESLKPGEVTIEVRSTGICGSDVHFWHAGCIGPMIVTGDHILGHESAGDVIAVAPDVTSLKVGDRVAIEPNVICNACEPCLTGRYNGCEKVAFLSTPPVDGLLRRYVNHPAVWCHKIGDMSYEDGALLEPLSVSLAAVERSGLRLGDPCLITGAGPIGLITLLSARAAGATPLVITDIDEGRLKFAKELVPEVRTYKVEIGFSAEETAEGIINAFNDGQGAGPDALRPRIALECTGVESSVASAIWSVKFGGKVFVIGVGKNEMKIPFMRLSTQEIDLQYQYRYCNTWPRAIRLVKNGVINLQKLVTHRYALEDALKAFETAANPKTGAIKVQIMSSTADVEAASAGQKN

SEQ ID NO: 17226 - protein, 322 aa, Zea mays
MSGHGDTATSAKMAKLKELLQKSENHICADCGASDPKWASANIGVFICVKCSGVHRSLGTHISKVLSVTLDKWSDSEVDSMIEVGGNSQANAVYEAFIPEGYQKPHSDSTQEEREKFIRSKYELQEFLKPSLRIVSHQPSDSGKHAGNASHSDGSKSQVGMIEFIGILNVKVIGGTNLAIRDMSSSDPYVVLTLGQQKAQTSVINGNLNPVWNEELKLSVPQQYGPLKLQVFDHDMVSKDDLMGEAEIDLQTMINAAAAFGDPELLGDIQIGRWLKSEDNALVRDSAVVVSGGKVKQGMALKLQHTESGELELEMEWMPLNV

SEQ ID NO: 17227 - protein, 101 aa, Bacillus cereus ATCC 14579
MKPNFSKGLIPAIVIEEGTKDVLMLAYMNEEAYKKTLETKRTWFYSRSRQSLWNKGETSGNVQYVQSLYLDCDQDSIVVNVKQVGPACHTGEKTCFYYQII

SEQ ID NO: 17228 - protein, 478 aa, Saccharomyces cerevisiae
TINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 17229 - protein, 107 aa, Bacillus cereus ATCC 14579
MENAFKLLYKTIEERKGSPLPESYTNYLFSKGEDKILKKIGEECAEVIIACKNNDKEEVVKEMVDVFYHCFVLLAEKNIALEDVMREVKERNGKLSRVGDRREIDTL

SEQ ID NO: 17230 - protein, 380 aa, Oryza sativa (indica cultivar-group)
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPALLTEAPLNPKANREKMTQIMFESFNVPAMYVAIQAVLSLYASGRTTGIVLDSGDGVSHTVPIYEGYALPHAILRLDLAGRDLTDALMKILTERGYSFTTTAEREIVRDIKEKLAYVALDYEQELNAAAAAKNSSSVEKSYELPDGQVITIGAERFRCPEVLFQPSLVGMEAAGIHETTYNSIMKCDVDIRKDLYGNVVLSGGSTMFPGIADRMSKEITALAPSSMKIKVVAPPERKYSVWIGGSILASLSTFQQMWISKAEYDESGPAIVHRKCF

SEQ ID NO: 17231 - protein, 438 aa, Bacillus cereus ATCC 14579
MYLHGTSRINGQGHLEIGGCDTTQLAKQYGTPLYVYDEGSIRGKCRAFHRAFKESGFSYQVAYASKAFLCMEMCRVAREENMSLDVVSGGELYTALQAGFPASRIHFHGNNKTEEEIVMALQANIGCFVVDNFFELEVLHDLAMQHGKFVNILIRVTPGVEAHTHEYITTGQDDSKFGFGVSNGQAMQAIGLALQKSNYNVLGIHSHIGSQIFETAGFVRAIEVLRQFLEEVREQTNYVVKVLNVGGGFGIRYTESDTPLTLETYVRAVTSAVREQFTVCEYPLPEIWIEPGRSIVGDAGTTIYTVGSVKDIPGIRKYVSVDGGMTDNLRPALYNARYEAMLANRANDENEELVSIAGKCCESGDMLIWDIHLPKVAASDLLAVSCTGAYGYSMANNYNRIRRPAVVFAKGGTSQVVVERETYENIIGNDRIRIKELV

SEQ ID NO: 17232 - protein, 584 aa, Photobacterium sp. SKA34
MKSDIDICRDTLLSPIEDIAKKAGIQPQELTPQGSLKAKIKPAILNRLADQEEGKLVVVTAITPTPLGEGKTVTTIGLAQGLAKIDRSVMACIRQPSMGPVFGVKGGAAGGGYSQVAPMDKLNLHLTGDIHAVTAAHNLAAAAIDARLYHESRLGYDLFSEKTGLPALRIDINNITWKRVMDHNDRALRMVTIGQNEPDKTINGLERHDGFDITAASELMAILALSGDLHDMRKRIGRIVVAYDLDGNPITTEDLQVAGAMTVTLCDAIEPTLMQTLEGVPTLIHAGPFANIAHGNSSIIADKIALKLSDFTITEGGFGSDMGFEKACNIKAQQAKRGPDCAVVVATLRGLKANSGLYDIRPGQGLPDGILAEDHDALVAGFENLKWHISNAARYGVPVVVAINRFPQDTDAELEQLQAMIKAESFQTYVDVAISEAFNKGGEGTIKLAECVVKASQHKANFTPLYQLNQPLEEKIMAVAEVGYGASHVELSEVAQQQLVKFKALGFDELAICMAKTPLSISTDPSIKGAPKGFTVPVRELKLCAGAGFIYALCGNVMTMPGLPEKPAFMNLDIDESGNIIGLS

SEQ ID NO: 17233 - protein, 91 aa, Glycine max
MLSATAIGALLGLGTQMYSNALRKLPYMRHPWEHVVGMGLGAVFVNQLLKWEAQVEQDLDKMLEKAKAANERRYIGSPFLFNPNYVTKDAA

SEQ ID NO: 17234 - protein, 526 aa, Candida maltosa
MTSDSTIHELIQSYITKWYVIVPLAIIIYKVFDYFYVLSLRKRLGAAVPTNEETDGYFGFHLPFVLMSKKKDGTIIDFSIERYPELKHPETPTFEFPIFTVKLISTIDPENIKAILATQFSDFSLGTRHAHFAPLIGDGIFTLDGAGWKHSRAMLRPQFAREQVGHVKLLEPHVQVLFKHIRKNKGREFDLQELFFRFTVDSATEFLFGESVESLRDASIGMTSKSKDVDGIEDFTGAFNYSQNYLASRSIMQQFYWILNGKKFRECNAIVHKFADHYVQKALNLTEADLEKQAGYVFLYELVKQTRDPQVLRDQLLNILVAGRDTTAGLLSFVFFELARNPDVVAKLKDEIDTKFGLGEDARIEEITFESLKQCEYLKAVLNECLRLYPSVPQNFRVATKNTTLPRGGGKDGLSPILVRKGQTVMYSVYATHRMESVYGKDATTFRPERWFEPETRKLGWAFVPFNGGPRICLGQQFALTEASYVTVRLLQEFSTLTLDPNLEYPPKKMSHLTMSLFDGTNVQMY

SEQ ID NO: 17235 - protein, 538 aa, Candida maltosa
MPVSFVHNVLEVVTPYVEYYQENLTKWYILIPTILLTLNFLSILHTKYLEYKFNAKPLTNFAQDYSFGVITPLMLMYFKWHGTVMEFACNVWNNKFLVLNGNVRTVGLRIMGLNIIETTDPENVKAILATQFNDFSLGTRHDFLYSLLGDGIFTLDGAGWKHSRAMLRPQFAREQVAHVKLLEPHVQVLFKHVRKSQGKTFDIQELFFRLTVDSSTEFLFGGSVESLRDASIGMTPSTKNIAGREEFADAFNYSQTYNAYRFLLQQFYWILNGSKFNKSIKTVHKFADFYVQKALSLTEADLEKQEGYVFLYELAKQTRDPKVLRDQLLNILVAGRDTTAGLLSFLFFELSRNPTVFEKLKEEIHNRFGAKEDARVEEITFESLKLCEYLKACVNEALRVYPSVPHNFRVATRNTTLPRGGGKDGMSPIAIKKGQNVMYTILATHRDPNIYGEDANVFRPERWFEPETRKLGWAYVPFNGGPRICLGQQFALTEASYVTVRLLQEFHTLTQDADTRYPPRLQNSLTLSLCDGANIQMY

SEQ ID NO: 17236 - protein, 800 aa, Staphylococcus epidermidis ATCC 12228
MLISNEWLKDYVNVDQSVQALAERITRTGIEVDDIIDYTKDIKKLVVGHVLSKTPHPNADKLNICQVDLGEEEPVQIVCGAPNVDEGQHVIVAKVGGRLPGGIKIKRAKLRGERSEGMICSLQEIGISSHVTPKNYESGIYVFPEAVKPGTDALEAIYLNDQVMEFDLTPNRADALSMVGTAYEVAALYQTKMNKPQLTSNESQESAKDELTIEVKNEDKVPYYSTRVVHDVTIGPSPVWMQFRLIKAGIRPINNVVDISNYVLLEYGQPLHMFDQEQIGSQSIEVRQAKKDETMRTLDGEERRLLDTDIVITNGKDPIALGGVMGGDFSEVTEQTRHVVVEGAIFDPVSIRHTSRRLNLRSESSSRFEKGIATEFVDEAVDRACYLLERYASGTVLKDRVSHGDLGSFVTPIEITADKVNRTIGFNLTDEEIIDIFEQLGFDTENKNGEITVNVPSRRKDISIKEDLIEEVARIYGYDEIPSTLPVFKDVTSGELTDRQFKTRTVKETLEGAGLDQAITYSLVSKNHATDFALQNRPTIELLMPMSEAHSTLRQSLLPHLIDAVSYNVARKNTNVKLYEIGRVFFGNGEGELPDEVEYLSGILTGDFVNNTWQGKKESVDFYLTKGVVERIAEKLNLQFDFRAGQIDGLHPGRTAIVSLNGKDIGFIGELHPTLAANNDLKRTYVFELNYDAMMEVSVGYINYEPIPRFPGVTRDIALEVNHEVTSSELLSIIHENGEDILNDTLVFDVYEGEHLEKGKKSIAIRLSYLDTENTLTDERVNAVHDKILEALKKHGAIIR

SEQ ID NO: 17237 - protein, 534 aa, Saccharophagus degradans 2-40
MRRLARLTRIIHTFCRYRLDALLKDVEVKSRYKLLLFPFWFYPKPDISRGRALRNSLEELGPIFIKFGQLLSTRPDLIPDDIIEELNYLQDRVAPFSNEEFKRIVEQALGNNTNALFKEFSEKPLASASVAQVHTATLHTGEDVVVKVVRPNIEKIIQKDVALLELLARTIEKLSPEGRRFKLSEVVADYKDTIFDELDLKREAANASQLRRNFEGSPLLYVPAVHWQYCTNKVMVMERIYGIPVTDMEKINAQSTNLKLLAERGVEVFFKQVFEHNFFHADMHPGNVFVSPANPQNPSYMAVDMAIIGSLTKEDQYYLARNLLAMFRRDYRQVAELHVMSGWVPANTSISGFESAIRTVCEPIFERPLKDISFGESLVNLFRTARRYNMPVQPQLVLLQKTLLNIEGLGRQLYPDLNLWDTAHPYLEKWLKERYQVKTLFNNLKYHAPEWLEKFPEVPHLVFNALEKLNNQPANEHKQQISSATQRTNKALTWLGYGTLMAGLAITLATYTAIPQSAIVLIAAGATLLAVTKR

SEQ ID NO: 17238 - protein, 151 aa, Brassica napus
  misc_feature (138)..(138): Xaa can be any naturally occurring amino acid
  unsure (1)..(151): unsure at all Xaa locations
MGVVEDTEPPFKRAKLLLADEPNGKSSSIRATSSVNNSLGDLMARPLTSSSQGDDETIGSKGVIKKSEFVRIISRALYSLGYGKTGAMLEEESGIPMHQSVVKAFLQQVKEGKWDESVATLHRIGLVDEKAVKAASLXLLEQKCLELLKFE

SEQ ID NO: 17239 - protein, 463 aa, Pseudomonas putida GB-1
MNTVGSDGNLAQGFKPRHVTMLSIAGIIGAGLFVGSGHAIAAAGPATIISYFVAGTLVVLVMRMLGEMAVAHPDTGSFSTYADQAIGRWAGYTIGWLYWWFWVLVIPIEALAAGHVLNAWFPQVDSWIFALASVLLLAGTNLFSVAKYGEFEFWFAILKVTAILGFIGLGFAALMGWLPNREVSGLSGLMAEYGGFAPKGWSAVVGAFITVMFSFIGTEAVTIAASESSDPSRNIAKATRSVIWRISTFYILSIFVIISVVPWNDPQLAVVGSYQRALEIMNIPNAAFMVDLVVLVAVTSCMNSSIYIASRMMYSLAKRGDAPAFLNKTSKVGVPRAAVFGSTLIGAAIAVLNYFAPKGVFEFLLASSGAIALLVYMVIAISQLRMRRRLERENTELKFRMWLFPYLTWAVIIFIAGALAVMMYTPEHRAEVSSTLGLAIVISFLGIVTSRGHAQPVGARSMG

SEQ ID NO: 17240 - protein, 541 aa, Oenococcus oeni PSU-1
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLRWEPKY

SEQ ID NO: 17241 - protein, 653 aa, Medicago truncatula
MSFFATLNLLVVLVMLLILPYNNVHGDEQQDSCSTRCGDHNISHPFRLKDSPENCGDKRYILSCEDNNQLILYYGSFGKYYVQSINYNNFTIRLLDFNSHGYSNYSLPPHPLGFYSFDSRTINPIALPYRVFGDHYIDLFKSMLYVTCPKHVQYSSGIYFDAACMNISNSYEQQKGNYIVFGDKSLLELALGDECRIELMFLTSWDFKHGGNNNISCTDIHRMMFYGFELSWLNSLCKHGWYSDILDYNNQRRAPSETWSLQALVTVSILMYIGILLGFLSGVKFVLGVPIVLLIYKWRQKHLSVYDGIEDFLRSDNSIMPIRYSYKDIKKITEQFKIKLGNGGYGTVFKGKLRSDRLVAVKLLDKAKTNGQDFVNEVTTIGRIHHVNVVQLIGFCVEGSKRALIYEFMPNGSLEKYIFSLIEESNSLSCKKLYAISLGVARGIAYLHNGCNMKILHFDIKPHNILLDENFNPKVSDFGLARVSPTDKSIVSLTAARGTIGYMAPELFYRNVGTISHKADVYSFGMLLMEMASRRKNLNPLAEQSCQIYFPFWIYGQLHDGSEVTIENDTDEEMKLAKKMMIVALWCIQTKPGDRPSMDKVIEMLEEEDGDLQMPNKPYLYPQDLPAEDFRDGNTRSSWSSSDTSINDFMEPT

SEQ ID NO: 17242 - protein, 645 aa, Medicago truncatula
MPSLTLVVVLLILIFSYNVDGDVEHQESCSRRCGVHSISHPFRLKDSPEKCGDKRYILSCEDNNQLILYYEFEEYHGKYYVQSINYNNFTIRLLDFNLASSNNSIPSYYSLGLYNFSSNFFTSPYLAYHRYKNYTNHMLTKSMLYVSCPNRMEYSYIGNCMNRTSYSQDVNSFYVGGYGKSLLEFGLGDGCHIEFMYLTWDVEDDGNINNISCTDIRRRMYYGFELSWLNSRCKHGRYAVLDQYNQPHCKYDYWNNAAWIVARLSFGLGVLVGLLSGVKFVLGLPFIIVLLIKKWRKKHQSMYDGVEDFLSSDNSIIPIRYSYKEIKKITGNFMTKLGNGGYGSVFKGQLRSGRLVAVKLLDSAKSNDRDFVNEVATIGRIHHVNVVQLIGFCVEGSKRVLIYEFMPNGSLEKYIFSHTEENYSLSCEQLYSISLGVARGIEYLHNGCNMKILHFDIKPHNILLDENFNPKVSDFGLARLCPTDKSIVSLTAARGTIGYMAPELFYRNVGTISYKADVYSFGMLLMEMANRRKNLDVLAGQSSQVYFPFWVYDQLQDGREITIENATNHEMKLAKKMMIVALWCIQAKPSDRPPMDKVLEMLEEEDEDLQMPNQPDLDAQDVRDDRTGSSLYSSGTLVTDSKEPI

SEQ ID NO: 17243 - protein, 346 aa, Medicago truncatula
MYDGVEDFLSSDNSIIPIRYSYRDIKKITEQFKTKLGNGGYGSVFKGQLRSGRLVAVKLLDKAKSSDQDFVNEVATIGRIHHVNVVQLIGFCVEGSKRVLIYEFMPNGSLEKYIFSHTKENYSLSCEQLYSISLGVARGIEYLHHGCNMKILHFDIKPHNILLDENFNPKVSDFGLARLCPTDKSIVSLTAARGTIGYMAPELFYRNVGTISYKADVYSFGMLLMEMASRRKNLNALAEQSSQIYFPFWIYDKFHDGSEVTIENDTDQEMKLAKKMMIVALWCIQTKPDDRPSMDKVLEMLEEEDGDLQIPNKPYFCPQDSPIADVYSSNSWTSDGTSVSGSKGPN

SEQ ID NO: 17244 - protein, 490 aa, Pseudomonas fluorescens PfO-1
MARFELQKLYIDGAYSDAGSDATFEAINPANGEVLAHVQRATKEDVERAVVSAEKGQKIWAAMTAMERSRILRRAVDILRERNDELAALETLDTGKAFSETKYVDIVTGADVLEYYAGLVPAIEGEQIPLRDTSFVYTRREPLGVVAGIGAWNYPIQIALWKSAPALAAGNAMIFKPSEVTSLTTLKLAEIYTEAGVPNGVFNVLTGSGREVGTWLTEHPRIEKISFTGGTDTGKKVMASASASSLKDVTMELGGKSPLIICDDADLDRAADTAMMANFYSSGQVCTNGTRVFVPSHLKAAFEAKIVERVARIRVGNPEDENTNFGPLVSFPHMESVLGYIAKGKEEGARVLCGGERLTDGEFAKGAFVAPTVFTDCTDDMTIVREEIFGPVMAILSYETEEEVIRRANDTDFGLAAGIVTRDLNRAHRVIHQLEAGICWINAWGESDAKMPVGGYKQSGVGRENGISSLNNFTRIKSVQVELGDYVSVF

SEQ ID NO: 17245 - protein, 540 aa, Bacillus cereus ATCC 14579
MSYEKVWANNEKLNQTEKNKLEKDGLEIFNDIPYYAENGFESIPKEEWDAFKWAGLYLQRPKEAGYFMMRVNIPSGIITNAQAEVLASIAEDYGRNVIDITTRQAIQFHWLEIQQIPDIFKRLARVGLSSAGACGDITRNITGNPLAGIDANELFDTTHIVKEVYDYFQHNEEFSNLPRKFKMSISSNIYNSANAEINCVAFTPATKEIDGEKKVGFHIKVGGGLSARPYLADELDVFVLPEEVKAVAIAIATIFRDFGYREKRHLARLKFLVADWGAEKFKEKLIEYTGPLQSKGESALKGWNAGYFYGVQDQKQKGLKYVGFNVPVGRLHAEEMFEIARIAKQYGNGQIRTCNSQNFIIPNVPPENVKGLLSEPLFEAISASPKSFIGHAVSCTGIEYCNLALVETKERLRKIAEYLDTQIALDVPVRIHMVGCPNSCGQRQIADIGLQGVKMKTKEKGIVEAFEIYVGGTLLDGGAYNQKLKGKIDGEDLPDVLASFISYFKENKLPAETFYDFVGRVGVDTLQIALNNVLEEVIAS

SEQ ID NO: 17246 - protein, 327 aa, Zea mays
EANGRAIRRASSPSSIGGRGMSGAASVERVKDRATGLDKFVLREARGSSVEVYLYGGQVTFWKNNFGQQLLFVSNKATFKPRKAVRGGIQICFPQLGNHGVLEQHGFARNRFWSVDESPPPFPVATSNCHIDLILKSSPEDLKIWPHSYEFRLRVALTPRGDLILTSRIKNISSDSKPFQFTFAYHTYFSVSDISEVRVEGLETLDYLDNLQSRKRFTEQGDAVVFESEVDKVYLSAPPKVVVIDHEKKRTFVLRKEGLPDVVVWNPWDKKDEEYKRMLCVGAAAIEKPVTLKPGEEWIGKQEISAVPSSYSSGQLDPELIRRMHTI

SEQ ID NO: 17247 - protein, 334 aa, Medicago truncatula
MLGQGAYGTVYKGSISKEFSVAVKILNVSQGNGQDFLNEVGTMSRIHHVNIVRLVGFCADGFKRALIYEYLPNGSLQKFINSPDNKKNFLGWKKLHEIALGIAKGIEYLHQGCDQRILHFDIKPQNVLLDHNFIPKISDFGLAKLCSRDQSIVSMTAARGTLGYIAPEVFSRNFGNVSYKSDVYSYGMMLLETIGGRKITEDLEENSSHVYYPEWIYNLIDDEEEMKIHIDDEGDEKIARKMAIVGLWCIQWHAMDRPSMQMVVQMLEENIDKTPIPPNPFDSQSRQPRRTDATATTRQVNSHRSPAYTFQLHNPKYTNGTKFCNTIYCSNNSL

SEQ ID NO: 17248 - protein, 351 aa, Burkholderia xenovorans LB400
MAATRCRRSLGRDVMKTTRFNQYYCGVIRSTAIVAGVVAIATQVAYPASTDVIPQWIVLADAALPASAVHGAAQLAQDDGAAAGSSTTGTSSTGIAAGEPTAADDAALVFRPHDCSSANVSGCAPRGGGSGSNGAAGSGNSGAGGAAGAAGSGSGSAGASGGGKGNGNGSGNGSSGGGSSGGGSSGGGSSGGGSSGGGSSGGGSSGGGSSGGGSSGGGSSGGGSSGGGSSGGGSSGGGSSGGGSSGGGSSGGGSSGGGSSGGGSSGGGSSGGGSSGGCGCGGSSGGAGAGAGAGGGKGGGFGGGFGGGKGGGFGGGFGGGFGGGFGGGSGGGHGGKGSGGNGGGNGGGNGH

SEQ ID NO: 17249 - protein, 648 aa, Medicago truncatula
MSSLTFVVLLLILIFSYNKVYGDEHQDSCSRWCGVHNIRSPFRLKDSPKECGDERYNLSCEDNNQLILYHDSFGKYYVQSINYNNFTIRLLDFNLASSNNFIPPYYSLGLYNFSSNSIVSPYLAFRYYKNNTLNVLTKSMLYMSCPNRMEYSYIGNCMNRTSNSQDVNSFYVGSYGKSLSEFGLGDGCRIQFMYLTSLDVEDDGADHNNNNISCADIRREMFYGFELSWLNSFCKLDVSYAYAELDQNNQAHCNYAYWNNVAWIVACLSSRTVALVVFLSGVKFVLGAPLIIALVIYKWRRKHLSMYDGIEDFLRSDNSIMPIRYSYKDIKRITEQFKTKLGNGGYGSVFKGQLRSGRLVAVKLLDRAKSNDRDFVNEVATIGRIHHVNVVQLIGFCVEGSKRVLIYEFMPNGSLEKYIFSHNEENYSLSCEQLYSISLGVARGIEYLHNGCDMKILHFDIKPHNILLDENFNPKVSDFGLARLCPTDKSIVTLTAARGTIGYMAPELFYRNVGTISYKADVYSFGMLLMEMANRRKNLNALADQSSQIYFPFWVYDQLQDGREMTILNDTNHEMKLAKKMMIVALWCIQAKPSDRPPMDKVLEMLEEEDEDLQMPNKPDYYVQDEDTRDDRTGSSWYSSGTSVTDTK

SEQ ID NO: 17250 - protein, 424 aa, Aspergillus oryzae
MAPSSTTAQRIEEARALAKKDASKAETIYKDILSKGPGSTEASSRDYESALVGLGELYRDEKKPNEIAELIKTSRDSFSSFAKAKTAKLVRQLLDLFSEIPNTLDIQTAVIKSCIDWAIVERRSFLRQNLQTRLVAIYMQKQAYYDALNLINSLLRELKRLDDKLMLVEVQLLESRVYHALGNQAKGRAALTASRTSAASVYTPPNLQAGLDMQSGMLHAEDKDFTTAFSYFIEALEGYSSLDESDKATAALQYMLLCKIMLNLGDDVTTLLGSKQAQKYASPRLEAMKAVARAHANRSLEEYEKALSDYRFELGRDVFIRNHLRRLYDAMLEQNLIKVIEPFSRVELDHIAKMVGLDTPQVERKLSQMILDKVIIGVLDQGSGCLIVFDETERDQAYDAALETIEKLSNVVEELYTNQASQLE

SEQ ID NO: 17251 - protein, 806 aa, Oryza sativa (indica cultivar-group)
MFGRMRCLVGGGVEDSPRGAVRRVSPALRRVHNANASAAAAAGAEGKSGLPFRSPDVMETVHEVAIYIHRFHNLDLFQQGWYQMKISATWEEGGSKTPASPARVVQYEASDVGADDALGIWKIDDADNSFYTQPFRIKYARQDIYLSVMVSFNIFNSEEEGPAASSVILKFELIYAPTLENGSDIQASSATSSAAVHEFRVPRRALLGSHSYCPVHFDAFHSVLVDLTLHIVYLKAGATKSSLKIPDQGLGPTSHHIVKALLTSREMLLEELKKISDAIGKTVEDLDVADLSLGKYEAVQPAKSGLPNSNKVFPATTKGVGHLAGILHDFLEKPNSAVDGANDAMLYTLPKEELLELFLTVSSQLSLLWNAFLKFHRINKTKILDYLRDIWALDRKSEWSIWTVHSKIEIPHRYLRSTDDESSHRHSLLRVSGSRKFHDDPVQNSASRAELHRKSIAQMKINTLSIQDMQIYADPSRVPVVLIEQHVMVVPQHGSSKVLATNSSEQKDMIVLPKLQGDSLALKSSAVRVKLIMVYKKQGHHLDLRLVRNQWLLLDPGAECLMSEANEDKTSGDFKEMGGRLAGEVVAFLKKKVDKLAKYGGCKELKLSFVGHSIGNVIIRTALAEPALQPYLKNLYTYMSISGPHLGYWYSSNSLFNSGLWLLKKLKGAQCIHQLTFSDDQDPQNTFFYKLCKLKTLENFKNIILLSSPQDGYVPYHSARIELCPAASSDNSRKGQVFTEMLNNCLDQMRAPTSETRIFIRCDVNFDQSAQGRNLNTMIGRAAHIEFLETDIYAKFIMWSFPELFR

SEQ ID NO: 17252 - protein, 378 aa, Ostreococcus tauri
  misc_feature (377)..(378): Xaa can be any naturally occurring amino acid
  unsure (1)..(378): unsure at all Xaa locations
MATDAAARWERVAALARAPGTCDLGQGWPDVGESAIAIDAARRAMTDGTTRGNQYAPPRGRSELTEALVEYYARTGYDVRNGSGDDGTSSVVVTASATEALYGAFQGALRASAERDEIVFVEPFFPWYKAIADDLGGKSVVVRARASDGFAIDVEAVRAACEGGKTALLVMCSPHNPTGHCATRDELEGIATVARELDLTVLSDEVYERAVFEGGEHVRLATIGDMRERCVTLGSASKLLNLTGWRVGWAIGPPRLIDQINSAHSLMSYAAPTPFQIGVAAALNEISASATGRVTADANAEAMHSNARTLGRALEDAGLQVFYPKGGYFLTCDVSSTGLTDARFCERLAEKARVACVPMSVFFLDAPDVRARSCASXX

SEQ ID NO: 17253 - protein, 843 aa, Clostridium difficile 630
MSLKSLKIKENLYWVGSLDPDLRVFDIIMYTPYGTTYNSYVLKGTEKTVLFETVKDKHFDNYIERLNDLNIDFEKIDYIVVSHTEPDHAGSVEKLLDLAKNAKVVASETAIKYLKEIVNKDFEYVAVTDGDTLSIGDKTLEFFSVPMLHWPDTIYTYIKEDKTLVTCDSFGSHYSNDKIVNTLDENEEKDYLDALRYYYDCIMGPFKPSMVTAIEKIKDLDIDTVCPGHGPVLTENPRKIIDLYYNWSVNEQIKLEKEVTICYVSAHGYTKIMAEAIKAYIEKNSNYKVNLFDVIEHKQEDILAKIAVSQGVLFGTPTILGDALKPIWDILISLNPVLHGGKVASVFGSYGWSGEGIENAMERISQLRMTAVKPFAVNFKPSNEEIDKLHSYTGKFLDKLNSTFGSKKKTKKFKCVICNEVFEGDSAPSVCPVCGAKEDQFIEVEEDEVTFRKDTDEYFVIVGNGAAGFYAADAIRKRNKTCKITMISNEDELTYYRPALSDGINEELGSDFYMEDKDWYDKNNIVVILGTNVDKLDEVNKTIIVNDGAIKFDKLVIATGSRNFIPPIKGHDLENVFTLRNIKDLYSVKEALEKSKKVVVIGGGLLGLEAAWEFRLKGLEVVVVEAMDSILSKQLDKEGSKILEQCVRDTGIDVRLGVAVDGIEGDVKAQKVVFKDGDSVDCDMVVFSIGVRANTQMVQDTSVKIDRGIVVDKTLQTNVKDIYACGDVAQVGNISLAIWPSSVEMGKIAGANASGDNLTFESEVYPVSLDAMNVKVFSIGNIQNFDKEISSKDEGQRIYKKLFMKDGSLVGAILINDLSCTVKLIRLISEKGDFEDIMKADIL

SEQ ID NO: 17254 - protein, 219 aa, Shewanella oneidensis MR-1
MTESHIDFRRAKFLISAPDIAHLDQYLPGDVGVEIAFAGRSNAGKSSALNALTEQKNLARTSKTPGRTQLINVFELDAQRRLVDLPGYGFAQVPLAMKMKWQQSLAEYLQKRACLSGVVVLMDIRHPLKDLDMQMIEWAVASEIPVLALLTKSDKLAQSAKMKTVNEVRKALAEFGDWVQVESFSALKGTGKPKVLSILNEWCHPQWLANELENQDNAE

SEQ ID NO: 17255 - protein, 262 aa, Silicibacter sp. TM1040
MSGDLSPIDKAKFVAAKRAAELVEDGMRVGLGTGSTAAWLVRCLGEMVREDGLKITGVPTSARTAELAREVGIELITLDEARWLDLTIDGADEFDSELNLIKGGGGALLQEKIVATASDQMVVIADKAKEVETLGAFPLPIEVIPFGWQTSQALVEETLISMDVMGRSSTLRMNGASPYVTDEGNHILDLHLNRIGNPRQLALVLNQIPGVVENGLFIDICDTVVIGYGDGKVEVRDINEGTIETDRIDFVETDNLFADLND

SEQ ID NO: 17256 - protein, 556 aa, Ostreococcus tauri
MEDDAEIKFLRRPVDTLRLGLGAAREVGSSTTKHPVEVMQEEETLRPGVDHLGSTLGRRAWTSKTLPAHVVVPFPSLSPTMTRGGIASWKKTVGDAVVAGDVLAEVQTDKATMEMESMEDGYLAKILVDAGENDDVPVGKPVAVMCERAEDVGAFADYEPAADAEATAEATAETNAVPAARAVLERPDYRPIKEQGGLTRNSRASGRVDAGTESRAAPIARALPADAPRMTVRDALNSALSEEMARDEKVYIMGEEVGDYQGAYKITKGLLQKYGAERVRDTPITEAGFTGIGIGSAFMGLKPVIEFMTFNFSMQAIDHIVNSAAKTLYMSAGAISSPIVFRGPNGAAAGVGAQHSQCFAAWYMSIPGLKVLAPYDAEDARGLLKAAIRDPDPVVFLENELLYGQEFALPKEAMDEDFTIPIGKAVVMKPGADVTLVAFSKMVGYCLQAAEKLREEGIDAEVINLRSLRPLDRDALAASVRKTNRMVVVEEGWPQCGVGAEISAVVNEDAFDHLDAPVERITGVDVPMPYAQNLEERALPTVDDIVRVARRVTYRD

SEQ ID NO: 17257 - protein, 290 aa, Bacillus subtilis subsp. subtilis str. 168
MNFGNVSTAMITPFDNKGNVDFQKLSTLIDYLLKNGTDSLVVAGTTGESPTLSTEEKIALFEYTVKEVNGRVPVIAGTGSNNTKDSIKLTKKAEEAGVDAVMLVTPYYNKPSQEGMYQHFKAIAAETSLPVMLYNVPGRTVASLAPETTIRLAADIPNVVAIKEASGDLEAITKIIAETPEDFYVYSGDDALTLPILSVGGRGVVSVASHIAGTDMQQMIKNYTNGQTANAALIHQKLLPIMKELFKAPNPAPVKTALQLRGLDVGSVRLPLVPLTEDERLSLSSTISEL

SEQ ID NO: 17258 - protein, 473 aa, Streptomyces avermitilis MA-4680
MAAVTAAGAAQAPIVAGHPLLGSMNDLLNDPLATYLRARRDHGDVVRFRAGPPGLRADIYAVFSAEGAQQVLATESGNFRKDNVFYGELRDSVGNGLLTSQDATYLRQRRLVQPLFTRRRVDGYAGQVADEAAGLAEAWRGIPGGGVELVGEMHRFALRVVGRILFGTDMETTFEVIERTLPLLQEYALKRGLAPVRTPRTWPTPANRRAARTQAELFALCDGIIDSRRNRKNEGDGGEESGEDLVTLLVRAGNAEDGSLDAAELREQVLIFLLAGHETTATALAFALHLLARHPEQQRRVRDEADRVLGGPGGRAPTAADMEALPYLTMVLKEAMRLYPSAPVIGRRAVADAEVDGVRIPAGADLFVSPWVTHRHPDYWPDPERFDPERFTPEAEAGRPRYAWFPFGGGPRACIGQHLSMLESVLGLAVLIREFEFEAVGEEEVPLGAGITLLAKGPARCRVIPRSSGPRSS

SEQ ID NO: 17259 - protein, 348 aa, Lactococcus lactis subsp. lactis Il1403
MKSVYFVEKNKMQVREFPKAQLVKETDAIIKIVRACVCGSDLWWFRGISERQPGPVGHEAIGLIEEVGTGVKNFKVGDFVIVPFTHGCGHCPICLAGFEANCPNAKDGVNGGYQGEFYRAINTDGALVKIPGQPSDYSDDQLASLTALADVMPTGFHAAKAADVHEGDTVVVFGDGAVGLCAVISAKLLGAKRIIAMSRHEDRAALARDFGATDIIDERGEEAIQKIMSLTNGYGADAALECVGTKQAIESAFQAVRAGGRVGRVGVPHDVDYNEWIDSLFWKNIQLGGGVASVARWDKEILLEAVLSGEINPGRVFTAEFSLDEIQKAYEAMDQRTAIKSLLRISEV

SEQ ID NO: 17260 - protein, 357 aa, Zea mays
MEMTGSLPVPSVQAMVAAGRHAPVPPRYLRPDLAADVVVADDATTIPIIDFQRLLLVDPEESARLHAACQDWGFFQLINHGVPDDVMEAMKASIQSFFALPAEAKQQYRQQAGQLEGYGQLFVVSEDQKLDWADVLYLNTQPPEHRNLSFWPAGESFRQTLDTYSAAVKHVADRLLGAMYMNLGLQLSIMDMDPERGAGIQSVRMNYYPPCAEAADKVLGFSPHSDSDLLTLVLQVNQLQGLQIKRPPDGGGAWAWLPVTPLQGAFVVNVGDVLEIFTNGRYRSVEHRALVNAHTERLSIAAFHSPSIHATIGPLPELLGDQEVPKYKTLDHQSFITLFFSAKLQGKSFLERMKKLS

SEQ ID NO: 17261 - protein, 558 aa, Glycine max
QDSNFVNAFRFLSAESVLKNEGDPCVPTPWEWVNCSTTTPPRITKINLSRRNMKGEIPRELNNMEALTELWLDGNMLTGQLPDMRNLINLKIMHLENNKLTGPLPSYLGSLPSLQALFIQNNSFSGVIPSGLLSGKIIFNFDDNPELHKGNKKHFQLMLGISIGVLVILLILFLTSLVLLLILRRKTSQQKRDEKGVSGRSSTKPLTGYSFGRDGNIMDEGTAYYITLSELKEATNNFSKNIGKGSFGSVYYGKMKDGKEVAVKTMTDPSSYGNQQFVNEVALLSRIHHRNLVPLIGYCEEEYQHILVYEYMHNGTLREYIHECSSQKQLDWLARLRIAEDAAKGLEYLHTGCNPSIIHRDVKTSNILLDINMRAKVSDFGLSRLAEEDLTHISSVARGTVGYLDPEYYANQQLTEKSDVYSFGVVLLELISGKKPVSSEDYGPEMNIVHWARSLIRKGDVISIMDPSLVGNVKTESVWRVAEIAMQCVEQHGACRPRMQEVILAIQDASNIEKGSEIQLKLSSSGGSKPQSSRKTLLASFLEIESPDLSNSCLPSAR

SEQ ID NO: 17262 - protein, 212 aa, Brucella melitensis 16M
MKKIPRIGVGGPVGSGKTAIIEAVVPILIKLGYRILVITNDIVTTEDAKHVQRTLKGVLIEDRIVGVETGGCPHTAVREDPSMNLAAVEEMEAKFPDTDLVLLESGGDNLTLTFSPALIDFFIYVIDVAAGDKIPRKNGPGISQSDILVINKTDLAPYVGASLQVMDDDSRMMRGKKPFVFTNCKTNEGIDDLVHLIRENVLFDTEVSKESA

SEQ ID NO: 17263 - protein, 336 aa, Anabaena variabilis
MIRVAINGFGRIGRNFARCWLGRENSNIELVAVNDTSDPRTNAHLLNYDSSLGVKKVDITADDNSITVNGKTIKCVSDRNPENLPWKEWEIDLIIESTGVFTSKEGALKHVNVGAKKVLITAPGKNEDGTFVIGVNHHDYDHNVHHIISNASCTTNCLAPIAKVLNDKFGIIKGSMTTTHSYTGDQRLLDASHRDLRRARAAAINIVPTSTGAAKRVALVIPELKGKLNGVALRVPTPNVSMVDFVVQVEKRTITEEVNQALKDASEGPLKGILDYSELQLVSSDYQGTDASSIVDASLTLVMGNDLVKVMAWYDNEWGYSQRVLDLAELVAEKWV

SEQ ID NO: 17264 - protein, 299 aa, Bacillus halodurans C-125
MYPKHEPIDTHQKCDDIPVHFPPQSQPWHPGLEYLMEPRPISENPHRPHSHKLLDRVAIITGGDSGIGRAVAYAFAKEGADLVISYLSEHEDAIETKKRVEEIGRDCLLVPGDLQHEQMSVKVVEKTIERFGKLDVLVNNHAVQFRQTSLLDITEEQLDITFRTNIYAYFFMTKAALPHLKKGSAIINTTSVTSYLGHSQLIDYAATKGAVTTFTRALSGSLADQEIRVNGVAPGPIWTPLIPSSYPAHSIPTFGSDTPLSRPGQPFEVAPSFVFLASDDSKYLTGQILHPNGGRVTGS

SEQ ID NO: 17265 - protein, 337 aa, Anabaena variabilis
MKIRVGINGFGRMGRLALRAAWGWPELEFVHINEIKGGAVAAAHLLKFDSVHGRWTPEVEAEGERVLIDSTPLSFSEYGKPEDVPWEDFGVDLVLECSGKFRTPATLDPYFKRGVQKVIVAAPVKEEALNIVMGVNDYLYEPEKHHLLTAASCTTNCLAPVVKVIHEGLGIKHGIITTIHDNTNTQTLVDAPHKDLRRARATSLSLIPTTTGSAKAIALIYPELKGKLNGIAVRVPLLNASLTDCVFEVNRPTTVEEINALLKAASEQAPLQGILGYEERPLVSIDYKDDPRSSIIDALSTMVVDETQVKILAWYDNEWGYVNRMVELARKVALSLK

SEQ ID NO: 17266 - protein, 616 aa, Medicago truncatula
MNTYYHVMGLLLLVCYLNTLVVEFAHGTTDLVNYPQDLTCGNQVIKFPFHIKNQNPNPSLHGYPDFELFCSSNNETMIELPYKVKLNVKNIDYKHQTIELFDPQSCLYKHIHNLNLSESHFNYLKHDYDDFVDHHFFNCSLLNRDWMDSYSVSCLRTSTSQIYAIPSSTNIEDLPLSFCTKMFNVSFKPSDSLRLTWSEPNCKHCESKGKICGWKNTTSNSDNKEVDCVPKNKKGSSKALVNTGSILGSLFFILLIGGVFHIYDSYILRKEKQAIIEKFLEDYRALKPTRYSYVEIKRITNNFGDMLGQGAYGTVYKGSISKEFSVAVKILNVSQGNGQDFLNEVGTMGRIHHVNIVRLIGFCADGFKRALIYEFLPNGSLQKFINSPDNKKNFLGWKKLHEIALGIAKGIEYLHQGCDQRILHFDIKPQNVLLDHNFIPKICDFGLAKLCSRDQSIVSMTAARGTLGYIAPEVFSRNFGNVSFKSDVYSYGMMLLETIGGKKITEDLEENSSHVYYPEWIYNLIDDEEEMRIHVDDEGDEKIARKMAIVGLWCIQWHAMDRPSMQMVVQMLEGDEDKTPIPPNPFASQSRRPRKNSAIATTGHLAQDLDVIHELD

SEQ ID NO: 17267 - protein, 255 aa, Sinorhizobium meliloti 1021
MSKSGLWVGTSWKMNKTLAEAMVFADGLAAADDARDQRIQRFVIPPFTAARQVKERLKATSVKVGAQNMHWDDAGAWTGEISPVMLSDCDLDIVELGHSERREHFGETDRTVGLKTAAAVKHGLVPLICIGETLAQREAGEADTVLKRQVEGAFAFLEGAARKAPVLLAYEPVWAIGVNGIPATADYADARHRLIGEVAERALGVKVPVLYGGSVNPQNCEELILQPHIDGLFIGRSAWDVGGYLDILQRVARAI

SEQ ID NO: 17268 - protein, 333 aa, Thermotoga maritima MSB8
MARVAINGFGRIGRLVYRIIYERKNPDIEVVAINDLTDTKTLAHLLKYDSVHKKFPGKVEYTENSLIVDGKEIKVFAEPDPSKLPWKDLGVDFVIESTGVFRNREKAELHLQAGAKKVIITAPAKGEDITVVIGCNEDQLKPEHTIISCASCTTNSIAPIVKVLHEKFGIVSGMLTTVHSYTNDQRVLDLPHKDLRRARAAAVNIIPTTTGAAKAVALVVPEVKGKLDGMAIRVPTPDGSITDLTVLVEKETTVEEVNAVMKEATEGRLKGIIGYNDEPIVSSDIIGTTFSGIFDATITNVIGGKLVKVASWYDNEYGYSNRVVDTLELLLKM

SEQ ID NO: 17269 - protein, 654 aa, Thermotoga maritima MSB8
MEKMTIRDVDLKGKRVIMRVDFNVPVKDGVVQDDTRIRAALPTIKYALEQGAKVILLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKADRILIGGAMMFTFLKALGKEVGSSRVEEDKIDLAKELLEKAKEKGVEIVLPVDAVIAQKIEPGVEKKVVRIDDGIPEGWMGLDIGPETIELFKQKLSDAKTVVWNGPMGVFEIDDFAEGTKQVALAIAALTEKGAITVVGGGDSAAAVNKFGLEDKFSHVSTGGGASLEFLEGKELPGIASIADKKKITRKLILAGNWKMHKTISEAKKFVSLLVNELHDVKEFEIVVCPPFTALSEVGEILSGRNIKLGAQNVFYEDQGAFTGEISPLMLQEIGVEYVIVGHSERRRIFKEDDEFINRKVKAVLEKGMTPILCVGETLEEREKGLTFCVVEKQVREGFYGLDKEEAKRVVIAYEPVWAIGTGRVATPQQAQEVHAFIRKLLSEMYDEETAGSIRILYGGSIKPDNFLGLIVQKDIDGGLVGGASLKESFIELARIMRGVIS

SEQ ID NO: 17270 - protein, 624 aa, Clostridium difficile 630
MDGNISIYYKGDISKKEDIKFKIKESVNNTRLSSRIEYKDEEKTFDFERFNVIDAIYGNKPFEKDGKVIVFNGNIYNYHEIKEELIKKGHNFTTNDDIEVLLASYIEFGKNCVHKIKGMFNFIIYDRENESIFGARDLFGIKPLYYINKENAIIFSSEYKFLLEYMKNLNINERSLQSYFSFQYVLPEDTMIQGIRLIPAGHYFRVENGILSLKRYNKLEFRSSTKFFYTKNHLGNRDVNEDDIRNIVVDSIVTHMEEEKEIGTFLSGGIDSSIITTVASQINPNIKSFSAGFSVKGYSELEVAKKTADKLGIENIQINITQDEYIKSLPNVIYSLDDPIADPSEVGLYFLIKEAGKHVKVALSGEGADELFGGYNIYKEYSTMKSVVNSPTYIKSILGRVSELMPNIKGRNYLYRATTPLEKRYIGNAKVFENSEVKRFFFKYKEKNIYEYLLSNLYRDAQKNNYDYISKMQHIDVNTWLQGDILQKISKLSTAEQVELRVPFLYKDVFDVAKNLRMEQKINKNNTKVLLREAFREIVPEHVVQRKKLGFPTPIRVWLKDSLGDIVKETIYNSNVDEFIDKKYAIKLLDTHLKGHRDNSRKIWTIFTFCLWHQLFIEHKNVEY

SEQ ID NO: 17271 - protein, 341 aa, Shewanella oneidensis MR-1
MKALSKLKAEKGIWLVDAPKPEMGHNDLLIKIKKTAICGTDMHIYNWDEWSQKTIPVPMVVGHEYVGEVVDIGQEVRGFNIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQENLKDVMKELGMTEGFDVGLEMSGVPSAFRAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 17272 - protein, 197 aa, Triticum aestivum
AYLGDTIEQVCTKKQAGTGPEFPGYRRPTRPIDDNGEVIKRKKKKGLKEKLQGRLPGHKDTEGEHVTGLPAPAAPASVQTHGGHHDTDVVVKKIDGDVKTEAAPAVPEEEKKGFLEKIKDKLPGGHKKPEDAAAVPVTHAAPAPVHAPAPAPEEVSSPDAKEKKGLLGKIMDKLPGYHKTGEEDKAAAATGEHKPSA

SEQ ID NO: 17273 - protein, 246 aa, Saccharophagus degradans 2-40
MRRRLIVGNWKMCGDFRTNQKRLEDLSSLWFGVHQTEVSVSPAYPYLAQAAGMLENTNISLCAQDVSTRENGAFTGEVSAAMLADMGCRYVMVGHSERRHYHNEGYDLIAEKFQAVCEAKMIPILCLGETTADREADRTFDVIGRQLLKVVNACGLEGLAKGVVAYEPIWAIGTGRAATPEQAQDVHSYIREILGPEGEQIRILYGGSVKPDTAEGLFAKKDIDGALVGGASLDARDFVAICRAAE

SEQ ID NO: 17274 - protein, 471 aa, Oryza sativa (japonica cultivar-group)
MESTDEHAMESDTDLISVLPGEVLQHILSFSRIRAIVRMRRLSRRWMRVIECLQFICLDYRDFKHWKVEKFARFVDNLLLIRSKVDLHTFQLYWFHYLPLNCNDLRKWILYAVKHNVKVLDVELDMYDKTALPSRIFTCRSVEELSLQMGEAPDEDLEHVGLVLPDIIQLPSLKKLTLSDVEVDQLSLNQFIGRSPNLEDLHLINSATYLDLIASKVLKRLTLDGFMHGPKRFTISAPHLVHFECQGCALQDVSWGEKPSLESAHIDTWGKKYDGESEFIGVLLSAKTLALFGSDVKVMLEKELPACPVFERLTTLEIGKWCLTEDFYTVLRFLQLSPRLGELTLMQEELPHAARKGAETDAMPIDGMTFQCPFLETVIIQCSKGDDGINKLVNVLAANGINPKKIQVNFYEDIEEMERAENRRIIEEREKELCNFEKMAKKNPEWVDESRYADSNPETDSDEYDDDYDDF

SEQ ID NO: 17275 - protein, 321 aa, Oryza sativa (japonica cultivar-group)
MSTSRDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 17276 - protein, 639 aa, Physcomitrella patens
MVSIARLKEACSHCLPPTVAPYHAVCTPPALVTRVFEQATIGRDVRVIGPADLAKFMTDWQGDRNATEERATSLMADFNFLKSTASRALRIPGLSHSSKYSLSSRHSGSKHGQSAPETPTFDIATFLKFLLHPEFNGHRVPVSKTPTDDMNAPLSDYYIFSSHNTYLMGNQLCSPSSTAPIVKALLDGCRVIELDCWNGSNKRIDVLHGGTLTKAVPFEDCVKAIKDNAFTTSAYPVVVTIESHLDLEHQKEAARVLNKILGNIMFVPPPNELPPQSFRSPEQLKHRIIISDKPPGDALLSQAANEPEFAQQTLLHEVVRDPSPDNRHEHRHGRRGKKKKLRRRQSQIAESRIQKLPSGKLGDSGRPAIANDPAFDELLYIHCQKPTEMATAQKKGGPLIKGQHAIMANLSESQLDDLIEDHTDSLIEFSKTNLTRVYPFGLRVTSSNADPMDAWEHGVQVAAINMQGRDRPVWISKAIFSRNGGCGYVKKPDILLPESNMDHKSLMNLQPKLELKVTVLLGTDWHKNYDVFKKPGYFVKVAIHGMHDDEQKFKTHVCKRSREPHWEVEEFVFQIRVPKLAILRLEVREYDRIVRDDMVGQSCVPVTEHRQGIRAVQLASKKGEPGSSKLLCHFITRTL

SEQ ID NO: 17277 - protein, 246 aa, Thermosynechococcus elongatus
AKQTLTYDDIVGTGLANKCPTLDDTARGAYPIDSSQTYRIARLCLQPTTFLVKEEPKNKRQEAEFVPTKLVTRETTSLDQIQGELKVNSDGSLTFVEEDGIDFQPVTVQMAGGERIPLLFTVKNLVASTQPNVTSITTSTDFKGEFNVPSYRTANFLDPKGRGLASGYDSAIALPQAKEEELARANVKRFSLTKGQISLNVAKVDGRTGEIAGTFESEQLSDDDMGAHEPHEVKIQGVFYASIEPA

SEQ ID NO: 17278 - protein, 216 aa, Magnaporthe grisea 70-15
MSSTDPTTTGQTAQDASRQQPTAAASSSSELASAKITLYKVLRRFADFPIEGIVFIDIMPIFIDPKAHLALLRALELQVLSSFAPATAKPDVVVGLDARGFLFGPSLALKLDASFVPVRKKGKLPGPCVTATYEKEYGQDFFQMQEGAIKPGQKVLVVDDIIATGGSAAAAGELVKKLGGELMGYLFLLEIAPLKGREKLGGVPVVTLLEEADYPH

SEQ ID NO: 17279 - protein, 298 aa, Methanosarcina barkeri str. Fusaro
MDFEQLRHGTELIKRGFARMQKGGVIMDVTNPEQARIAEEAGAVAVMALQAVPADIRKAGGVARMADPEIVQQIIDTVTIPVMAKARIGHFVEAEILEALGVDMVDESEVLTPADPYFHIDKMQFTVPFVCGARNLGEALRRINEGAAMIRTKGEAGTGDVSQAVKHMKQIQGEIRALAGKTKEELIMVSREIEAPIELVVETSKMQRLPVVNFAAGGVATPADAALMMRLGADGVFVGSGIFKAENPEKMAKAVVEAVNNFDNPAKLAEISKGVGAGMKGISADTIPEQEALQERGW

SEQ ID NO: 17280 - protein, 387 aa, Pseudomonas fluorescens PfO-1
MTVLKMSDLDLQGKRVLIREDLNVPVKDGVVTSDARILASLPTIKLALEKGAAVMVCSHLGRPTEGEFSAENSLKPVADYLSKALGREVPLVADYLGGVDVKAGDIVLFENVRFNKGEKKNADELAQQYAALCDVFVMDAFGTAHRAEGSTHGVAKFAKVAAAGPLLAAELDALGKALGAPAKPMAAIVAGSKVSTKLDVLNSLSQICDQLIVGGGIANTFLAAAGHPVGKSLYEPDLLDTARAIAAKVSVPLPVDVVVAKEFAESAEATVKLIADVAADDMILDIGPQTAANFAELLKSSKTILWNGPVGVFEFDQFGNGTKVLAEAIAESAAFSIAGGGDTLAAIDKYGVAEKISYISTGGGAFLEFVEGKVLPAVEVLESRAKA

SEQ ID NO: 17281 - protein, 681 aa, Pseudomonas fluorescens PfO-1
MPSFFRFNLFTPRRSAMPSRRERANAIRALSMDAVQKANSGHPGAPMGMADIAEVLWRDYLKHNPSNPLFADRDRFVLSNGHGSMLIYSLLHLTGYDLSIDDLKQFRQLHSRTPGHPEFGYTPGVETTTGPLGQGLANAVGFALAEKVLGAQFNRPGHNIVDHHTYVFLGDGCMMEGISHEVASLAGTLGLGKLIAFYDDNGISIDGEVEGWFTDDTPKRFESYNWQVIRNVDGHDPEEIKTAIETARKSPLPTLICCKTTIGFGSPNKQGKEDCHGAPLGDAEIALTRQALNWNHGPFEIPADIYAEWDAKEKGRAAEAEWDQRFAAYSAAFPTEANELIRRLSGELPADFSEKADAYIAEVAAKGETIASRKASQNALNAFGPLLPEVLGGSADLAGSNLTLWKGCKGVSAEDASGNYMYYGVREFGMTAIMNGVALHGGLVPYGATFLMFMEYARNAVRMSALMKQRVIHVYTHDSIGLGEDGPTHQPIEQLTSLRSTPNLDTWRPADAVESAVAWKNALERKDGPSALIFSRQNLQHQTRDAGQIADIRRGGYVLKDCAGEPELILIATGSEVGLAVQAYDKLTEQGRKVRVVSMPCTSAFDAQDASYKQSVLPLQVGARIAIEAAHADFWFKYVGLEGRVIGMTTYGESAPASALFEEFGFTLENILGQAEELLED

SEQ ID NO: 17282 - protein, 365 aa, Debaryomyces hansenii CBS767
MVTKRNLKNIPKEWIPQDETKYDLDWADLTNIDISTFDKPGGKEKLASQLKIALHKDGFWTVSGTGISEEEMNRLFALGEFFFNNYSEEEKKLQEVNFEEGNYFGYKIKGNKSVFGTDVPDNVETFNIAKFTKQGFFEEFFKQDFIKEYREELEGISRKSFEVARKLFVLFALILELDENYFVDRHLYDDQSDDHLRFMKYHPREKEEDDRVENTWARGHTDFGSLTLLYNQVVSGLQIRLSNGEWKYVPSVPGAIICNIGDTLNFWSGGYFKSTIHRVVRPPPDQVDAPRIGVFYFVRPGDNTKIEIAESPVLKNLGLYRKIKPIVGTDYVRSRVKDYHDKKDYLKQNNVKFRLGEFEIEDGFE

SEQ ID NO: 17283 - protein, 474 aa, Ralstonia metallidurans CH34
MSKQFDVLVIGAGPGGYIAAIRAAQLGLNVACLEGNAYDDPKGEARLGGTCLNVGCIPSKALLASSEEFENASHHLADHGITVGDVKVDVAKMLKRKDDIVSKMTKGIEFLFRKNKVTLFKGYGKFTGKAAEGFQVEVNGETLTAKQVIIATGSKARHLPGVAVDNNLISDNEGALKFGTVPKKLGVIGAGVIGLELGSVWRRLGAEVTVLEALPAFLGAADEGVAKEAQKLLTKQGLQFHLSVKVDEVKTGKDNVTVNYTDKDGKAQTLEVDRLIVSVGRVPNTDNLGLDAVGLGVDQRGFIEVDDHCQTKVPGIWAIGDVVRGPMLAHKAEDEGVAVAERIVGQKPHIDFNTVPWVIYTFPEIAWVGKTEQQLKAEGREYKSGQFPFMANGRALGMGASDGFVKMLADARTDEILGVHIVAANASDLIAEAVVAMEFKAASEDIGRVCHPHPSMSEVMREAALAVDKRQLNM

SEQ ID NO: 17284 - protein, 419 aa, Ralstonia metallidurans CH34
MAIVDVKVPQLSESVAEATMLNWKKKPGEAVAQDEILIEIETDKVVLEVPAPSAGVLSQIIKNDGDTVVADEVIAKIDTAATAGAVAPAAAAPAPAAAAPAPAAAAPAAAASAGAIAMPSAAKLMAEGGLSASQVAGTGKDGRITKGDVLAAGSAPAPAAKAAPAPAAAKPALPQVSAQVDFAALGDRPEERVPMSRLRARIAERLIQSQSTNAILTTFNEVNMKPVMDLRAKYKDRFEKEHGVKLGFMSFFVKAAVHALKKYPVINASVDGNDIVYHGYFDIGIAVGSPRGLVVPILRNADQMSLADIEKKIAEFGTKARDGKLSLEELTGGTFSISNGGTFGSMLSTPIINPPQSAILGVHATKDRAVVEDGQIVIRPMNYLAMSYDHRIIDGREAVLGLVAMKEALEDPARLLLDL

SEQ ID NO: 17285 - protein, 1118 aa, Oryza sativa
  misc_feature (485)..(485): Xaa can be any naturally occurring amino acid
  unsure (1)..(1118): unsure at all Xaa locations
MTMMTPPPIEQQQEDEEMLVPHQELPAAAAPMEVVAQTEPANAAESQPPEDPQTSRFTWTIENFTRINGKKHYSEPFVVGGFKWRVLIFPKGNNVDHFSMYLDVADSVNLPYGWNRYAQFSLAVVNQIHPKYTIRKDTQHQFNARESDWGFTSFMPLSDLYDPSRGYLVNDTVVVEAEVAVRRMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKETVVEGTIEQLFEGHHINYIECINVDYKSNRKESFYDLQLDVKGCSDVYASFDKYVEVERLEGDNKYHAEQYGLQDAKKGVLFLDFPPVSQLQLKRFEYDYMRDTMVKINDRYEFPLQLDLDRDDGKYLAPDADRSIRNLYTLHSVLVHSGGVHGGHYYAFIRPTLSDQWYKFDDERVTKEDTKKAXLEEQYGGEEELPQINPGFNNTPFKFTKYSNAYMLVYIRESDKDKIMCNVDEKDIAEHLRIRLKKEQEEKEHKKKEKAEAHLYTIIKVARDEDLKEQIGKNIYFDLVDHEKVRSFRIQKQLPFTSFKEEVAKECGIPVQFQRFWLWAKRQNHTYRPNRPLGPHEESQSVGQLREVSNKAHNAELKLFLEVETGVDLRPIRPPEKSKEDILLFFKLYNPEKEELCFVGRLFVKATGKPSEILTKLNEMAGFAPNEEIELYEEIKFEPNVMCEHIDKKLTFRSSQLEDGDIICFQKSPVSDGETQVRYPDVPSFLEYVHNRQVVHFRSLEKPKEDDFCLELSKLHTYDDVVERVARQLGLDDPSKIRLTSHNCYSQQPKPQPIRYRGVEHLLDMLVHYNQTSDILYYEVLDIPLPELQCLKTLKVAFHHATKDEVVIHSIRLPKNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLLVIREGETAAEILERIQKKLRVPDEEFSKWKLAFISMNRPEYLQDVDVVSARFQRRDVYGAWEQYLGLEHTDTTPKRSYTANQNRHTFEKPVKIYN

SEQ ID NO: 17286 - protein, 380 aa, Debaryomyces hansenii CBS767
MSDSTTGKTIICKAAIAWEAGKPLTIEDIEVAPPKAHEVRIKILHTGVCHTDAYTLSGVDPEGAFPVVLGHEGAGIVESVGEGVDNVKVGDSVVALYTPECKECKFCKSGKTNLCGKIRSTQGKGVMPDGTSRFKCKGKELLHFMGCSTFSQYTVVADISVVAVNPKAQPDKTCLLGCGITTGYGAATITANVGEGDNIAVFGAGCVGLSVVQGALQRKAAKIIVVDINDSKKEWAEKFGATDFVNSAKLPSDTTIVDKLVEMTDGGCDFTFDCTGNVNVMRNALEACHKGWGTSVVIGVAAAGKEISTRPFQLVTGRVWKGAAFGGVKGRSQLPDIVENYMNGGLKVDEFITHRHELENINTAFDDMHAGDCIRAVINM

SEQ ID NO: 17287 - protein, 1077 aa, Saccharophagus degradans 2-40
MPKRTDIKSILIIGAGPIVIGQACEFDYSGAQACKALREEGYRVILVNSNPATIMTDPSMADATYIEPITWETVAKIIEKERPDAVLPTMGGQTALNCALALHKHGVLEEFGVELIGATEDAIDKAEDRNRFDQAMKKIGLECARAKIVHTMEEANQVPKEFGFPCIIRPSFTMGGSGGGIAYNWEEFEEICTRGLDLSPTNELLIDESLLGWKEYEMEVVRDKNDNCIIICSIENFDPMGVHTGDSITVAPAQTLTDKEYQIMRNASIAVLREIGVETGGSNVQFAVNPEDGRLVVIEMNPRVSRSSALASKATGFPIAKIAAKLAVGYTLDELQNDITGGATPASFEPSIDYVVTKIPRFTFEKFGDADARLTTQMKSVGEVMAIGRNFQESLQKALRGLEVGSAGFEPRVDLTGDNALELIRRDLSTPGAERIWYVADAFRAGMTVEEVHEQSAIDPWFLVQIKDIIDTETALSSMPLVDVDKRIMFNLKRKGFSDKRLGKLLGVSEKTLRGHRHKLDVHPVYKRVDTCAAEFSTSTAYMYSTYDEECESNPTSREKIMVIGGGPNRIGQGIEFDYCCVHAALASREAGYEAIMVNCNPETVSTDYDTSDRLYFEPVTLEDVLEIVHREKPKGVIVQFGGQTPLKLANALEAEGVPIIGTSPEAIDRAEDRERFQQMIQRLELLQPPNAIVRSTEEAIHIAPTVGYPLVVRPSYVLGGRAMEIVYTENELRTYMREAVQASEDSPVLLDHFLNNAIEVDIDAVSDGERVVIGGIMQHIEQCGVHSGDSACSLPPYSLPEDVQDEMREQVRKMARELGVIGLMNVQLAYQDGRIYVIEVNPRGSRTVPFVSKCIGVSLAKIAALCQTGKTLEELGFTEEIVPDYYSVKEAVFPFNKFPAVDPILGPEMKSTGEVMGVGDTFAEAYSKAQVGSGGDLPTSGTAFISVRDFDKDGIVVVAKELTDMGFSVVATRGTAKTLEAAGLSVKVVNKVGEGRPHIVDMIKNREVAMVINTTEGKKAIKDSASIRRSAENNHVYYTTTLAAANALCMALRFGKNHEVRTLQELHVRTAKLAKA

SEQ ID NO: 17288 - protein, 421 aa, Magnetospirillum magnetotacticum MS-1
MHHLIVGAGPAGVTAAEIIRELEPEATITLVGDEPEPPYSRMAIPYMLVGKVGEDGTYLRKGPNHYDRLGITLMPGRRMTGLDPAAKRIALDGGESLAYDRLLLALGARPMRPPIEGLDLPGVHTCWTLADARKIAEEAIPGSHVVLMGAGFVGTIVLEALALRQVSLTVVEMGDRMVPRMMDEVAGGMLKRWCEAKGVRVLTGTGIRRITQAESAADTRDSLVVELSDGATLPAHLVVVSAGVRSNTEAVAASGIALGNGILVDDHMRTSLPHVFAAGDVAQGRDFMSGEAHVHAIQITAAAHGRIAAYNMTGNDQAYHGSLNMNVLDTLGLITCSFGSWQGNGGHCARLVDEAGFRYLRLEFDGTSDVVIGAQAVGTTDHVGALRGLIQSKRRLGPAVKEQMMADPTRFMNGFVQTLHR

SEQ ID NO: 17289 - protein, 346 aa, Debaryomyces hansenii CBS767
MVVHNPNNWHWVDKNCIDWTRQYFNENLINISAAEGEKDVFVNTISSVEGDVEVCQRKGKVISLFDLKVVLEIKGHSISQSKKEGDFSGSITVPELAYDSTEDDLQFDISIYNEDADSEKMRPLIKKELLPKLRDSLIKFGRDLITTHSSDIQLSSDKVNSAYTKANQENAQNTPAAAKKASAPTPAAQKSTSSGAAAAKSASNSSVPRYNTSTLHLEPTFNTTAEQLYITLLDQQRVAAWSRSNPSMGSFPPEEGSEFSLFGGSISGKFLKLVPNEKIVQLWRLEDWKSGHYAQLDLQLIQGSGETKMIVKWSGIPVGEEDRVRGNFEDYYIRSIKITFGFGAVL

SEQ ID NO: 17290 - protein, 416 aa, Magnetospirillum magnetotacticum MS-1
MARRYVVVGGGPAGVVCAETLRRQDAEGSITLVCAEPGPPYSRMAIPYAMSGKIDESGTWLRKDWGHYEALGIALLHDRVTGVDSGARQVRLESGAPLSYDALLIATGSSPARPRVPGLDLPGVHSCWTLEDLRRIDPLLKPGRRVLLLGAGFVSCIILQSLVQRGAKVTVSCGSSGRMVRSMMDETAGGMIMRWCRAKGVEVLTAGRPTAIEQRDSGLLVTLDSGKSAEADLVIVGTGVKTNTAFLEGSGIAIEDGIIVDQYLGTNVPGIWAAGDVAQGFNCCTGLTEVHAIQPTAVEHGRVAAMNMSGHPTPFGGSLSMNTLETLGLISCSFGQWMGAEGGKQVRMVDEEHFRYLRLEFQGDRLVGANTVGMTNEIGIIRGLIQTKLRLGEWLERLTQDPSRLAEAYVACAQGV

SEQ ID NO: 17291 - protein, 533 aa, Triticum aestivum
  misc_feature (184)..(184): Xaa can be any naturally occurring amino acid
  misc_feature (266)..(266): Xaa can be any naturally occurring amino acid
  unsure (1)..(533): unsure at all Xaa locations
MAGATMATATVTAASPLRGRVTGRPRRVRTRCAAASGATETPAAPGVRLSAECVIVGAGISGLCTAQALATRYGVSDLLVTEARDRPGGNITTVERPDEGYLWEEGPNSFQPSDPVLTMAVDSGLKDDLVFGDPNAPRFVLWEGKLRPVPSKPGDLPFFSLMSIPGKLRAGLGALGIRPPPPVXGREESVEEFVRRNLGAEVFERLIEPFCSGVYAGDPSKLSMKAAFGKVWRLEEIGGSIIGGTIKAIQDKGKNPKPPRDPRLPXPKGQTVASFRKGLAMLPNAIASRLGSKVKLSWKLTSITKADNQGYVLGYETPEGLVSVQAKSVIMTIPSYVASDILRPLSIDAADALSKFYYPPVAAVTVSYPKEAIRKECLIDGELQGFGQLHPRSQGVETLGTIYSSSLFPNRAPAGRVLLLNYIGGSTNTGIVSKTESDLVEAVDRDLRKMLINPRAADPLALGVRVWPQAIPQFLIGHLDRLAAAKSALGRGGYDGLFLGGNYVAGVALGRCIEGAYESASQVSDFLTKYAYK

SEQ ID NO: 17292 - protein, 347 aa, Bacillus subtilis subsp. subtilis str. 168
MQSGKMKALMKKDGAFGAVLTEVPIPEIDKHEVLIKVKAASICGTDVHIYNWDQWARQRIKTPYVFGHEFSGIVEGVGENVSSVKVGEYVSAETHIVCGECVPCLTGKSHVCTNTAIIGVDTAGCFAEYVKVPADNIWRNPADMDPSIASIQEPLGNAVHTVLESQPAGGTTAVIGCGPIGLMAVAVAKAAGASQVIAIDKNEYRLRLAKQMGATCTVSIEKEDPLKIVSALTSGEGADLVCEMSGHPSAIAQGLAMAANGGRFHILSLPEHPVTIDLTNKVVFKGLTIQGITGRKMFSTWRQVSQLISSNMIDLAPVITHQFPLEEFEKGFELMRSGQCGKVILIP

SEQ ID NO: 17293 - protein, 374 aa, Saccharophagus degradans 2-40
MSKRDYYEVLGVSKDVSPQELKKAYRKVAMKYHPDRNSDDPNSEDKFKEASEAYEVLSDAQKRAAYDQYGHAGVDGNAGMGGGAGAGNFSDIFGDVFGDIFGGGGGRRRGGPSRGSDLRYTLDLSLEDAVKGTTVKIRVPTLVSCKPCGGSGAKPGTSPQTCTTCGGHGQVRMQQGFFSVQQTCPNCRGQGKMITDPCKECHGHGRVEETKTLSVKVPPGVDTGDRIRLAGEGEAGADGGPAGDLYVQVDVQDHAFFQREGRNLYCEVPISLFDACLGGELEVPTLDGRVKLKIPAETQTGKLFRLRGKGVTPVRGGAAGDLMCRVIIETPVNLTKKQKELLEELKASMKGEKNSPKQESWFEGMKNFFGDLKM

SEQ ID NO: 17294 - protein, 374 aa, Pseudomonas putida GB-1
MSKRDYYEVLGVERGASEADLKKAYRRLAMKYHPDRNPGDKESEDKFKEANEAYEVLSDASKRAAFDQYGHAGVDPSMGGGGAGFGGANFSDIFGDVFSDFFGGGRGGGRGGAQRGSDLRYTLELNLEEAVRGTTVSIRVPTLVNCQPCDGSGAKKGSTPSTCPTCGGIGQVRMQQGFFSVQQTCPRCHGQGKIITDPCTSCHGEGRVEEYKTLSVKVPAGVDTGDRIRLSGEGEAGTHGGPTGDLYVVISVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKASGWFDGVKRFFGDL

SEQ ID NO: 17295 - protein, 304 aa, Zea mays
MAAAPSSLVSSHLSRLADLRRAAAPATPTVPQQLRVGCSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKTPDFATIINSVTAKKVAA

SEQ ID NO: 17296 - protein, 464 aa, Bacillus halodurans C-125
MDRKETAKLMENVMTELSEKEGFLGIEDDEKRKRIVLSAQEILTTTDKIIKSYIRVSTEHGIMRIPAYRVQHNNISGFYKGGIRFSEFVSEEEVENLAILMTLKNALHRLPFGGAKGGVHVDPRKYSEKELNLISKKYVQRFARDLGPNHDIPAPDLGTNEQVIDWMVGEFKTIHPGQAYLGSFTGKSVENGGARGRREATGKGTFLSYIWLLSQWYDEHVSGNGINRTKQWETISNLKQQADNSDPIRVAVQGFGNVGSVAALEAYQCSEIAHRVVAVSDRYTTLYNEKGLDVRALAAYTIGGKDLPKNSEELAAAGVEASVLPVDAVLTCETDVLILAAIENQIHERNMKQVNARVLVEGANAPISTEADDYFEAAGTVVIPDILANAGGVIVSYLEWKQSRITELYSEDDILDEMGTQMKETLKSVYERYFSSVGHTLRFTCFTLALERLTSLLYKHGKLY

SEQ ID NO: 17297 - protein, 79 aa, Glycine max
  misc_feature (58)..(58): Xaa can be any naturally occurring amino acid
  misc_feature (65)..(65): Xaa can be any naturally occurring amino acid
  unsure (1)..(79): unsure at all Xaa locations
LEVCIRRTTQCDIGLTNFIYWGFWPDAIPGYAIVERTSFEISTETHDELLYDKVKLLXEMGYGCXTDISENLRSESLYR

SEQ ID NO: 17298 - protein, 352 aa, Arabidopsis thaliana
MSLLDDSFTSAMTLTNSGVPQVPDRYVLPPSQRPALGSSLGTSETTLPVIDLSLLHQPFLRSLAIHEISMACKEFGFFQVINHGIPSSVVNDALDAATQFFDLPVEEKMLLVSANVHEPVRYGTSLNHSTDRVHYWRDFIKHYSHPLSKWIDMWPSNPPCYKDKVGKYAEATHLLHKQLIEAISESLGLEKNYLQEEIEEGSQVMAVNCYPACPEPEMALGMPPHSDFSSLTILLQSSKGLQIMDCNKNWVCVPYIEGALIVQLGDQVEVMSNGIYKSVIHRVTVNKEVKRLSFASLHSLPLHKKISPAPKLVNPNNAPAYGEFSFNDFLNYISSNDFIQERFIDTIKKSSS

SEQ ID NO: 17299 - protein, 286 aa, Nostoc punctiforme PCC 73102
MASVMLATVDPGDEVIVFEPYYENYGPDAILAGATPRYVTLHPPHWTFDEAQLHQAFNANTKAIIINTPHNPTGKVFTREELTLIAELCQKWDVLAFTDEIYEHILYDGTQHIALATLPGMEERTITINGLSKTYSVTGWRVGYILANPALTGAIRKVHDFLTVGAPAPLQRAGVTAMQLPPSYYEELGKLYHQKRDSILQILDGVGIPYFLPQGAYYVLADISKFGYKTDIEFTYHLIKNIGVAVVPGSSFFSQPEKGHSLIRFCFSKTPETLQAASDRLLKLSK

SEQ ID NO: 17300 - protein, 352 aa, Methanosarcina barkeri str. Fusaro
MKGFAMLEIGKVGWIDTERPSAGPYDAIVRPIAVAPCTSDVHTVWEGALGNRKNMILGHEAVGVIEETGSEVKDFKPGDKVIVPAITPDWRSIEAQDGMPMHSNGMLSGWKFSNFKSGVFAEFFHVNDADMNLALLPKGMPLEQAVMLSDMATTGIQGAEMAKIKMGSTVAVIGIGPVGLMAVAGATILGAGRLIAVGSRKVCVDLALEYGASEIVDYRKGGLVEQILEKTNGKGVDSVIIAGGNENTISDAVKIVKPGGTVSNVNYYGTGDILPIPRIEWGSGMSQKDIRGGLTTGGRLRMERMADLCTYGRIKPEKMATHVFKGFDKMEEALMLMKEKPRDLIKPVVLLD

SEQ ID NO: 17301 - protein, 478 aa, Rickettsia rickettsii
MISNFFNLIRIFRIISKKQILIDSRSPKYCRFIGYILALFFAPVSLIKKSREDYGKRLIDCLSDLGPIYIKFGQTLSTRADLVGAEIAGYLRLLQDKLPPFDGGVARRLITSLRGDMYVDEAISASKQKIATQSMTVSHDALPFLHLDDTPIAAASISQVHKAQLITGEYVAVKILRPGIHKKYNRDIKLLYFLAKIISKFSKAKRLKPIKVVDKFHETMKFELDLRLEAAAASELTDNMRNDINVIIPKIYWDLTSENILTTEWLDGTSIYDTLLLKEMGLEPSKISQDFAVMFFNQAYRDGFFHADLHAGNILVNKQGKIILLDFGIMGRLKEKDRLAVAESLFGFLRRDYKLVAKVHLRAGYIPSNTDLALFAQSCRAVTEPIVGTPIKNISIGKLLAHLFKITEDFGMEVQPELLLLQKTLIMVEGIGRQLDGNVNMWQLAEPWIKKWAVKNLSPEAKLLRLVKHDLDSLEDII

SEQ ID NO: 17302 - protein, 636 aa, Fusobacterium nucleatum subsp. nucleatum ATCC 25586
MKKNFFVSTPIYYVNGDPHVGSAYTTIAADVINRYNKAMGMDTHFVTGLDEHGQKVEQAAKQNGFTPQAWTDKMTPNFKNMWAALDIKYDDFIRTTEDRHKKAVKRILDIVNAKGDIYKGEYEGKYCVSCETFFPENQLNGSNKCPDCGKDLTVLKEESYFFKMSKYADALLKHIDEHPDFILPHSRRNEVISFIKQGLQDLSISRNTFSWGIPIDFAPGHITYVWFDALTNYITSAGFENDENKFDKFWNNSRVVHLIGKDIIRFHAIIWPCMLLSAGIKLPDSIVAHGWWTSEGEKMSKSRGNVVNPYDEIKKYGVDAFRYYLLREANFGTDGDYSTKGIIGRLNSDLANDLGNLLNRTLGMYKKYFNGTIVSSSTVEPIDDEIKSMFNDVVKDVEKYMYLFEFSRALETIWKFISRLNKYIDETMPWTLAKNEAKKARLAAVMNILCEGLYKIAFLIAPYMPESAQKISNQLGIDKDITNLKFDDIKEWSIFKEGHKLGEASPIFPRIEIEKEEIVETKKELKIENPVDIKEFNKIEIKVVEILDVDKVEGADKLLKFKVFDGEFERQIISGLAKFYPDFKKLISEKVLAVVNLKFTKLKGEISQGMLLTTEDKNGVSLIKIDKTVEAGAIVS

SEQ ID NO: 17303 - protein, 252 aa, Oryza sativa
VRMENGLSDEVLKAVFPLLDGQDLVFCMLVCRQWREIAKDDYFWKCICARKWPSICKQPPSDANYQKLYLTFSKPRTPQHLPVPKLTFEDLVFYIDMWLDGSLIFSQAVSGCILRGGLQNTPCGIPDVLVAHLTAPDCILMMEVEPKLEITMGPSITVSVLAHRKDTKKMACVINKSTFDYIDSNAARALAYEYLQFSPRYPFISDIRAWMSLLFLYKGTNVIEVFGIELDFCDAARSETEILWLLDMLDWK

SEQ ID NO: 17304 - protein, 392 aa, Oryza sativa (japonica cultivar-group)
MADEWWSASQRSHGTSACSAAPSPLTADRVSCGWTSPAAAAAAESTSSITFQDPSRSSAAHHQPLSDAASSLGDPHMVDWTQAFLSGRSDASFQAVLQDDMAASTRPFRAQPTAADEAVMTNPFRDMGVGQGLLLDQASAPLHGLSFDAGEPAVAPATHSITTSFGDYQHSASYDAAAAVMQFSQTPRAPSLPAAAQMQFLSGSYQLPFGGAPPLPSQLLLQAMQPKPSCSSNANTLLAKSNSGSAQQICSSEGRKSVSDSPAAAKRPRIEVPSPLPTFKVRKEKLGDRITALQQLVSPFGKTDTASVLHEAIEYIKFLHEQVASLSSPYLKNGNPLQHFQQKGSESTKDAEQPKPDLRSRGLCLVPVASTYTVASETVPEFWHPTFGGTFR

SEQ ID NO: 17305 - protein, 731 aa, Magnetospirillum magnetotacticum MS-1
MSPRRRILPGSANPLGATWDGNGVNFALFSAHAEKVELCLFDRRGLREVERITLPEYTDEVWHGYLPDCRPGQLYGYRVHGPYDPNEGHRFNAHKLLLDPYAKAHAGSFEWSDTHFGFKPGTPKQDLIADKRDNARFMPKCRVLDTAFTWGDDRRPNVPWPETIVYEAHVRGMSMKHPGVTNGMRGTFLGLTQPGIIDHLRRLGVTTLQLLPIHAMIDEKHLADKGMRNFWGYNSIGFFASDARYYSASPHGDFKTMVARLHDVGIEVILDVVYNHTAEGNHLGPTLSYRGIDNLSYYRLGPDGKRWYENYSGCGNTLNLAHPRVLQMVMDSLRYWAEDMHVDGFRFDLAASLVRGKGGFDHTSGFLDAVRQDPVLSKLKLIAEPWDLGGDGYRVGRFPPGWSEWNGRYRDTVRRFWTGEGGVIGDLASRLTGSSDIFGWGGRRPWASLNFVTCHDGFTLADLVTYERKHNEANLEANKDGSDANYAWNCGHEGPSPYPEITALRARQSRNLLATLLLSQGVPMLLAGDEMGRSQKGNNNAYCQDNELGWVDWSQVDEDLLAFVQMLIGLRKSHPVFRRPRFFEGKRLPNSPLKDIVWITPEGREMGQGDWTTPFARTLGFVLGGESCAVDNLTGREEMDDTFLVLLNAYHEAVPYVLPPPHLGRSWELVLDTNDPAGKQAGTQWMAGITYPLGSRSLAVLRRSGGLRNGPRDASVSPGGVPQDETEGNVE

SEQ ID NO: 17306 - protein, 1073 aa, Pseudomonas putida GB-1
MPKRTDIKSILILGAGPIVIGQACEFDYSGAQACKALREEGFRVILVNSNPATIMTDPAMADATYIEPIKWQSVAKIIEKERPDAVLPTMGGQTALNCALDLERHGVLEKFGVEMIGANADTIDKAEDRSRFDKAMKDIGLECPRSGIAHSMEEANAVLEKLGFPCIIRPSFTMGGTGGGIAYNREEFEEICTRGLDLSPTKELLIDESLIGWKEYEMEVVRDKKDNCIIVCSIENFDPMGVHTGDSITVAPAQTLTDKEYQIMRNASLAVLREIGVETGGSNVQFGICPNTGRMVVIEMNPRVSRSSALASKATGFPIAKIAAKLAIGYTLDELQNDITGGRTPASFEPSIDYVVTKLPRFAFEKFPKADARLTTQMKSVGEVMAIGRTFQESLQKALRGLEVGACGLDPKVDLASPEAASILKRELTVPGAERIWYVADAMRSGMTCEEIFALTGIDMWFLVQMEDLIKEEEKVKTLALSAIDKDYMLRLKRKGFSDQRLAVLLGITDKNLRRHRHKLEVFPVYKRVDTCAAEFATDTAYLYSTYEEECEANPSTRDKIMILGGGPNRIGQGIEFDYCCVHAALALREDGYETIMVNCNPETVSTDYDTSDRLYFEPLTLEDVLEVCRVEKPKGVIVHYGGQTPLKLARALEEAGVPIIGTSPDAIDRAEDRERFQQMVQRLSLLQPPNATVRSEEEAIRAAGGIGYPLVVRPSYVLGGRAMEIVYELDELKRYLREAVQVSNDSPVLLDHFLNCAIEMDVDAVCDGTDVVIGAIMQHIEQAGVHSGDSACSLPPYSLSKEVQDEVRVQVKKMALELGVVGLMNVQLALQGDKIYVIEVNPRASRTVPFVSKCIGTSLAMIAARVMAGKTLKELGFTQEIIPNFYSVKEAVFPFAKFPGVDPILGPEMKSTGEVMGVGDSFGEAFAKAQMGASEVLPTGGTAFISVRDDDKPQVAGVARDLIALGFEVVATAGTAKVIEAAGLKVRRVNKVTEGRPHVVDMIKNDEVSLIINTTEGRQSIADSYSIRRNALQHKIYCTTTIAAGEAICEALKFGPEKTVRRLQDLHAGLKA

SEQ ID NO: 17307 - protein, 512 aa, Arabidopsis thaliana
MGCCQSLFSGDNPLGKDGVQPQPLSQNNHGGATTADNGGSGGASGVGGGGGGGGIPSFSEFSFADLKAATNNFSSDNIVSESGEKAPNLVYKGRLQNRRWIAVKKFTKMAWPEPKQFAEEAWGVGKLRHNRLANLIGYCCDGDERLLVAEFMPNDTLAKHLFHWENQTIEWAMRLRVGYYIAEALDYCSTEGRPLYHDLNAYRVLFDEDGDPRLSCFGLMKNSRDGKSYSTNLAYTPPEYLRNGRVTPESVTYSFGTVLLDLLSGKHIPPSHALDMIRGKNIILLMDSHLEGKFSTEEATVVVELASQCLQYEPRERPNTKDLVATLAPLQTKSDVPSYVMLGIKKQEEAPSTPQRPLSPLGEACSRMDLTAIHQILVMTHYRDDEGTNELSFQEWTQQMKDMLDARKRGDQSFREKDFKTAIDCYSQFIDVGTMVSPTVFGRRSLCYLLCDQPDAALRDAMQAQCVYPDWPTAFYMQSVALAKLNMNTDAADMLNEAAQLEEKRQRGGRGS

SEQ ID NO: 17308 - protein, 508 aa, Rickettsia rickettsii
MNNTYYITTPIYYVNDIPHIGHAYTSVASDVIARFMRLRGFDVMFLTGTDEHGQKVEKAAINKNIDPQKFTDQTSESFRHLMTAMHISNDDFIRTTEHRHKEAVAVFWQKLLDNGTIYEGFYEGWYAVRDEAFFDESELTRDGLAPTGAPVEWVKEPSYFFNLSKWQDKLLEFYEANPDFIRPISRRNEVISFVKSGLKDLSVSRTTFNWGIKVPNNEKHVIYVWLDALANYISALGYLDEQSNYGKFWPADLHVVGKDILRFHAVYWPAFLMAAEVPLPKTIMAHGWWTNDGQKISKSLGNTIDPIKLIDEFGVDQVRYFLMREVTFGADGNFARSNLITRINSELSNKIGNLLQRTTSFVYKNNDAKVPLLTQGVIDKIYELPILKTASKCVEQNILLMDKTEINKILENIINLAEEANIYIDSEAPWNLKKTDPDKTLEVLYALLEVLRYIAIMLLPFIPSSANKMLDQLGVNKEERLFKHLIRDYTLTAGSNILEPTIIFPKFE

SEQ ID NO: 17309 - protein, 435 aa, Staphylococcus epidermidis ATCC 12228
MENEQMFERTVQPVLDVKDKPKPAQWAFLSLQHLFAMFGSTVLVPFLTHLPISAALLASGIGTLLYILITKAKIPAYLGSSFAFITPIITGLSTHSLGDMLVALFMSGLMYVIIGIFIKLSGTHWLMHLLPPVVVGPVIMVIGLSLAPTAVNMAMFENSAEMKGYNLSYLIVALITLAVTIIVQGFFKGFLSLIPVLIGIIVGYIVSIFMGIVKFAPIAQAKWIDFPHIYLPFKDYTPSFHLGLILVMIPVVFVTVSEHIGHQMVINKIVGRNFFENPGLDKSIIGDGVSTMFASMIGGPPSTTYGENIGVLAITKIYSIYVIGGAAVIAIILAFIGKFTALISSIPTPVMGGVSILLFGIIAASGLRMLVESQVDFASNRNLVIASVVLVVGIGNLLINLKGIGINLQIEGMALSALSGIILNLILPKDKNQIN

SEQ ID NO: 17310 - protein, 1090 aa, Xanthomonas oryzae pv. oryzae KACC10331
MAGPTLLRTPMPKRTDLKTILIIGAGPIVIGQACEFDYSGAQACKALRDEGYRVVLVNSNPATIMTDPNMADAVYIEPINWQTVEKIISKEKPDALLPTMGGQTALNCALDLADHGVLEKYNVELIGAKREAIRMAEDRELFRVAMGEIGLDCPKAAVAHTLEEALEIQTRVGYPTIIRPSFTLGGSGGGIAYNREELIEIVGRGLELSPTTEVLVEESVLGWKEFEMEVVRDTADNCIIVCAIENLDPMGVHTGDSITVAPAQTLTDKEYQRLRDASIAVLRKIGVDTGGSNVQFGISPTTGRVVVIEMNPRVSRSSALASKATGFPIAKVAAKLAVGYTLDELRNEITGGLTPASFEPSIDYVVTKIPRFAFEKFPQADARLTTQMKSVGEVMAMGRTFQESLQKALRGLETGKIGLDPTGLDLSSEDDIAALKRELKAPGPERLFYVADAFRAGMTVAEVYALSFIDPWFLDQIEELISHEQQLADDGMAALDAARLRMLKCAGFSDARLAELIGSNEESVRTLRRALEVRPVYKRVDSCAAEFATSTAYMYSTYEDECEALPTDRDKIMILGGGPNRIGQGIEFDYCCVHAALALRDDGFETIMVNCNPETVSTDYDTSDRLYFEPLTLEDVLEIVELEKPKGVIVQYGGQTPLKLARALEANGVPVIGTSPDSIDLAEDRERFQQLVDTLGLKQPPNRIARNAEEALVLAREIGYPLVVRPSYVLGGRAMEIVYGESDLARYVRDAVKVSNDSPVLLDRFLDNAVEVDVDIIADKDGNVLIGGVMEHIEEAGVHSGDSSCSLPPYSLSPQTQAELRRQVVMLAEGLNVVGLMNTQFAVQVNEAGDDIVYLLEVNPRASRTVPFVSKAIGMPLAKIAARCMAGKTLAEQGAIKEIVPDYYSVKEAIFPFAKFQGVDPILGPEMRSTGEVMGVGRSFSAAFARAQEAGGIKAPPVGKAFVSVRDPDKQRVLPVAQALVERGFTLVATRGTGAWLQQNGLSCEIVNKVAEGRPHIVDSIKNGEIVYIVNTTEGRAAISDSFSIRREALQHRVTYSTTVAGAKALVHSLEFRGTGPVWSLQELHKELEA

SEQ ID NO: 17311 - protein, 1057 aa, Staphylococcus epidermidis ATCC 12228
MPKRDDIKTILVVGSGPIIIGQAAEFDYAGTQACLALKEEGYRVILVNSNPATIMTDKEIADKVYIEPLTHDFIARIIRKEQPDALLPTLGGQTGLNMAIQLHDSGVLEANNVKLLGTELESIQQAEDREMFRTLMNDLNVPVPESDIVNTVEQAFEFKEQVGYPLIVRPAFTMGGTGGGICHNDAELKEVVSNGLHYSPATQCLIEKSIAGYKEIEYEVMRDKNDNAIVVCNMENIDPVGIHTGDSIVVAPSQTLSDVEYQMLRDVSLKVIRALGIEGGCNVQLALDPHSLNYYIIEVNPRVSRSSALASKATGYPIAKLAAKIAVGLTLDEMLNPITGTSYAAFEPTLDYVISKIPRFPFDKFEKGERELGTQMKATGEVMAIGRTYEESLLKAIRSLEYGVHHLGLSNGESYELDYIKERIGHQDDERLFFIGEAIRRGTSLEELHNMTKIDYFFLNKFQNIIDIEHELKNHQGDLEYLKYAKDYGFSDKVIAHRWDKEEKDIYQLRMSQNIKPVYKMVDTCAAEFESTTPYYYGTYEYENESIVTDKEKILVLGSGPIRIGQGVEFDYATVHAVWAIQNAGYEAIIVNNNPETVSTDFSISDKLYFEPLTEEDVMNIINLEQPKGVVVQFGGQTAINLADKLAQHGVKILGTSLEDLNRAEDRKEFEALLREIAVPQPQGKTATSPKEALENAREIGYPVVVRPSYVLGGRAMEIVDNDQELENYMTQAVKASPEHPVLVDRYLTGKEIEVDAISDGETVVIPGIMEHIERAGVHSGDSIAVYPPQTLTQDEINTLEDYTIKLAKGLNIKGLINIQFVIAHDGVYVLEVNPRSSRTVPFLSKITDIQMAQLAMRAIMGETLAEIGFKQGIQPYSEGVYVKAPVFSFNKLKNVDITLGPEMKSTGEVMGKDLTLEKALYKGLTGSGFEVKDHGTVLMTVSDKDKDEIVKIAHRLNEIGYKILATRGTAQKLKDHNIPVEVVGKIGGEDDLLTRIQNGEVQIVINTMTKGKEIERDGFQIRRTTVENGVPCLTSLDTASALTNVIESMTFTMRNV

SEQ ID NO: 17312 - protein, 251 aa, Pseudomonas putida GB-1
MRRPMVAGNWKMHGTRASVAELTEGLSNLALPSGVEVAVFPPALFINQVIDGLAGKEITVGAQNSAVQPEQGALTGEVAPEQLVEAGCKLVLIGHSERRQVIGETDEVLNRKFAAAQAKGLKPVLCIGETLEEREAGKTLEVVGRQLSSIIEAFGVKAFANAVIAYEPVWAIGTGLTATPQQAQDVHAAIRGQLAAEDAEVAAKVQLLYGGSVKAANAAELFGMPDIDGGLIGGASLNADEFGAICRAAGN

SEQ ID NO: 17313 - protein, 104 aa, Zea mays
  misc_feature (19)..(19): Xaa can be any naturally occurring amino acid
  unsure (1)..(104): unsure at all Xaa locations
MSGRGKGGKGLGKGGAKRXHRKVLRDNIQGITKPAIRRLARRGGVKRISGLIYEETRGVLKIFLENVIRDAVTYTEHARRKTVTAMDVVYALKRQGRTLYGFGG

SEQ ID NO: 17314 - protein, 460 aa, Zea mays
MVNGERRADAECTRASLLGRYEIGRTLGEGNFGKVKYARHIASGGHFAIKILDRSKILSLRIDDQIRREIGTLKLLKHPNVVRLHEVAASKTKIYMVLEFVNGGELFDKIAIKGKLSEHEGRRLFQQLIDGVSYCHDRGVYHRDLKPENVLVDRKGTIKISDFGLSALPQHLGSDGLLHTTCGSPNYIAPEVLQNRGYDGSLSDLWSCGVILYVMLVGCLPFDDRNLVVLYQKIFKGDCQIPKWLSPAAQDLLKRILQPNPMKRINVAGIREHEWFKKDYVPAVPHDDDEDVLPSPAPSIKPIDEPAQEKCSPINAFQLIGMASSLDLSGFFEEEDAAQRKIRFTSTHPPKDLFDKIESVVMEMGFKVHRGAGKLKVLKNSKCSRNPSSLLVCTEVFELGPSLYVVELRKSHGDSTLYRQLCERLSDELGACKTDQIARTESSSDDLSSVDGEAFPLSGF

SEQ ID NO: 17315 - protein, 232 aa, Oenococcus oeni PSU-1
MEKNLQNELKKEAAIRAAEFVENDTVVGLGTGSTVKFLVDELGRKVREENLSFTGVTTSKRTASQAESLGIKIVSLDSIPRIDLTIDGADQVDNNFNGIKGGGAALLWEKIVATNSKKNIWIVDQSKLVDRIGSFPLPVEVIPFGALHVLNKFEELNLNPALRLTENGKKVMTDSQNYIIDLHLNQIIDPAKLSNQLINTVGVVEHGLFLNVVDKVVVGKKGQPLILENPDK

SEQ ID NO: 17316 - protein, 340 aa, Oenococcus oeni PSU-1
MLDYLIDEVSKAFYLIFTNFILDKKEVDLVNKVIVLGSLNVDTILKIKRFPNPGETLETLDKSSAAGGKGANQAVAAVRSGAQTTMIGQIGHDDLGKFMIDSLQNDHINVSPITVNDTVGTGTATVLLDENGQNCILVYGGANQKISPEDIKKISDNIKNSDFLISQFETPQNATKAAFEIAKENSLTTILNPAPASKIDSSLLTLTDLIVPNETESTVLTGIKITDEKSMIETAKAFSKMGIDNLIITIGDRGVFYSTKEKSELVSAYHVKAVDTTAAGDTFIGALSSQLKKDLSNIKSAISFAQCASSITVQRLGAQPSIPTLNEIRIAEKNYESVKN

SEQ ID NO: 17317 - protein, 419 aa, Zea mays
  misc_feature (402)..(402): Xaa can be any naturally occurring amino acid
  unsure (1)..(419): unsure at all Xaa locations
MNRRAPLGDIGNLVSVRPAEGSLSCRSRSIAPITRSFGAQLVKNVQANAAIKNAAILPARHAPRQERKAPAKQPPPEDVIVLSSDSEQSRTQLESSASSVRSRKKVINTLSSVLSARSKAACGITDKRRQVVVIEDIDKLDVNNELAVVEYIEDIYTFYKIAQHDRRPCDYIDTQVEINPKMRAILADWIIEVHHKFALMPETLYLTMYIIDQYLSLQPVLRRELQLVGVSAMLIACKIEEIWAPEVNDFILISDSAYSREQILSMEKGILNNLEWNLTVPTVYMFLVRFLKAATLGNIVEKEMENMVFFFAELALMQYGLVTRLPSLVAASVVYAARLTLKRAPLWTDTLKHHTGFRESEAELIECTRCWSAHTRRPHADSKLRAVYKKYSSEQFRTRARXRPPAAAVEINETKITCC

SEQ ID NO: 17318 - protein, 448 aa, Gracilaria gracilis
MGNVTRKAAVQNGKSKAATLVDEAIQTNPVVIFSKTYCPYCQSAKSNIRSALKKIANAPKPEIFELDRMGSLGYQIQNYLAQVTGRHTVPNVFIGGSSVGGGDDIAAYARRGVLVQMLTQAPQRLVHQFPERFEPEKKPDTAAEAVERAIKDNAVMVFSKSYCPFCTSAKDLLQERIAAVEGLNPINVFELDEMGTDGAAMQQYLFQKTGQRTVPNIFIAGKHVGGSDDVHGLDARNELIPMLTSAAASVSSPAATEVLSAEEEQTETDTALPADVVSEEKPKTETKEIVFGAGCFWGVELAFQRVAGVLKTEVGYSNGKMSRVTYDAICTGATGSAEVVRVWYDPSVLFLKQLLEVWESRHDPTSLNKQGNDQGTQYRSAIYYSDEEQAEEVRRWISEASTRHTKEIVTEVAAIKNYCAAEEYHQRYLEKKGQSAEKGSSASIRCYG

SEQ ID NO: 17319 - protein, 189 aa, Ostreococcus tauri
MAIDHMSVKCVVVGDGAVGKTSMLMCYATNTFPTDHMPTIFDNYSKNVTLQDGRTVSLGLWDTAGQDEYAAFRPLSYDAADAMLLAFSCDSRESYESVETKWVQELRAKSPGTPIVLVCTKIDLRDSAKGVIGRVEGEALSERIKATAYVECSALTQSGLQTVFDTVIDVRLRPELFAKKAQGGCCSIQ

SEQ ID NO: 17320 - protein, 451 aa, Shewanella oneidensis MR-1
MAQHFDYICLGAGSGGIASANRAAMRGAKVLLIEAKHVGGTCVNVGCVPKKVMWYGAHIAEAMNLYAKDYGFDVSVNKFDWNTLVNSREAYIGRIHEAYGRGFTNNKVTLLNGYGRFVNGNTIEVNGEHYTADHILIATGGAPTIPNIPGAEYGIDSDGFFALREQPKRVAVVGAGYIAVEVAGVLHALGSETHLFVRKHAPLRNFDPMLIDALVDAMKTEGPTLHTNSVPQSVVKNADDSLTLNLENGESVTVDCLIWAIGRSPATGNIGLENTEVQLDSKGYVITDAQQNTTHKGIYCVGDIMAGGVELTPVAVKAGRLLSERLFNAMSDAKMDYSQIPTVVFSHPPIGTMGLTEPEARAQYGDGNVKVYTSSFTSMYTAVTSHRQACKMKLVCAGKEDKVVGIHGIGFGMDEILQGFGVAMKMGATKADFDAVVAIHPTGAEEFVTMR

SEQ ID NO: 17321 - protein, 1018 aa, Ostreococcus tauri
MRRRSTSPASRPPAKRHRTDEDAVLAAGGRRIAPTGIGHGCLHDVVRPKAAATTDETSTSAPRDEGAIETPTKPAKSYPFELDTFQQKAVEVLERKESVLVSAHTSAGKTVVAEYAIAMAIRDGQRVVYTSPLKALSNQKYRELREEFEDVGLMTGDVVINPSASCLVMTTEVLRSMLYKGGEVMREVGWVIYDEIHYMRDSERGVVWEESIVLLPDMVKYVFLSATIPNAREFAEWVCKTHNQPCHIVYTDFRPTPLEHYIFPANGEGIFLVMDRQSNFRDSNFEQAVTVISDSGGTAAARVANRGRGDDGKNEAVNQDIFKIIRMVVERNYDPVIVFAFNKHECEKMANSLHKVDLCDDDEKKLIDTIYWNAMDALSEEDKRLPQVANLPNLLRRGLGVHHSGLLPILKEVIEILFQEGLIKVLFATETMSVGLNMPARTVVFCSPRKFDGAGFRWITSGEYIQMSGRAGRRGKDDRGLVILMMDERMDPPVAKNMLHGQSDTLDSAFRLNYAMILNLMRVEGADPESLIQSSFAQFQNDRALPGIEAKIVEIEKERDAVHIEDENAVDEYVKLQDGLDAMIRERRVVTNTPTYAVPFLQPGRLVRVCTKVPSVFNSTEEEAIKIPAPGTEPGEDDVVWGMIVSFERIGGGGKSGKAAYGVDILVRTRENRNGKTPLTVKDKSERYEIVLPNDSDESTEPRILRFPLEQIDIMSSVRVYLPKDLHPREARDQCMSSVGEVIKRFPDGVPVLDFEKDMKINNDNFAKLLKRIEGIKSMMRKHPIASSERLPEKLYAHREKRQLSIALKQAKRDAKAAAGLIMRDKLKQMRRVLRRLGHTSAEGVVQTKGRVACELASVDELVTAELIFNGTFKEVDVDMLVALVSCLVWRERSRNAAKLSEKTAEVYNRLKEVARKVGKQMVECKMHVDIEEYVDGFRSELMEIMIAWCKGNKFAEIMKMTDLFEGSIVRAIRRVEEVLRQLADACRVIGENELQEKFLLASEKVKRDIVFVASLFL

SEQ ID NO: 17322 - protein, 478 aa, Bacillus thuringiensis serovar konkukian str. 97-27
MRKTMSQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 17323 - protein, 138 aa, Triticum aestivum
VAPFQGLKSTAGLPVSRRSNGASLGSVSNGGRIRCMQVWPIEGIKKFETLSYLPPLSTEALLKQVDYLIRSKWVPCLEFSKVGFIFREHNASPVEVEEVKKEYPDAYVRIIGFDNMRQVQCVSFIAFKPPGCEESGKA

SEQ ID NO: 17324 - protein, 370 aa, Methanothermobacter thermautotrophicus
MILPLGPMHPGYKEPIRLKVKTRGEKVLKAEIEYGYVHRGIERVMRNKTWQKAIYLSERVCGICSYIHTQTFAEAFEAISEVEAPPRAQFLRALTNELDRIQSHLIANSTYFKALDHETMFMYMLALREPVMDAIELLTGNRVNMGWNVVGGVRMDASEDHLSRIREIIVDLEREFDRYVEMFEHGPLIGLRSRDVGYMSREEAEKARAVGPIGRASGIRYDFREDHPTYRDHLDFRTIWRDEGDNFARVMNRFDEIRVSIDLIKQVIDSIPSGPVRRKVDVKAGYGEWRNEAPRGEVAYMIETNGNLIKNISIRTPSIMNIDACAKYMLRDVATVADAVATYASADPCIACAERVVVLDENEGKREILL

SEQ ID NO: 17325 - protein, 88 aa, Filobasidiella neoformans
MSAPTSIPALDEASKKELESFLEQEQAKAKLQASIHELTNTCWNTCITGGISSKFSKSEAQCLENCVDRFLDSSLYIVRQIEAQKQQI

SEQ ID NO: 17326 - protein, 844 aa, Oryza sativa (japonica cultivar-group)
MRLLALAVASIVLANLHLLGVHGRDLLLSCGSNATVDAGGRRWIGDMAPGLNFTLSSPGIAASQAGSSNGNEIFGLVYHSARFFSTASWYNFSVLPGNYCLRLHFFPYTFGNFSGNDSLFDVTANDFKLVSKFNVSEEIVWRSTVSNSAINAVVKEYFLLVGSRGLQVEFDPSPGSFAFVNAIEVMLTPDNLFNDTVNKVGSAGNGQLPLGLSNRGLETMYRLNVGGHALNSSSDQYLHRPWYTDEAFMFSANAAQIVSNTSSVSYLSNNDSSISPIDVYETARIMSNNMVVDKRFNVSWRFYVHPNFDYLVRLHFCELFYDKPNQRVFKIYINNKTAAEDYDVYVRAGGINKAYHEDYFDNLPQQVDSLWLQLGPDSLTSASGTDPLLNGLEIFKLSRNGNLAYVLGHIDMGNQRGISKDRNRKILWEEVGIGSASFVTLTSVVLFAWCYVRRKRKADEKEAPPGWHPLVLHEAMKSTTDARAAGKSPLTRNSSSIGHRMGRRFSISEIRAATKNFDEALLIGTGGFGKVYKGEVDEGTTVAIKRANPLCGQGLKEFETEIEMLSKLRHRHLVAMIGYCEEQKEMILVYEYMAKGTLRSHLYGSDLPPLTWKQRVDACIGAARGLHYLHTGADRGIIHRDVKTTNILLDENFVAKIADFGLSKTGPTLDQTHVSTAVKGSFGYLDPEYFRRQQLTQKSDVYSFGVVLFEVACGRPVIDPTLPKDQINLAEWAMRWQRQRSLDAIVDPRLDGDFSSESLKKFGEIAEKCLADDGRSRPSMGEVLWHLEYVLQLHEAYKRNNVDCESFGSSELGFADMSFSLPHIREGEEEHHSKPSSIREDPDT

SEQ ID NO: 17327 - protein, 676 aa, Hordeum vulgare subsp. spontaneum
MFPLGARQPPPSAMDNHQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQAQSSWTKRAVEIDSPQDMSPDQSADPPEGTCAHVNHPKSEICSNRWLPGTNNKKCQKPKETTNGDGFKGKELEIGAPGNLNTDDQSSPKESSVKPTDGRCEYLPHNNSSDTVMENLEEPIVRAADLIGSMAKNMDAQQAAARAIDAPNCSLQAPEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHAANYGSNSFSNNNTNNGSTAATTAAAATVHAETGGGVDKRSNMMNMKRERRVAAVNKFREKRKERNFGKKVRYQSRKRLAEQRPRVRGQFVRQPPAPAAVER

SEQ ID NO: 17328 - protein, 462 aa, Mycobacterium smegmatis str. MC2 155
MSSSIVGSAAQEVESDRVDRLIADEEQVFLRRQPRSAEFIARARAHLAGGATSNWQIAQPQAVWMSHGYGSKVYDVDGTEYVDMHGGYGAAIAGHGHPAIVAAVSEQVRRGTHFAQPTENAIWIAEELSRRFGLPLWRFANSGTEATMDAVHLARAVTGRDLIIKVEGCYHGHHDSVQVSVLPEADEVGPRAHPVGVPGTSGIPEAIRNLVVVVPFNDPEAVARALTEHRGQVAAMILEPVMMNAGIIPPADGYLAEIRDLLHEAGSLLIYDEVKTGFTAGPGGITALSGVVPDIVCLAKALGGGIAVAAIGGTTQVMSAIADGRYEQVGTFNGNPLAMAATRATLSEVLTDESYAHLNRLAGDLRARLASVIAEHGVDWHVVSVGAKGCVTFRKEPVREYRDFLQIDDRLGHLHWLMQHNGGVFLPPWGKVEQWLLSVQHDTADVDRFVANFARLAAAVTR

SEQ ID NO: 17329 - protein, 394 aa, Glycine max
MEAAKVLSHCKTAPFGFSIVSNKVSLRPFDKHFHADVLANRPKSISFQLNCSYGNPFSSVLKPARKRANFLPSPRCSISSSASTESQNPVLEFFRNVPFDSIKATLLQLTPIDVVKWSGILCIIAAATKWTMNMLFSPFFWMYFSWTWLFWPWMVAIGLAVYGLYCFRKHLHSEANIFEQLAIVTSVFTWLTLVPPGHFNGYLEGWPYVFFFVYHYFFFFNVSVRKRLYGDYFAQPHDPKWDVNLPMWSRLLFSTGVMVGHWLAAFEGPELHLIPGGWSNLGIWALIITTLLMQYNATLYLAKYSENVVEPTSVVQFGPYRWVRHPIYSSTMLLFVTYCIALRAPLSLLFIVAVCLLYYKQKAEKEEDLMVETFGQSYTEYASKVKYKLIPFIY

SEQ ID NO: 17330 - protein, 407 aa, Mycobacterium smegmatis str. MC2 155
MLEDTKVRARPSWLLLGPAFVAAIAYVDPGNVAANVSAGAQYGFLLVWVIVVANVMAGLVQYLSAKLGLVTGRSLPEAVADHTRTPTRVAFWLQAELVAMATDLAEVVGGAIALYLLFDLPLLVGGLITGVVSLLLLAVQNRRGQRVFERVITGLLMVIAIGFLTSLFVKTPPAAAVADGLIPRFDGAESILLATAMLGATVMPHAVYLHSGLARDRHGHAEGPRLRMLLRVTRFDVGLAMLVAGAVNMAMLLVAATNLQGRGDTDSIEGAHAAVSDALGPTVALLFAIGLLASGLASTSVGAYAGAMIMQGLLKKSYPLLLRRLVTLVPALLVLAIGVDPSRALVLSQVVLSFGIPFALIPLVRLTSDKALMGGDANHRVTTAFGWGVAGLISVLNVVLIYLTVNG

SEQ ID NO: 17331 - protein, 516 aa, Cryptococcus neoformans var. neoformans JEC21
MLRQATSRFLSSTHRSIRPLSTTAPSFIRIRSQASEPSPAERPPPVPENVNPSQPFEPEVSKSEGTAKAAETQQAEEPASAGTPLTPPQPEVVFGNTHSAASTTPETEPNVENPDYSKLPSLDIDQEAAAISEPATGKDQEVEGGERKKTGAGKKEYVSSQEKSRRMWIRAGYGALAVGAVGAVLAMGNDETTGKKQGGFVETFQNNMLELFDFFNKPAFQTLLPDPLPPPHQRPYTLCIDLEGLLVHSSWDRTHGWRTAKRPGVDYFLGYLSQFYEIVLFSSQPLYTAAPIAEKIDPYQAFMPYRLFRESTRSVKGKVVKDISFLNRDPSKVIVLDVNPEHVALQPENGIVLQPWNGSPGDKGLVDMIPFLESIGIFNPADVRPILQAYAGKDIPIEYAKKEAEAKAKAIEEWERAHPTAITGAGSGFLSSIFGSVAAPGSSRPNQPMTYLEQKRAQAQRIYQEEQKYWAEHADEFKKLIEEDKQRQLAEMKGSILGYLGAPKMQDGPKEEVLKA

SEQ ID NO: 17332 - protein, 427 aa, Oenococcus oeni PSU-1
MPALRWQFLFLLAAIISGISGMAYSEFASALPVAGSAYSYGSVIFGQVVVGWFLGWSLILEYFLATSAVSVGFSSYLAGLLQTDHISGFNSILAGPMEGGIINLPAVVLLLVILGIQIIGLSTTRWVENVFVAIKLAILAIFIIVGLFFIKSNNYVPFYPKEFQTGAFGLSGIWMATSGIFFAFIGFDTLAAHTAEVKNPKKQVARGIIYTVIVAAVLYTLFAIVLTGMVNYTKLNVSDPASFAFTFVGQKGLASVIGIGSMIGMFTGVLALVFASSRLIYSFGRDGLLPNFIGKISGSQHVPFNALLIAGVVEIILAGFVPLSYLASLINAGTLAAFTFVNFGIIPLRHRTDLPNENGFRVPGYPIIPIIGGLTSFFFITQLETKTLVMFGVWTLVGLLIYFTYGVRHSMVKESKFDQSIIKENNA

SEQ ID NO: 17333 - protein, 721 aa, Triticum aestivum
  misc_feature (11)..(11): Xaa can be any naturally occurring amino acid
  unsure (1)..(721): unsure at all Xaa locations
VRYPDDPFDRXWESDSLRRANYLVDVAPGTERITTTKPVFVGTELEPPEKVMQTAVVGQNGSLNYRLDLEGFPGNAWAVSYFAEIEDLAPDETRKFKLVVPGMPLFSKPTVDVEENAQGKYRLYQPGYTNVTLPFVFSFEFKKTNDSSKGPILNAMEIYKHVQITMGSPDANTMSSLASRYPQAGWAQEGGAPRPPVSWTWVQCSSEAAPRVLSITLSEKNITGSIPEELTKLSALVELRLDGNSFSGGIPDFSGCRNLQYIHLENNQLNGALPSSLGDLPNLKELYIQNNRLSGHIPRALSKKSIIFNSSGNNLQGPSDSISHGTIIIIVCAVVGAILLLAVAIGCCLCTHKRKKKPSRETVVLAAPAKKLGSYFSEVATETAHRFALSEIEDATDKFERRIGSGGFGIVYYGKLADGREIAVKLLTNDSYQGIREFLNEVALLSRIHHRNLVTFLGYSQQDGKNILVYEFMHNGTLKEHLRGGPNDVKITSWVKRLEIAEDAAKGIEYLHTGCSPTIIHRDVKSSNILLDKNMRAKVADFGLSKPAVDGSHVSSIVRGTVGYLDPEYYISQQLTEKSDIYSFGVILLELISGHEPISSDNFGLNCRNIVAWARSHIESGNIDAIIDASLDTGYDLQPVWKIAEVGIMCVKPKGAQRPTISEVLKEIQDAIAIEVQREAPQVQQLMSKRSMGSVSINTDNSVDLEQNASFDEMLMRPGLR

SEQ ID NO: 17334 - protein, 921 aa, Oryza sativa (japonica cultivar-group)
MPSASAALVLLFVAFSLSNAQPGFISLDCGGDDDYTDGIGIQWTSDAKFVSAGQKANLLLQNQQLQQYTTVRSFPADNRKYCYTMNVRNRTRYLVRATFLYGNFDNSNVYPKFDLSLGPTPWTTVVIDDATTPVVQEAIILAAAPTLSVCLSNASTGQPFISTLELRQFNGSLYYTTDEKQFFLRLSARINFGAESNASVRYPDDPFDRIWESDLVRRANYLVDVAPGTERISTTKPIFVSTNEEPPQRVMQTAVVGKNGSLTYRIDLEDFPGNAWGVSYFAEIEDLTPNQTRKFKLVIPGKPEFSKPTVDVEENAQGKYRLYEPGYTNIPLPFVFSFGFKKTNDSSEGPILNAMEIYKYIEISVGSQDANIMASLVSRYPEAGWAQEGGDPCLPASWSWVQCSSEAAPRIFSISLSGKNITGSIPVELTKLSGLVELKLDGNSFTGQIPDFTGCHDLQYIHLEDNQLTGALPPSLGELPNLKELYIQNNKLSGEVPQALFKKSIIFNFSGNSDLRMGHSNTGRTIVIIVCAVVGAILILVAAIVCYLFTCKRKKKSSDETVVIAAPAKKLGSFFSEVATESAHRFALSEIEDATDKFDRRIGSGGFGIVYYGKLTDGREIAVKLLTNDSYQGIREFLNEVTLLSRIHHRNLVSFLGYSQQDGKNILVYEFMHNGTLKEHLRGGPDDVKINSWVKRLEIAEDAAKGIEYLHTGCSPTIIHRDLKSSNILLDKNMRAKVADFGLSKPVVDGSHVSSIVRGTVGYLDPEYYISQQLTEKSDMYSFGVILLELISGHEPISNDNFGLHCRNIVEWARSHMESGDIHGIIDQSLDAGYDLQSVWKIAEVATMCVKPKGVLRPSISEVLKEIQDAIAIELQRELPSSIHHLMSKTSPSEAVNTTGSLQDLEQNASFDELLMRPGLR

SEQ ID NO: 17335 - protein, 542 aa, Vitis vinifera
MQTSTYAAKGSIGLELQNRRVFPRFGEFRKQSSCVKNLRVTNNTTSSGLRIGSVVMGAEFGRPRTRIEAVFRPRSVKARASGGDIEDVDVTAPQGKSSGTVLPFVGVACLGAILFGYHLGVVNGALEYLSKDLGIAENAVLQGWVVSTLLAGATLGSFTGGALADKFGRTRTFQLDAIPLAVGAFLCATAQSVQTMIIGRLLAGIGIGISSALVPLYISEISPTEIRGALGSVNQLFICIGILAALVAGLPLARNPLWWRTMFGVAVVPSILLALGMAFSPESPRWLFQQGKISEAEKSIKTLNGKERVAEVMNDLREGLQGSSEQEAGWFDLFSGRYWKVVSVGAALFLFQQLAGINAVVYYSTSVFRSAGIASDVAASALVGASNVFGTAIASSLMDRQGRKSLLITSFAGMAASMMLLSFSFTWSALAPYSGTLAVLGTVLYVLSFSLGAGPVPALLLPEIFASRIRAKAVALSLGMHWISNFVIGLYFLSVVNKFGISTVYLGFSAVCLLAVLYIAGNVVETKGRSLEEIERALNPAT

SEQ ID NO: 17336 - protein, 461 aa, Photobacterium sp. SKA34
MKHPNVLQITLVVALGGLLFGYDTAVISGATESLQTFFNLNPAELGFAAASALIGCVIGAIAAGYTSTKYGRRGALLIAALLFFISALGSAIPDQYWTFIFYRIIGGIGVGIASMVSPMYIAEIAPPQKRGALVSCNQFAIIFGMLVVYFVNYGIALMGSESWLNEMGWRYMFGSEMIPAGLFFCLLFSVPETPRWLAMRGRDEQAKELLSKISKGKDFDNQWKEIKDSLVEVGTASVTSRKILPILVIGIMLSVLQQVTGINVFLYYAPVILKSFSSSSTDLALLQTILVGAVNLTFTVIAIITVDKYGRKPLMMLGSGLMAVSMIAIGTAAYLNAIGGYLLFFVLTYIAAFALSLGPVTWVLLSEIFPNNVRSKALSIAVFAQWVANYAVSQTFPMMNDQNSWLFKEFNGGFPFWFYGVMGLVTIYFVHRFVPETKGKSLEELEELWEKPDELETVTHN

SEQ ID NO: 17337 - protein, 751 aa, Thermotoga maritima MSB8
MCGNAHPRLMTAHDRIRLMLLSRVIIFSTEGEFGGEIVINRTEIETEAKVVIRELESLKKKSFTREEKKLLIKAYEFARIVHEGQKRFSGEPFITHPVEVTKILAGLGVDVTTLVAALLHDVVEDGENVSLDQIKKEFGPEVARIVDGVTKVSNINAPIGRDQDSRKKIETIQKMFFAMAEDMRVIFVKLADRLHNMRTIHYVQDPEKKRYKAYETLEIYAPLAHKLGIYSIKSELEDLAFKVLYPEEYYKIKELVAEKRKEREKRTNEYISLLKSALEEHKIKAIVEGRYKHYYSIWRKMKEKGKKFEEIYDLIALRVIVKDVTTCYTVLGIVHNIWKPLPGRFKDYIAAPKSNGYRSLHTTVITGYGEPLEIQIRDEEMHREAEYGLIAHWIYKERPDVKTAKEWIERLLDWRKELAQGFTEFEDIKKELQMDEVFVFTPKGDILHLPKGSTPIDFAYAIHTEIGHHYSGAKVNGKIVPIDYQLKNGDVVEIIVNKNSPGPSVDWLKYAKTHSARAKIRRFLKEKLAPELVERGKEVLRKICRKLGKSFEEVMQTEGIKRYLNTYQEKDFFMRIGEGSITTQDLIEAILGKKIVVKKRSTKKKTRIQNLVKVDGIDSIEFHIAKCCHPIMGDPIVAVVSRRGMTIHRRDCRNLKNMSQDRIFPAEWNLETSEMFDAHIRVVLNSEKNLPSLIDRITNLGAEFVAMKTLKSEEPLVVQIHIKISNTVELTGLLDRLRSYRYVLDAERVVQ

SEQ ID NO: 17338 - protein, 1182 aa, Cryptococcus neoformans var. grubii
MFVTRPPSSSVDHRGSLLDGHTNHTNTPGSSRDDVPSSDSTSTAFHKFKNSSRFSPHYLNIPPGLAFKSYLEKWGPEQVIGFLAIHGCEHHSGIFIKNSIDGKLLLDLDMGILTSLGITKVGERIRLMAGIKCLRQRVAHEAEKHNIPSAHLCNGSLEMDRVKVIIHPKLSASLYVHRHGPFDSGPITARRCPLTPSSSADPEGDPSPMQRSQEVMKHSFITRSSRRQVIPPLPPGQIHNHGIDNSPMPSLRHIPLRSGVSYSDIDVKGMPPLVTQSTNSVFNHTFAVTGSHDTTSCLGGHLRRPDYFRSTNDTFQTCTKRGDNTISELPQRNQESSPSMWKQSGVICEDKAMRNGSLFAPTSHKPFAISITGDNVMEYPHNLPIKNGLPLRSFQSPDKSADDDRLNINPSAPSLDDLRRQLVKFVNAEDGTTRTVNVMKTTSGVEVLERALRKFGKTGTGRALLLDDESHNGGKHEGPLCIDGWGVFAENLQGEEMGPMSEEDLLDICASLRNGAAMQRDALILRQTSKSQKRKDMRFYLGSMPVLPTPVNLPISFSSSHSGQFEQNSALQYTAQHQPLRSKNRSRASMMSIMSGLGVSHPDIKQPTHDSLQSPASVTMPSSKKKSMYNFFGHRPPSELISSHLTDYFPSAKKRDVAKARGSMLRLNIAHSAERNPRSVENLGMIEADDVPFSSTEQSLTEQRDHYFDSSTCQPADTSSPGHVDHNITDPAGNSEGNYRLPYDQKVLPTPITQELHSANSVNPILRTYPPNLPSTYLSARLTDLHRDSFLSQLQPLQHSSSLSSAQPFSSHRRTVDEITAEMQHRQTSLSCDRPTSTIDSDISGPPCNSEISLDHTSEASGISESSSEYCDDHSSVSSEDSEDNSAAHTRAFTTKRNIKWIKGALIGAGSFGSVFLGMDAQSGLLMAVKQVELPRGIAKMEARRRDMLSALEREIELLKDLQHDNIVQYLDSSMDANHLNIFLEYVPGGSVAALLNNYGAFEEALAGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPEIPSDISVHAADFLSRAFALDYRMRPSAASLLKHAFMVHDGNGGNDEPIQNTYA

SEQ ID NO: 17339 - protein, 746 aa, Candida albicans SC5314
MSVIAGHHVPRSNDQRQYDTPSVPINIAPDSEGHIHEMSRLKDYEVIEKLGQGTFGVVQKAKSKKDGSLVAIKQLINHSAKEGFPITAMREITILKQLNHKNILTIQDMIFEEPKMSNRTDIITMRGSFYTVTPYMSSDLVGLLENPKIKLELGQIKCIMQQLLKGIQYVHNQKFLHRDIKAANILIGQDGVLKIADFGLARIYHGNVPRLGMGPGGGEKAYTGLVVTRWYRPPEILLGERKYTTAVDLWGIGCVFAELFTGKPILVGKSDSHQAQIVFELVGSPLTWTDAAKLPNKNEYSCGLACKRSLEAKFASIMPTEAIDLLSGLLTLDPFKRLNALDALNHKFFSTDPLPLLPTQMPKFEESHEIDKERFKKLKDKEQAVSELKPPTEIRYDNHSESRYNADHSTFGGGGVGGKETSFSSGKSDYIDHYEPRARRDHYEPRIRNDNKDSNDVRGEFESATRQEQRRRDIQNRLDAGGMDTYIPKTTTAKLREHSGTESLSKKYDNYQPINVSRGSKSPSPSKLSSISQSKADLISKPSAPKVASRESSLERKQVSNGIRTTTDVEPPRARARRPTDMFGRPLTSNSTQAQPTRNKSVERPKDLEKPTNGVTEDRNKKPVLEEKKEVVKPNLAIPKIKKSSSLVSLSSRSSTTPVISNPSKVTKRAASSVTPPVLPKKPKISKTSSESEVSDLEEDSDFTGENATVFERFMALEQLQKSPVYKRIINEKMRFEKLSGGHKSM

SEQ ID NO: 17340 - protein, 554 aa, Candida albicans SC5314
MGSSTNNTQSKATPSVLENEVNSSKSSVVSSTSSAKGLLRETTNHGTMETSSVQISESESRPSKMVLVLTLASSISGFMFGYDTGYISSALVQIGTDLSNKILTSGEKEFITSATSLGALLGAVVGGVLANLIGRRRVLLGSNIIFVVGTIIQLAARTVWTMIAGRFVLGWGVGIASLIAPLMISELAPAKYRGRLIVTNVIFITGGQLIAYFINWGLTRVSHGWRVSVGLCMVPPVLQFVLFWFLPDTPRFYVMNGNFEKARQVLRKVHVDPSDEFVNATIDEMIASDSTVPGNGPLQKAWKSIKIIHTTPGNFRALILACGLQGIQQFTGFNSLMYFSATIFETIGFHNATAVSIIIAATNFVFTGIAICIIDKVGRRRILLVGMPCMCISLIVCAVAFHYLNVDFSTGTVVSRGINGWGIVVIIGMILYVASYAIGIGNAAWVGVEMFSDVNVRSIGAMYAACTNWAGSLVIATTFLTMLENITPTGTFSFFAGLCFIAFFFVYFLLPDTAGLELEETTDFLSNGFNVKQAAQLSKERKKHSKFAKSKPTV

SEQ ID NO: 17341 - protein, 267 aa, Musa acuminata
MASPRHSHSSVGPQSRDSSSSRFSGGIKPGGGPRKMSSHDDRKGGRSKSDKAWKECATIEEEGLLEDEREEKGLPRRCYSLVFLLGFVILFSFFALILWGASRSQKPEITMKSVRFENFIIQAGTDASLVPTDMATLNSTVRFSFRNTGTFFGVHVSATPFVLSYDQLTLAGGEMNNFYQSRKSQRNVEVVVLGKKVPLYGGGPSLASSPGSVATVPLSLSFMVKSRAYVLGKLVKPKFEIGVQCKVVMKPAQLNTRVSLKNSCQYY

SEQ ID NO: 17342 - protein, 140 aa, Oryza sativa (japonica cultivar-group)
MRKYRVAGLVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANA

SEQ ID NO: 17343 - protein, 342 aa, Arabidopsis thaliana
AVVIVLIGLGAWAIVSITPPPPKRCGTPGGPPITAPRIRLSDGRYLAYEEHGVSRQNATFKIVFIHAFSTFRRDAVIANRVRPGFLEKNGIYVVSYDRPGYGESDPHSSRNEKTLAHDVEQLADQLQLGSKFYVVGYSMGGQAVWGVLKYIPHRLAGATLLCPVTNSWWPSFPDSLTWELWNKQSKSERFSMLITHHTPWLLYWWNNQKLFSTTAVMQSSPNMFSPQDLALLPKLAARVSYKNQTTQQGTHESLDRDLIVGFGKWSFDPMKIENPFPKGEGSVHMWQGDDDRLVPIQLQRIIAQKLTWIKYHEIPGAGHIFPMADGMAETILKELLPIPQSS

SEQ ID NO: 17344 - protein, 473 aa, Bacillus thuringiensis serovar konkukian str. 97-27
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFIDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTNTTEVESL

SEQ ID NO: 17345 - protein, 333 aa, Saccharomyces cerevisiae
MSEPSEKKQKVATSSLDQLKKAGTHVVADSGDFEAISKYEPQDSTTNPSLILAASKLEKYARFIDAAVEYGRKHGKTDHEKIENAMDKILVEFGTQILKVVPGRVSTEVDARLSFDKKATVKKALHIIKLYKDAGVPKERVLIKIASTWEGIQAARELEVKHGIHCNMTLLFSFTQAVACAEANVTLISPFVGRIMDFYKALSGKDYTAETDPGVLSVKKIYSYYKRHGYATEVMAASFRNLDELKALAGIDNMTLPLNLLEQLYESTDPIENKLNSESAKEEGVEKVSFINDEPHFRYVLNEDQMATEKLSDGIRKFSADIEALYKLVEEKM

SEQ ID NO: 17346 - protein, 511 aa, Cryptococcus neoformans var. grubii
MFARQPLSRNLLRPLSRPSSSFSRASTIPKLAFLQSARGFASASEPYDVVIIGGGPGGYVAAIKAAQLGFKTACIEKRGALGGTCLNVGCIPSKAMLNNSHIFHQTQHDLKNRGIDVSGIQLNLPKMLAAKEASVKALTGGIETYLFKKNGIDYIKGEASFETANKVNVKLLEGGETQVEAKNIIIATGSEVTPFPGLEIDEERIVSSTGALELKEVPKKMVVIGGGVIGLELGSVWSRLGAEVTVVEYLGAIGAGMDSEVGKQFQKILTKQGFKFKLNTKVVSGHREGDIVKLKVDSAKGGKEETIEADVVLVAIGRRPVTTGLNLEAIGVETDKRGRIIIDDEFNTSAKGVKCIGDVTFGPMLAHKAEEEGIAAIEILKSGHGHVNYDAIPSVVYTHPEVAWVGKNEEELKAAGVQYKIGKFPFAANSRAKTNQDSEGFVKFVVEKETDQVLGCHIIGPAAGELIASAVLAMEYKASAEDIARTCHAHPTLSEAFKEAALSSYDKPINF

SEQ ID NO: 17347 - protein, 169 aa, Zea mays
MAPTVMMASSATAVAPFQGLKSTASLPVARRSSRSLGNVSNGGRIRCMQVWPAYGNKKFETLSYLPPLSTDDLLKQVDYLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 17348 - protein, 1071 aa, Methanosarcina barkeri str. Fusaro
MPKREDIKKVLLIGSGPITIGQAAEFDFSGSQACRSLKEEGIKVVLVNSNPATIMTDPEMADSVYIEPLDAKIVEKIIEKERPDGIIAGIGGQTGLNITSELAEKGVFEKYGVEILGTPVEAIKNTEDRELFKETMLRIGEKVPLSRAVNSLKEAEDVVDELGLPLIVRPAYTLGGAGGGIARTKEELLEITERGLRRSRINQVLIEESVLGWAEIEYEVMRDENDTCIVICNMENIDPMGVHTGESAVVAPSQTLSDAEHQMLRSASIKIIRALKIEGGCNIQYALKEGDYRVVEVNPRVSRSSALASKATGYPIARVTAKIAIGMKLDEIINNVTKSTPASFEPALDYVITKIPRWPFDKFTTADKTLTTAMKSTGEVMAIGRTIEESLLKAFKSLDIDNQLGNKHWDEPETKTLLKTPTSERLFVIFDALEKGMSVKEIFELSSINPFFISKIKRIVDMEKRIRAEELTPELLREAKKMGFPDTRLAELTGSTRQEISDLRHKAGILATFKMVDTCAAEFEAATPYYYSTYEDSCETNATTDKKKILILGAGPIRIGQGIEFDYCTVHAVTALREEGIETHIINNNPETVSTDFDTSDKLFFEPLTLEYVMNVIEREKPDGVLVQFGGQTSVNLAIPLKQELKRRTDLNTVILGTDPDDMDLAEDREKFYILMKELGVPQPEGGYATSHKEAIEVAKRIGFPVLVRPSYVLGGRAMEIVYDEIDLERYMKEAVRVSHEHPILIDDFLEAASEIDVDAVCDQKDVIIGAIMEHIEEAGVHSGDSACVIPPQSLSPEVLDQVRDYTRKIALALKVKGLINIQMAEKCGKVYVLEANPRSSRTIPFVSKSVGIPLAKIAAKVIAGHSLKSLGYTDEPKPKHVSIKEVLLPFDKLPGADPVLGPEMKSTGEVMGIDYDFGRAYYKAELAADNVLPLTGKVFLSIRNADKTELVDVAKKLQAAGLELMGTEGTVNYLARHGVFMDVVKKVHDGSPNVIDMMRRDEVDLIINTPTSKQSRRDGSRIRRAAVDFKVPYITTMQAAIAAAAAIETMKKGEELTIKSINEYHKEMEN

SEQ ID NO: 17349 - protein, 409 aa, Triticum aestivum
MAAATTTTSRPLLLSRQQAAASSLQCRLPRRPGSSLFAGQGQASTPNVRCMAVVDTASAPAPAAARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 17350 - protein, 377 aa, Mentha x piperita
MSALVNPVAKWPQTIGVKDVHGGRRRRSRSTLFQSHPLRTEMPFSLYFSSPLKAPATFSVSAVYTKEGSEIRDKDPAPSTSPAFDFDGYMLRKAKSVNKALEAAVQMKEPLKIHESMRYSLLAGGKRVRPMLCIAACELVGGDESTAMPAACAVEMIHTMSLMHDDLPCMDNDDLRRGKPTNHMAFGESVAVLAGDALLSFAFEHVAAATKGAPPERIVRVLGELAVSIGSEGLVAGQVVDVCSEGMAEVGLDHLEFIHHHKTAALLQGSVVLGAILGGGKEEEVAKLRKFANCIGLLFQVVDDILDVTKSSKELGKTAGKDLVADKTTYPKLIGVEKSKEFADRLNREAQEQLLHFHPHRAAPLIALANYIAYRDN

SEQ ID NO: 17351 - protein, 3971 aa, Bacillus subtilis
MYTSQFQTLVDVIRNRSNISDRGIRFIESDKIETFVSYRQLFDEAQGFLGYLQHIGIQPKQEIVFQIQENKSFVVAFWACLLGGMIPVPVSIGEDNDHKLKVWRIWNILNNPFLLASETVLDKMKKFAADHDLQDFHHQLIEKSDIIQDRIYDHPASQYEPEADELAFIQFSSGSTGDPKGVMLTHHNLIHNTCAIRNALAIDLKDTLLSWMPLTHDMGLIACHLVPALAGINQNLMPTELFIRRPILWMKKAHEHKASILSSPNFGYNYFLKFLKDNKSYDWDLSHIRVIANGAEPILPELCDEFLTRCAAFNMKRSAILNVYGLAEASVGATFSNIGERFVPVYLHRDHLNLGERAVEVSKEDQNCASFVEVGKPIDYCQIRICNEANEGLEDGFIGHIQIKGENVTQGYYNNPESTNRALTPDGWVKTGDLGFIRKGNLVVTGREKDIIFVNGKNVYPHDIERVAIELEDIDLGRVAACGVYDQETRSREIVLFAVYKKSADRFAPLVKDIKKHLYQRGGWSIKEILPIRKLPKTTSGKVKRYELAEQYESGKFALESTKIKEFLEGHSTEPVQTPIHEIETALLSIFSEVMDGKKIHLNDHYFDMGATSLQLSQIAERIEQKFGCELTVADLFTYPSIADLAAFLVENHSEIKQTDTAKPSRSSSKDIAIIGMSLNVPGASNKSDFWHLLENGEHGIREYPAPRVKDAIDYLRSIKSERNEKQFVRGGYLDEIDRFDYSFFGLAPKTAKFMDPNQRLFLQSAWHAIEDAGYAGDTISGSQLGVYVGYSKVGYDYERLLSANYPEELHHYIVGNLPSVLASRIAYFLNLKGPAVTVDTACSSSLVAVHMACKALLTGDCEMALAGGIRTSLLPMRIGLDMESSDGLTKTFSKDSDGTGSGEGVAAVLLKPLQAAIRDGDHIYGVIKGSAINQDGTTVGITAPSPAAQTEVIEMAWKDAGIAPETLSFIEAHGTGTKLGDPVEFNGLCKAFEKVTEKKQFCAIGSVKANIGHLFEAAGIVGLIKSALMLNHKKIPPLAHFNKPNPLIPFHSSPFYVNQEVMDFTPEDRPLRGGISSFGFSGTNAHVVLEEYTPESEYAPEDGNDPHLFVLSAHTEASLYELTHQYRQYISDDSQSSLRSICYTASTGRAHLDYCLAMIVSSNQELIDKLTSLIQGERNLPQVHFGYKNIKEMQPAEKDNLSKQISDLMQHRPCTKDERITWLNRIAELYVQRAVIDWRAVYSNEVVQKTPLPLYPFERNRCWVEAVYESAKERKEKGEVALDINHTKTHIESFLKTVISNASGIRADEIDSNAHFIGFGLDSIMLTQVKKAIADEFNVDIPMERFFDTMNNIESVVDYLAENVPSAASTPPQESVTAQEELVISGAQPELEHQEHMLDKIIASQNQLIQQTLQAQLDSFNLLRNNSHFVSKESEISQDKTSLSPKSVTAKKNSAQEAKPYIPFQRQTLNEQVNYTPQQRQYLESFIEKYVDKTKGSKQYTDETRFAHANNRNLSSFRSYWKEMVYPIIAERSDGSRMWDIDGNEYIDITMGFGVNLFGHHPSFITQTVVDSTHSALPPLGPMSNVAGEVADRIRACTGVERVAFYNSGTEAVMVALRLARAATGRTKVVVFAGSYHGTFDGVLGVANTKGGAEPANPLAPGIPQSFMNDLIILHYNHPDSLDVIRNLGNELAAVLVEPVQSRRPDLQPESFLKELRAITQQSGTALIMDEIITGFRIGLGGAQEWFDIQADLVTYGKIIGGGQPLGIVAGKAEFMNTIDGGTWQYGDDSYPTDEAKRTFVAGTFNTHPLTMRMSLAVLRYLQAEGETLYERLNQKTTYLVDQLNSYFEQSQVPIRMVQFGSLFRFVSSVDNDLFFYHLNYKGVYVWEGRNCFLSTAHTSDDIAYIIQAVQETVKDLRRGGFIPEGPDSPNDGGHKEPETYELSPEQKQLAVVSQYGNDASAALNQSIMLKVKGAVQHTLLKQAVRNIVKRHDALRTVIHVDDEVQQVQARINVEIPIIDFTGYPNEQRESEVQKWLTEDAKRPFHFHEQKPLFRVHVLTSKQDEHLIVLTFHHIIADGWSIAVFVQELESTYAAIVQGSPLPSHEVVSFRQYLDWQQAQIENGHYEEGIRYWRQYLSEPIPQAILTSMSSSRYPHGYEGDRYTVTLDRPLSKAIKSLSIRMKNSVFATILGAFHLFLQQLTKQAGLVIGIPTAGQLHMKQPMLVGNCVNMVPVKNTASSESTLADYLGHMKENMDQVMRHQDVPMTLVASQLPHDQMPDMRIIFNLDRPFRKLHFGQMEAELIAYPIKCISYDLFLNVTEFDQEYVLDFDFNTSVISSEIMNKWGTGFVNLLKKMVEGDSASLDSLKMFSKEDQHDLLELYADHQLRISSTLDHKGVRAVYEEPENETELQIAQIWAELLGLEKVGRSDHFLSLGGNSLKATLMLSKIQQTFNQKVSIGQFFSHQTVKELANFIRGEKNVKYPPMKPVEQKAFYRTSPAQQRVYFLHQMEPNQVSQNMFGQISIIGKYDEKALIASLQQVMQRHEAFRTSFHIIDGEIVQQIAGELDFNVRVHSMDREEFEAYADGYVKPFRLEQAPLVRAELIKVDNEQAELLIDMHHIISDGYSMSILTNELFALYHGNPLPEIPFEYKDFAEWQNQLLIGEVMEQQEEYWLEQFKQEVPILQLPADGSRAMEWSSEGQRVTCSLQSSLIRSLQEMAQQKGTTLYMVLLAAYNVLLHKYTGQEDIVVGTPVSGRNQPNIESMIGIFIQTMGIRTKPQANKRFTDYLDEVKRQTLDAFENQDYPFDWLVEKVNVQRETTGKSLFNTMFVYQNIEFQEIHQDGCTFRVKERNPGVSLYDLMLTIEDAEKQLDIHFDFNPNQFEQETIEQIIRHYTSLLDSLVKEPEKSLSSVPMLSDIERHQLLMGCNDTETPFPHNDTVCQWFETQAEQRPDDEAVIFGNERCTYGQLNERVNQLARTLRTKGVQADQFVAIICPHRIELIVGILAVLKAGGAYVPIDPEYPEDRIQYMLKDSEAKIVLAQLDLHKHLTFDADVVLLDEESSYHEDRSNLEPTCGANDLAYMIYTSGSTGNPKGVLIEHRGLANYIEWAKEVYVNDEKTNFPLYSSISFDLTVTSIFTPLVTGNTIIVFDGEDKSAVLSTIMQDPRIDIIKLTPAHLHVLKEMKIADGTTIRKMIVGGENLSTRLAQSVSEQFKGQLDIFNEYGPTEAVVGCMIYRYDTKRDRREFVPIGSPAANTSIYVLDASMNLVPVGVPGEMYIGGAGVARGYWNRPDLTAEKFVHNPFAPGTIMYKTGDLAKRLRDGNLIYLGRIDEQVKIRGHRIELGEVEAAMHKVEAVQKAVVLAREEEDGLQQLCAYYVSNKPITIAEIREQLSLELPDYMVPSHYIQLEQLPLTSNGKINRKALPAPEVSLEQIAEYVPPGNEVESKLAVLWQEMLGIHRVGIKHNFFDLGGNSIRATALAARIHKELDVNLSVKDIFKFPTIEQLANMALRMEKIRYVSIPSAQKISYYPVSSAQKRMYLLSHTEGGELTYNMTGAMSVEGAIDLERLTAAFQKLIERHEVLRTSFELYEGEPAQRIHPSIEFTIEQIQAREEEVEDHVLDFIKSFDLAKPPLMRVGLIELTPEKHVLLVDMHHIISDGVSMNILMKDLNQFYKGIEPDPLPIQYKDYAVWQQTEAQRQNIKKQEAYWLNRFHDEIPVLDMPTDYERPAIRDYEGESFEFLIPIELKQRLSQMEEATGTTLYMILMAAYTILLSKYSGQEDIVVGTPVSGRSHMDVESVVGMFVNTLVIRNHPAGRKIFEDYLNEVKENMLNAYQNQDYPLEELIQHVHLLKDSSRNPLFDTMFVLQNLDQVELNLDSLRFTPYKLHHTVAKFDLTLSIQTDQDKHHGLFEYSKKLFKKSRIEALSKDYLHILSVISQQPSIQIEHIELSGSTAEDDNLIHSIELNF

SEQ ID NO: 17352 - protein, 376 aa, Methanothermobacter thermautotrophicus
MDGKREIIETEITMGTVHSAAIEPYRVRLFVEDEIVRDAEITVGVNHRGIERIMEGLPVEKANSLTEKVCGICSGVHLWNSILVAEKGLGVEIPERASYIRIIVGELERIHSHLLYLAHGNEVLGHETFSMRLFYIRETVMELLRLIGGNRVQYGVPIIGGIRPRADLDEMKTQRISEGMDFIEEKVEAFAERFTSDPMVMSRITGVCPISRKDALRLHVTGPTLRATGVEFDLRTEMPCYDPFEFDVITQDGGDVRANLLMRVLEIFESINIIRQALRDLPDGRVVDRNWEMQDTGIVKSYVEAPRGRLYHSYAIEDGRVRGSIIRTPSMSNIGAMQYACIGHHITDAQLGIVQCDPCFTCTDRAIEIIDLNAER

SEQ ID NO: 17353 - protein, 322 aa, Xanthomonas campestris pv. campestris str. ATCC 33913
MTASPSKLAQLRDLSVVVADTGDYDAIKRLKPVDCTTNPTLVKKALDLPVYADLIERELAWGRAHGGEDRNSTINEVADRLTVGVGTMLSELVPGRVSTEVDADLAHDTQATIAKARKFIAMYAERGVSKDKILIKIAATWEGIEAARQLQQEGIDCNLTLIFNRSQALACAEAGVFLISPFVGRILDFFVAKGQTPASIDEDPGVVFVRGVYDEFKRRGSSTVVMGASFRSTAQIEALAGCDRLTISPDLLEKLDADHGDLPRKLSPLNADNAAITPINSDSFATDLAADDMATEKLASGIDTFAKDLEALRKTIADKLAG

SEQ ID NO: 17354 - protein, 306 aa, Nocardioides sp. JS614
MNSPGVLVIGEALIDIVEAPSGAVAEAPGGSPLNVAVTLGRLGVPVTLATALGDDERADRIQAHLADSGVALAAGARTLDRTASARARMQSDGSALYDLDVTWDPATPDPGGATAIHAGSIALFQEPGASRVGDVLRRAPAGAMISLDPNIRPSLLPGRRRVVAQFEQLAALAHLVKLSDEDAAWLYPDLTWRQVAQHLLRLGPTLVVVTRGGQGSHLAAAGITVDRPAITSVIADTIGAGDSFMGALIRQALALGVIDRLVSRSALGSHDLVTLGDAAGLVAAVTVSRVGADPPWDWEIDAALTE

SEQ ID NO: 17355 - protein, 444 aa, uncultured archaeon GZfos23H7
MEKEAKTKEGVFEAVEKQEVKFVRLWFTDILGQLKSFAITPKELEGAFDEGMGFDGSSIKGFARIDESDMVAKPDPATFQIVPWRPKEHAVARMFCDILQPDGSPYEGDPRYVLKRNLEQLEEEGYTFYIGPELEFFYLEDDKDPEVLDEGGYFDLTTLDAASDLRRDTILTLEEMGIEVEYSHHEVAPSQHEIDLRYKDALTMADQVMTHRIVVKEIAHQYGCYATFMPKPIFGVNGSGMHVHQSLFKGDRNAFFDLNNEYHLSEKGRGYIAGLLRHAPEITSVANQWVNSYKRLVPGYEAPVYISWARRNRSTLVRVPMYKPGKEKATRVEFRSPDPACNPYLAFSVMLAAGLAGIKNKYELPPPTEKDVYTMSKEEKEKEGITSLPGSLIEAISLTENSELMREALGDHVFNNFITSKKVEWDRYRVNVTEWELKEYLGVL

SEQ ID NO: 17356 - protein, 450 aa, Sulfitobacter sp. EE-36
MTLPPKPESRPAKVSLWRYARLFRQDILSAQPARLYRAWMAEFKTPFFRSYLINQPDLIQTVLKTRPDDYPKSDRIGEGLRPLLGNSVFLTNGAIWKRQRRIIDPAFEGGRLRETFPAIWDAAEAAAARLAPHDGAPLEVEAQTSHAAADVIFRTLFSIPIEHHMAREVFDEFKTYQRSQPILNIAAFVPLPRWLPRLFRRDTKRSAAKIRRLITALTAERMEAIKAGTAPDDLATKIMTTPDPEDGSTFTTDEMVDQVAIFFLAGHETSASALAWAMYLVATHPDWQDRLAAEAQAIDQCDFAVMGKLKQSRDVFREALRLYPPVPMMVREASCPATFRDRTVARGAQVVISPWHLHRHERLWDNPDGFDPARWHSENGKKCQREAYLPFSAGARVCPGAGFAMVEGPLILSRILRDYRIEVVGEKPPIPVAHLTVRSKDGILLRFVRR

SEQ ID NO: 17357 - protein, 288 aa, Oryza sativa (japonica cultivar-group)
MSAFAPSLPLHVAAAATAVASQGRRGRIKTTSTCWRRRAAVPVNMAAATSSALSKLAPLEAILFDIDGTLCDSDPIHFCAFRELLQQVGFNNGVPISEEFYSANISGGHNDDLARALFPDLDHDKAMKFMDDKEALYRRLAPEQLVAVEGLHDLCRWIKDHKLKRAAVTNAPRSNAELMLSLLGLTEFFPVLVIGSECDRAKPFPDPYLKALELIGASPDHTFIFEDSASGIRAGVAANVPVVGLTTRNPEKVLQDAGASLLIKDFQDPKLLSILEEIEPTVAAVEQV

SEQ ID NO: 17358 - protein, 214 aa, Cynodon dactylon
MIRSKEPADEQKASPAQCSTVAKLKTASSSLANLLSVFVGTNSPEPRPRRSFDADGVGLSIVAAMSRACLTVAEPIAIGAAARRRAREEVELSESYTCVITHMDAKDGSGRSVRKRVYFDFGDGSGRWLEEPGEAPAPAHDFLSRCCLCNKRLDGLDIYMYRGEKAFCSSECRCYQMLMDDHTDNCGSEAFKTGNHSTSPCSTPMAFSPSVVAA

SEQ ID NO: 17359 - protein, 366 aa, Mycobacterium smegmatis str. MC2 155
MIGKHFEPLGSMTAMSIWGLRHLPDFVAASAKSRLAPGAAAMRREEREQTTAAAVAALRNVVPPAELAAEWPAPQNLPPLWNVLEHRRSVYRTSVRYGDDPAQLLDVWRPKELPAQPAPVLLFVPGGAWVHGSRVLQGYALMSHLAQQGWVCLSVDYRVSPHHRWPRHIHDVKAAIAWARANVDKFGGDRHFIAIAGCSAGGHLAALAGLTPNHPELQGDLPDGADTSVDAVVGIYGRYDWEDRSTVERERFVDFLERVVVKRSIERHPEIFRLASPIAQVHADAPPFLVVHGSADTVIPVAQARSFVDRLGAASRAPVSYLELPGAGHGFDMTDGARTGAMATAIGLFLKEIHRNRTRNTAKAVI

SEQ ID NO: 17360 - protein, 380 aa, Oryza sativa (japonica cultivar-group)
MVAGAEVMHQVVPLLEASFHRRCSVKGVDEVSPPVEEMSPEAASEAAIEVPELMVKAPVESLQFSPNIRSGSFADIGPRRYMEDEHIRIDDLSGHLGSLLMCPAPNAFYGVFDGHGGPDAAAYMKRHAIRLFFEDSEFPQALEEDESFYESVEKSIHNAFLSADLALADDLAISRSSGTTALAALIFGRQLLVANAGDCRAVLCRKGVAVEMSRDHRPTYDAEHERITECGGYIEDGYLNGVLSVTRALGDWDMKMPQGSRSPLIAEPEFQQTTLTEDDEFLIIGCDGIWDVMSSQHAVTIVRKGLRRHDDPERCARELAMEAKRLQTFDNLTVIVICFGSELGGGSPSSEQAPIRRVRCCKSLSSEALCNLKKWLEPNE

SEQ ID NO: 17361 - protein, 894 aa, Musa acuminata
MNSVRSGFLIQAAFLVMISGSSNMGVSGLGSMSSIAVSYGENGPVFCGLSSDGSHLVACFGADASIVYGAPLRLPLLGLTAGDGFVCGLLLDTGQPYCWGSNIFVKMGVPQPMAEGASYSEISAGDDHLCALRKPAIDSRKGASLIDCWGYNMTASHEFDGSVAAITAGSVFSCGMFIHNRTAFCWGDETSSGVISLTPRNLRFQSISAGGFHVCGILENSQVFCWGRSLETQQLSLGHGDVKMVPMDPMVSVAGGRFHACGIKSLDHKAVCWGFMLQNSMPPPKDSRLYEIAAGDYFTCGVLAATSLRAVCWGTGVPWSIPMAVSPGICASNPCGQGYYEFSHTSWGNKVCKPADSRVCLPCSVGCPEGTYESTPCNLTSDHGCEFNCSSCASVECSSFCSSQKESKSKRLLSLQMPIFIAEIVFAIIFVSSVFLVACLYARHRLQSCRCLESAVTTSRKRTYSFHKEMVKVRPDLEELKIRRAQMFTYGELEKATSGFSEESLVGKGSFSCVFKGVLKDGTVVAVKRAIRVSDVKKNSKEFHTELDLLSRLNHAHLLNLLGYCEEGGERLLVYEFMAHGSLYRHLHGKDLCLRKRLDWVRRVTIAVQAARGIEYLHGYACPPVIHRDIKSSNILIDEEHNARVADFGLSLLGPVDSSSPLSEPPAGTLGYLDPEYYRLHYLTTKSDVYSFGVLLLEILSGRKAIDMQFEEGNIVEWAVPLIKAGDISAILDPVLKPPADLEALKKIAAMASKCVRMRGKDRLSMDKVTTTLERALALLMGSPCNEQPILPTEVVLGSSRLHNKASQRSSNRSCSENDTDDQIYEYRAPSWITFPSVTSSQRRKSSASEGDAEGKNSEGRSLGHGGAGDGLRCLEEEIGPASPQENLFLQHNF

SEQ ID NO: 17362 - protein, 199 aa, Brassica rapa subsp. pekinensis
MAMLGGVRDVPSNENSVEVESLARFAVDEHNKKENALLEFARVVKAKEQVVAGTMHHLTLEIIEAGKKKLYEAKVWVKPWLNFKELQEFKPSTTITPSDLGCKKGEGASGWREVPGDDPEVQHVADHAVKSIQQRSNSLFPYELQEVVHANAEVTGEAAKYNMVLKLKRGEKEEKFKVEVHKNHEGVLHLNHMEQQHHD

SEQ ID NO: 17363 - protein, 211 aa, Staphylococcus aureus
PSADMLFEPSFVNDIDVNENDVVHFCSVDLVDSPMRDAHYQLITKTLNANGTVVFDPNVRLPLWDNAEDLRQTIHTFLPLAHIVKVSDEELEFITDIDDENEAIQSLFKGNVTVVIYTKGADGAAIYLKNGINHYHSGYKVKPVDTTGAGDAFIGAVISRILATDVLNLTQLFENEGEEILAFSNSVAAIVTTKYGAINSLPTLQEVEQAF

SEQ ID NO: 17364 - protein, 420 aa, Arabidopsis thaliana
MALSSLLRSAATSAAAPRVELYPSSSYNHSQVTSSLGFSHSLTSSRFSGAAVSTGKYNAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDATYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 17365 - protein, 642 aa, Saccharomyces cerevisiae
MSSQFFLKTSQDIELFQSYPTFEQSNTNSKDFPVISSVLSPCGRFLALSTKENVKVFTGPCLDNVLLTMKLSDVYDLHFSPAGNYLSTWERASIQDPNHKNVKVWYLNKPFKKDCVSEDIVPAYEYQAKSQSGWFLQFSKLDNYALRLFKHDLKIVKLSSANADKFDFQSPFAVLSDDETSQHFTTYLISPAEHPTICTFTPEKGGKPAQLIIWALSEGKITKKIASKTFFKADSCQLKWNPLGNAILCLAITDFDSSNKSYYGENTLYLLSFQGVNGTLGGNSVRVSLTTGPVHDFTWSPTSRQFGVIAGYMPATISFFDLRGNVVHSLPQQAKNTMLFSPSGHYILIAGFGNLQGSVEILDRLDKFKCVSKFDATNTSVCKWSPGGEFIMTATTSPRLRVDNGVKIWHVSGSLVFVKEFKELLKVDWRSPCNYKTLENKDEAFFENHIINNWEPLPDSTTSSLDPKISNKSELQIHSSVQEYISQHPSREASSNGNGSKAKAGGAYKPPHARRTGGGRIVPGVPPGAAKKTIPGLVPGMSANKDANTKNRRRRANKKSSETSPDSTSAPSAPASTNAPTNNKETSPEEKKIRSLLKKLRAIETLKERQAVGDKLEDTQVLKIQTEEKVLKDLEKLGWKDE

SEQ ID NO: 17366 - protein, 245 aa, Bradyrhizobium japonicum USDA 110
MTGIAGKVIAITGASSGIGAAAARHLAERGAIVVLGARRADRLEMLAASIASKGGKASYLVTDVRQREDVAGLVGLATDRYGKLDVLINNAGIAPISLLDDLRVDDWDDMIDVNVKGVLYGIAAALPVFRRQGFGHFVNTLSTAGLKIVPTMAVYAGSKNAVRAISEGLRQEVGPSLRVTTISPGYVDTELPSSMTDSALREQGQASMKAMAIPASAIAEAMAFAIAQPDSVDVGEIVIRPTAQA

SEQ ID NO: 17367 - protein, 865 aa, Triticum aestivum
  misc_feature (72)..(72): Xaa can be any naturally occurring amino acid
  misc_feature (247)..(247): Xaa can be any naturally occurring amino acid
  misc_feature (819)..(819): Xaa can be any naturally occurring amino acid
  misc_feature (832)..(832): Xaa can be any naturally occurring amino acid
  unsure (1)..(865): unsure at all Xaa locations
MFGVGGIVSDLTGGLRGPHLKGSVVLMRKNALDFNDFGATVMDGVTELLGRGVTCQLISSTHVDHNNGGRGXVGAEANLEQWLLPTNLPFITTGENKFAVTFDWSVDKLGVPGAIIVKNNHAAEFFLKTITLDNVPGRGTIVFVANSWVYPQAKYRYNRVFFANDTYLPHQMPAALKPYRDDELRNLRGDDQQGPYEDHDRVYRYDVYNDLGDTRDVLGGSKDLPYPRRCRTGRKPSATKPDHESRXLLPLVGNVYVPRDELFGHLKQSDFLGYTLKALVDGIIPAIRTYVDLSPGEFDSFADILKLYEGGIKLPNIPALEEVRKRFPLQLVKDLIPMGGDFLLKLPKPQIIKADEKAWMTDEEFAREMLAGVNPMMIKRLTEFPPKSTLDPSKYGDHTSTITEAHIGKSLEGLTVEQALADNRLYIVDQHDNLMPFLVDINNLDGSFVYATRTLLFRRGDGTLAPVAIELSSPLIQGDLTTAKSTVYTPHHAGVEGWIWQLAKAYASVNDYGWHQLISHWLNTHAVMEPFVIATNRQLSVTHPVYKLLHPHYRDTMNINARARGLLINAGGVIEMTVFPRKHAMPMSSMVYKNWNFTEQALPDDLIKRGMAVEDPSSPHKVRLLIEDYPYAADGLEVWHAIEQWVTEYLTIYYPDDGVLQGDVELQAWWKEVREVGHGDLKDAAWWPKMHTVAELIKACATIIWTGSALHAAVNFGQYPYSGYHPNKPSASRRPMPVPGSEEYALLERDPEKAFILTITNQFQALVGISLMEILSKHSSDEVYLGQHETPAWTSDAKAQEAFRRFGARLEGIEKQVVXMNGDPRLKNRNGXGKFPYMLLYPNTSDHTGQAEGLTARGIPNSISI

SEQ ID NO: 17368 - protein, 549 aa, Bacillus subtilis
MAELIHSTIGRLLEQIAETYPDQEAVVYPDRKIRYTYAQFDSLCRRTAKGLMRMGIGKGDHVAIWASNILEWLAVQFATAKIGAVLVTVNTNYQAHELDYLLKQSDATALIVMDSYRGTSYTDILKSLIPELQETEPGQLKSERYPFLKTLIYIGDKRFPGMYHWDDTEILAKTVSDAELEARMNSLEKDDVINMQYTSGTTGFPKGVMLTHFNVINNAANIAECMVLTSQDRMCIPVPFFHCFGCVLGVLACVSVGATMIPVQEFDPVTVLKTVEKEKCTALHGVPTMFIAELHHPDFNAYDLSTLRTGIMAGSPCPSEVMKAVIEKMGMKDITIAYGQTEASPVITQTRANDSFLRRVETTGRALPHAEVKIVEPGTYQEVQRGGQGELCTRGYHVMKGYYKDEEATRKAINPDGWLFTGDLAVMDEDGYCRITGRLKDMLIRGGENIYPREIEEFLYRHPDILDVQVVGVPDAKFGEEAAAWIKLKDGKTASPEELKDYCKGKIARHKIPRYVIFTDEYPMTASGKIQKYKLREKTIEMFNLSSCQ

SEQ ID NO: 17369 - protein, 427 aa, Bradyrhizobium japonicum USDA 110
MTAIIDIIGREILDSRGNPTVEVDVVLEDGALGRAAVPSGASTGAHEAVELRDGDKARYLGKGVTKAVGAVNGEIFEALSGLDVEQQAQIDQIMIDLDGTPNKSRLGANAILGVSLACAKAAANSLDMPLYRYVGGTSARLLPVPMMNIINGGVHADNPIDFQEFMILPVGASSFAEGLRYGAEVFHTLKSELKKAGHNTNVGDEGGFAPNLPSADAALEFVMNAIGKAGFKAGSDIVIGLDCASTEFFKDGKYVYEGEGKTRSISEQAKYLADLVARYPIVTIEDGMSEDDMDGWKELTDLIGKKCQLVGDDLFVTNVKRLAEGIKAGRANSILIKVNQIGTLTETLAAVEMAHKAGYTSVMSHRSGETEDSTIADLAVATNCGQIKTGSLARSDRTAKYNQLLRIEQQLGKQALYGGKAALKALA

SEQ ID NO: 17370 - protein, 450 aa, Silicibacter sp. TM1040
MASVIYPTTNFTATEQLCITHGEGIYVYDDTGKQYIEGLAGLWCTSLGYSNTEVVEAITEQLKRLPFQHTFGGKTHAPVMELAEKLKAMVPVEDAYFFFGNSGSDANDSHYKMLRYYFNAIGKPHKRKIITRERGYHGVTVAAGSLTSLPANLAHFDAPLEALSILRTDAPHYYTGRQGNETEAQFVERILQNLEDQILAEDPDTIAAMIIEPITGASGVIVPPEGYYEGLQALLRKHGILIWADEVICGFGRTGADFGCTTMGIKPDLMTFAKQLSSAYFPISASVIPGWMYKAMVDQTNEVGVFGHGYTYSGHPAACAAALKTLEIYERDKIFDHAAEVGTYLQEQLRATFTDHPLVGEVRGKGLIAALELVSNKTTGATIAGGKGGAAAVKACQTEGVILRAVAGNALAFCPPLIITKPEVDEMLKRTKAGVDAAYEALRSEGLLNS

SEQ ID NO: 17371 - protein, 471 aa, Methanosarcina barkeri str. Fusaro
MAQEKTEEFEKAQGAEKPEKNKAMEKAMKAGQYFDFFEREAGMFNTIGPRAREIIEQDCKITSACTARPYPLVVDSAKGSVIRDVDGREYIDLIAGIAVMNAGYSNPEVKAAISAQLEKMTHCGYGDFFAEPPVKLAKKLEDLSGYSKVFYCNSGTEAVEAAIKLAFWKTKRQGLISFYNSFHGRTLGSLSLTCSKARQKEHFPVLHTAHSHYAYCYRCPFKLEYPSCGIECAKELENLIFRRELSPTDTAAVFVEPVQGEGGYIVPPPEFHKEVRRICTDNDVLLVADEVQAGCFRTGPFLAMENFGVRAEISCFAKALGGGLPLGAMLADRELMDWPQGIHSNTFGGNLLASAASLASLEFLEKENIEHRVKELGSQMKQRLRELQENFPCIGDVRGLGLMVGVEIVKPDKSIDPIQRDRILRKAFKEGILLLPCGDSVIRFSPPLVITDEELDSGLEKFQKALEKAGT

SEQ ID NO: 17372 - protein, 493 aa, Methanosarcina barkeri str. Fusaro
MVQEYKLFIGGEFKDSSTGETFEDINPATLENLATIQVAGAEDVDMAVEAAEAGFRLWNEVPAAKRAEVLFRAARILQERKEELSVLMTKEMGKVLPETRGDVQEAIDITNYAAGEGRRMLGETTTSELKEKFCMTILRPIGVVGLITPWNFPIAIPAWKVMPALVAGNAIVFKPASDTPLLAFKLIEVLSEAGLPPGVINLVTGPGGTVGKAVVQHPRIKAISFTGSLDTGKWIMEECSKTMKRVSLELGGKNPVIVMDDADLELALEGVLWGAFGTTGQRCTATSRLILHEKIKDEFIKRLLAKAKALSIGGGLLPETDIGPVINKAQLEKIERYVKIGKEEGATLLYGGNRIDPGLPGYFFEPTIFTDVRPDMRIAQEEIFGPVLGIFTVSDLEEAITLANSTKYGLSSAIYTGNIGNAFRAIEKVEAGITYVNAPTIGAEVHLPFGGVKGTGNGFREAGTEAVKEFSEVKAVYIDYSGMLQKAQIDSAE

SEQ ID NO: 17373 - protein, 195 aa, Silicibacter sp. TM1040
MRTAQVSRSTAETEISVSVNLDGSGTYDNQTGVGFFDHMLDQLSRHSLIDMTIRAKGDYHIDDHHTVEDTGIALGQALVQALGDKKGINRYGECHLPMDDAQVRAALDLSARPFLVWNVDLPTQKIGSFDTELVREFFQALATHGGITLHIDQIHGVNSHHIAEAAFKAVARALRTAVEVDPRKADAVPSTKGAL

SEQ ID NO: 17374 - protein, 624 aa, Bradyrhizobium japonicum USDA 110
MDTQPIRLPSVAGATRSAGYPTRPPLRRFLTDCHEEFRGDSSGELADYIPELKRANPDHFGIALVTIDGHVYEVGDSAVPFTIQSVSKAFVFALALETVGEERVSATIGVEPSGEAFNSIRLTNDNRPFNPMVNAGAIACSGLIYEVDGKGAFERVRSKLSEFAGRELGVDEAVHASETATGNRNRAIAWLLRNYAVLPDDVDAVLDVYFRQCAILVTARDLAVMAATLANRGINPVTGAQVITPHIVARTLSVMTSSGMYDYAGEWTYRVGIPAKSGVGGGIVAALPSQLGLGTFSPLLDNHFNSVRGLKVCEALSARFDLHMLNRNADVRTSVMADYDVYGISSRRSRQPHEQQILDERHSDIRIVELVGALNFGTIDYVTRRLTSEPPNAPLLIIDFRRVPDITAAGAELLGETLTALGNANVTTILSGLEEASAVWAAIAARTGDPRRLRRFALLDDAIEWAEDQVIYRFGGFTDVKESVHLGEQALLAELDTDEIAAIVKLSTTRHYTAGQRVIAAGAPANSLFFLQSGMVSVKLRSGVRLASLGPGMEFGEMAILERTRSADVFADTPVACLELPLDSFADYRRLHPETALKIMRNLAAILARRLVAANAKVDLLSAY

SEQ ID NO: 17375 - protein, 338 aa, Cryptococcus neoformans var. grubii
MFVPCISLHDFDDRRDEIIKELMDASMNVGFFTLCNHGISAEDVQAAFDLSNRFFSLPDEIKIKTPLNGKNAGWEKNTQVRPSTGTADQKESMQLQFARMEGLWPSDEDVPGFRTRTEKFMNQIQALSIKVMECFADGLGLPHDIFTESTVERGENDCQNVLRLLHYHSTEGKQFGPNLWRAGAHADFDILTMLFQRDGEGGLEVCPGRKVVGDFGMGQTWIPVEARQDTIVCNIGDQLMRWSDDQLKSTYHRVRLPESNERKGPRYSIAFFNQSRINTVIQGPQKKYPPITGGEFIAEAMAKNRMQSAEIARHAALETGEKVTTEVHFVPKHLQVVA

SEQ ID NO: 17376 - protein, 103 aa, Zea mays
  misc_feature (56)..(56): Xaa can be any naturally occurring amino acid
  unsure (1)..(103): unsure at all Xaa locations
MSGRGKAGKGLGKGGAKRHRKVLRDNIQGITKPAIRRLARRGGVKRISGLIYEETXGVLKIFLENVIRDAVTYTEHAPRKTVPPMDVVYALKRQGRTLYGFGG

SEQ ID NO: 17377 - protein, 128 aa, Vibrio angustum S14
MTKVLHTEQAPAAIGPYVQGVDLGNMVLTSGQIPVNPATGEVPEEIAAQARQSLDNVKAVVESSGLQVSDIVKMTVFVKDLNDFAAVNEVYGSFFDEHNAPYPARSCVEVARLPKDVKIEIEAIAVRK

SEQ ID NO: 17378 - protein, 211 aa, Staphylococcus aureus
PSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 17379 - protein, 593 aa, Pseudomonas syringae pv. tomato str. DC3000
MTADNALYIPPYKADDQDVVVELNNRFGAEAFTAQPTRTGMPVLWVERARLFEILTFLRNVPKPYSMLYDLHGVDERLRTNRRGLPGADFTVFYHLLSIERNSDVMIKVALSESDLSVPTITSIWPNANWYEREVWDMFGIDFPGHPHLSRIMMPPTWEGHPLRKDFPARATEFDPYSLTLAKQQLEEEAARFRPEDWGMKRSGQNEDYMFLNLGPNHPSAHGAFRIILQLDGEEIVDCVPDIGYHHRGAEKMAERQSWHSFIPYTDRIDYLGGVMNNLPYVLSVEKLAGIKVPEKVDVIRIMMAEFFRITSHLLFLGTYIQDVGAMTPVFFTFTDRQKAYTVIEAITGFRLHPAWYRIGGVAHDLPRGWEKLVKDFVDWLPKRLDEYTKAALQNSILKGRTVGVAAYNTKEALEWGVTGAGLRSTGCDFDLRKARPYSGYENFEFEVPLAANGDAYDRCMVRVEEMRQSIKIIDQCMRNMPEGPYKADHPLTTPPPKERTLQHIETLITHFLQVSWGPVMPANESFQMIEATKGINSYYLTSDGGTMSYRTRIRTPSFPHLQQIPSVIQGSMVADLIAYLGSIDFVMADVDR

SEQ ID NO: 17380 - protein, 181 aa, Triticum aestivum
  misc_feature (29)..(29): Xaa can be any naturally occurring amino acid
  misc_feature (38)..(38): Xaa can be any naturally occurring amino acid
  misc_feature (102)..(102): Xaa can be any naturally occurring amino acid
  misc_feature (112)..(112): Xaa can be any naturally occurring amino acid
  misc_feature (132)..(132): Xaa can be any naturally occurring amino acid
  unsure (1)..(181): unsure at all Xaa locations
STALLGNHTIRQHQIVAATEWTGGDYISXTMAWTQAEXLLARSWDAMMSLLLNGSLVQAWTSPGSLTGQIHNGTDDNSGLFVTGKPYMTFVAFFSDALDIFXVSDIMSTQGXHLNALLKLYSLLICVTLQHXPMYQEFLMDLADSVDTSKATSGPITGRMAPSLGAAGTMLDTRTINDLLV

SEQ ID NO: 17381 - protein, 873 aa, Ehrlichia ruminantium str. Gardel
MSERLIYYFSKNKCDGNLKLNHILGSKGANLAEMCNIGISVPPGFTISTAVCSHYNDNKLPDQISYLIQNAIEFLNNEVNLKFGDENNPLLLSVRSGSVSSMPGMLDTILNVGLNDKTVIGLAKKSGDLFAYDSYRRLIQMYAHTVLQVENSFFEEAIYKKKSVSTSKNEKISDPNIFKELIDEFKRIVKLHTNKDFPQDVNEQLYTAIYAVFRSWMNKRAITYRKIHNIPDNLGTAVNVQSMVFGNMSENSATGVVFTRNPSTGTKEIFGEFLISAQGEDVVSGTHSPLPLNKMKDLMPITHNELEQVCKKLELYYRDMQDIEFTIENGKLWILQTRSGKRSIQSAVKIATDMVKEKLISKEEAITRIDHKSFSKLFHPTLESSTNTDIIAYGLPASPGAATGQVVFTPSDAEQLKKEGKNVILIRQETNPEDINGMNSAVGIITLRGGMTSHAAVVARGMGKPCICSVNNIFIDKSEQFFYTNTGIKVYKGDNITINGCNGEVILGVIKTTLPKLDESFYDLMEWVDEIRTLKVMANADTPEDAEISMNFKADGIGLCRTEHMFFSDKRISIVQEMIVSDKKEERAVALEKLEIMQKEDFKKIFTHTLDKQVTIRLLDPPLHEFLPDNDDAIQEISSRTGKSLEKLKNRILYLLEKNPMLGHRGCRLAISYPEIYEMQVKAIFLAIKELQEETGIKEIIPEIMIPLIMSEEEIIVIKELVNNIAKQFDNPKYLLGTMIELPKAALIADKIAKHVQFFSFGTNDLTQTTLGVSRDDSASFIGTYRDLGIIKHDPFETLDTDGVGKLISIAVGLSKKESPDIKIGVCGEHGGNFESIQFFSRLNINYISCSPYRIPIARLIAAQCTIFNKDIN

SEQ ID NO: 17382 - protein, 610 aa, Pseudomonas chlororaphis
MCGLTGWVDYTRRLEGEDPAIRAMTNTLALRGPDAEGIWKHRHALLGHRRLAVIDLSGGTQPMVYRFADGQEVSLVYTGEVYNHDALRDQLRQAGHVFQTRSDTEVVLHAYLEWGERCCDHLTGMFAFALFDGRDGHLLLVRDRLGIKPLFYARHREGLLFGSETKAILAHPEFTTGLEVTGLVDVLTLSKGTAQTPFRNLMELLPGHFLSWRPNGQMKIQSYWKVRRQEHQHDLQTTVQQTRELVTHALGSQLHADVPVCSLLSGGLDSTTLTAIAQRIVKAKTGGNINSFSVDFTGQAEQFKSDDLRPDQDQPFALLAAEFIGSRHQTVLIDNEELVSYLAREEVFRARELPFTFGDMDTSLNLLFREIRKHSTVAISGEGADEVFGGYGWFRDPKVIASASFPWSSRVKLPAGFINADFNRQCDLAQYQQASYDDALLQVEHLAQDSPHERRMRELCHMHLKRWMVMLLDRKDRLSMCNSLEVRVPFTDHELVEYIYNVPWSIKSKDGEEKWLLKQACADFVPEAVLKRRKSPYPTSADLGYERFLRQSARQLLQDTGNPVFGIVSHAYMAEELRQPEGYFNTQISRHSLETALALDAWLRLHKISL

SEQ ID NO: 17383 - protein, 182 aa, Pseudomonas syringae pv. tomato str. DC3000
MFKYIGDIVKGTGTQLRSMVMVFGHGFRKRDTLQYPEEQVYLPPRYRGRIVLTRDPDGEERCVACNLCAVACPVGCISLQKAETEDGRWYPDFFRINFSRCIFCGLCEEACPTTAIQLTPDFEMADFKRQDLVYEKEDLLISGPGKNPDYNFYRVAGMAIGGKPKGAAQNEAEPINVKSLLP

SEQ ID NO: 17384 - protein, 234 aa, Solanum tuberosum
  misc_feature (30)..(30): Xaa can be any naturally occurring amino acid
  unsure (1)..(234): unsure at all Xaa locations
MRVIRSTAILILFLLSVFGLSEQGKAGGFXSEEMATLGGVHDSHGSSQNSDEIHSLAKLAVDEHNKKENAMIELARVVKAQEQTVAGKLHHLTLEVMDAGKKKLYEAKVWVKPWLNFKELQEFKHVEDVPTFTSSDLGVKQVEQTSGLKSVPVHDPVVEEAAEHAIKTIQQRSNSLLPYELQEIVHANAEMADDHTKLHLVIKTSRGGKEEKFKVQVQHNNEGAFHLNHMEPDN

SEQ ID NO: 17385 - protein, 481 aa, Triticum aestivum
IDYGRLLGGLLIEGFDERSCRSRYQFARYHRNAARVPSPYLIERLRRQEALQKKCGPGTKSYNNAAKQLMSTQSINGISDCNYLFLTIHAGMGNRMLEITSAFLYALLTGRVLLVDRYKQIANTFCEPFPGTSWLIPSDFPLSYNEFTKHSPESYGNMLQENVIRGNTYRSLASARPPYVYLHLDGDYAFHDKLFYCEDDQQFLQGVPWLIMRTDMYFVPSLFLIPSFQDELSKLFPEKDTVFHHLGRYLLHPTNDIWYSATTYYRAYLAKADKVVGIQIRIFEKKGILQRNGPFPHVLEQILSCAQGEKLLPEIGVTDEAAARNNRTIAVLATSLSSWYSDQIRERYSEHHTVDGTTVKVYQPSHEEYQKKKNRKHNMKALAEIYLLSMSDVLITSGFSTFGYVAQGLAGLTPWIMYRPENHVVPEPPCGRAMSIEPCFHQAPYFDCKAKRDADLGKVVPYVRHCEDVSWGLKIVNETRL

SEQ ID NO: 17386 - protein, 888 aa, Oryza sativa
  misc_feature (315)..(315): Xaa can be any naturally occurring amino acid
  unsure (1)..(888): unsure at all Xaa locations
MAPAAHRDGAAEAVGQRVFHFGKGRSDGNKTMKDLLGGKGANLAEMASIGLSVPPGFTVSTEACQQYQAQKAMPAGLWDEILAALTWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEXPYAELVENCKILESHYKEMMDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVIL

SEQ ID NO: 17387 - protein, 137 aa, Brassica napus
  misc_feature (135)..(135): Xaa can be any naturally occurring amino acid
  unsure (1)..(137): unsure at all Xaa locations
MGVYLSTPKTDKLSADGENSRVRFGLSSMQGWRTTMEDAHAALPDLDECTSFFGVYDGHGGKAVSKFCAMHLHKQVLINDANSSGDLPTSLHKAFLRMDEMMKGQRGWRELTELGDKGNKISGMIDDIIWPPKGXDS

SEQ ID NO: 17388 - protein, 266 aa, Cucumis sativus
AKRLKAEAVKDSKSLVLSMDDNEEVIDEFQGVKIWWTSSKTVPKTQSISYYPTSEERRFYKLTFHRRHRETILDSFINHIMEEGKAVELKNRQRKLYMNHSGESWRHKSSWRHVPFEHPANFRTLAMDPKKKQEIVNDLVKFKKGKEYYEKVGKAWKRGYLLYGPPGTGKSTMIAAMANFMEYDVYDLELTSVKDNTELKKLLIEISNKSIIVIEDIDCSLDLTGQRKKKKKTEEEGDEAKEIEKKAKEEEKKESKVTLSGLLNFI

SEQ ID NO: 17389 - protein, 144 aa, Glycine max
MGAFTEKQEALVSSSFEAFKANIPQYSVVFYNSILEKAPAAKDLFSFLANGVDPTNPKLTGHAEKLFALVRDSAGQLKTNGTVVADAALVSIHAQKAVTDPQFVVVKEALLKTIKEAVGGNWSDELSSAWEVAYDELAAAIKKA

SEQ ID NO: 17390 - protein, 423 aa, Ashbya gossypii ATCC 10895
MLRWIPTRICPRLCTRGFASSCARLAQGPAFFVKPITPNDLFVSCTVFNEKGAVTGVSERYPKLSFLRDRGLYPRDLRKLDTSSIEVIPSIVVKPTCILVNLLHIKAVIEKNRVYVFDTTSKEAAARLGVLMYDLESKLASHSSQPAQHYEHRALESILVNVMTCLETEFKHLSKQCGLVLNELEDQIDRDKLRDLLIHSKDLTSFYQKSLLIRDMLDELLESDEDLAAMCLSPAPGTVEADAAEVEMLLETYYKQCDEYVQQSGSLLQNIKSTEDVVNIILDANRNSLMLFELKVTIYTLGFTVATLLPAFCGMNLKNFIEESVWGFGGVLAVSAVAGLAVTASNFKALRNVARLTVMNSHSTSPGAKNISSARLHLDRDVPTLWMRLKTAFRTIWFGKSRPSRDGRQRDMIWKWLLDDTSK

SEQ ID NO: 17391 - protein, 251 aa, Bradyrhizobium japonicum USDA 110
MTDAIRPLIAGNWKMNGLKASAAEFDAMLNGAADVATKADLLVCPPATLIAAFADKARGKKVAVGAQDCHPKASGAHTGDIAAEMLANAGATAIIVGHSERRADHGEGDALVRQKAEAAWRAGVTAIVCIGETQAQRDAGQTLDILRGQLDGSLPDGSTAANLVVAYEPVWAIGTGLTPTVQDVEQIHGFIREFLTSRFSVDGAKMRILYGGSVKPSNAAELMAVKNVNGALVGGASLKAADFLAIAKGCP

SEQ ID NO: 17392 - protein, 278 aa, Triticum aestivum
  misc_feature (245)..(245): Xaa can be any naturally occurring amino acid
  unsure (1)..(278): unsure at all Xaa locations
AHHQRLGSPREGKRPGLVGTTHSYPQRTGRTARPVCVHVCPNLLHAFPPSLPLSSPPSLCSFLPSKRQSRTPGSSNQAMSLAPSIPSIKVKVGRIAPPPPYRACRSFAVIRSSKAEGPRRPAAPPLSPPPPMPPKTPALSTPPSLSQPPTPVKPAQPSPPPPETKPAVATAAATPPVGGVVTFEYQRKVAKELQEYFKKKKLEETNQGPFFGWLAKNEIANGRWAMFGFAVGMLTRVRNRLGFRXANEDPSLQFWDCGFGIDGSCLAVLVLYFYKSEV

SEQ ID NO: 17393 - protein, 361 aa, Xanthomonas campestris pv. campestris str. ATCC 33913
MSVSFASTRSPSPRSADELSVILAAPGFGLHFTDHMVAISWTNELGWHDAQVRAYGPLQLDPAASVLHYGQEIFEGIKAYRHADGSIWTFRPQANGERLQRSARRLALPELPVDLFVESLRQLVAVDAGWVPSAPETSLYFRPFMIADEAFLGVRAAHKASYYVIASPAGPYFAKGVAPVSIWLSTEYARAAKGGTGAAKCGGNYAASLLPQQKAYAQGCSQVLFLDPVEGKYIEELGGMNVFLVYKDGTLVTPELSGSILEGITRDSILQLARDRGMQVVERKVSIDEWKDGVASGEISEVFACGTAAVVTPIGELKGDGFAVGDLSAPAGEVTMSLRQELTDIQYGRVPDRHGWLVRLS

SEQ ID NO: 17394 - protein, 331 aa, Oryza sativa
  misc_feature (324)..(324): Xaa can be any naturally occurring amino acid
  unsure (1)..(331): unsure at all Xaa locations
MAEVQSVQALASSLAALPPEFVRSEHERPGATTFRGGDAPEIPVIDMAAPESAARVAEAAAEWGLFQVVNHGVPAAAVAELQRVGREFFALPQEEKARYAMDASSGKMEGYGSKLQKDLEGKKAWADFFFHNVAPPAMVNHDIWPSHPAGYREANEEYCKHMQRLARKLFEHLSTALGLDGGAMWEAFGGDELVFLHKINFYPPCPEPELTLGVAPHTDMSTFTVLVPNDVQGLQVFKDGHWYDVKYVPDALIIHIGDQIEILSNGRYKAVLHRTTVDKDRTRMSWPVFVEPPPEHVVGPHPQLVTDGSPAKYKAKKFKDYRHXKINKLPM

SEQ ID NO: 17395 - protein, 577 aa, Solanum tuberosum
MRGFTYLSKVLHSHSSYSKLLVLCSVSTGGLLVYAESNVESGKQVVEQNQPESKKKRVVVLGTGWGGTSFLKDVDISSYDVQVVSPRNYFAFTPLLPSVTCGTVEARSIVEPVRNIIKKRSGEIQFWEAECLKIDPVNRTVSCRSGINDNLAGHNDFSLQYDYLVVAVGAQVNTFNTPGVMEHCHFLKEVEDAQRIRRTVIDCFEKSVIPGLSEEERRTNLHFVIVGGGPTGVEFAAELHDYVYEDLVKIYPSVKDFVKITVIQSGDHILNTFDERISSFAEQKFQRDGIEVSTGCRVTSVSDHFINMKVKSTGKHVEVPYGMVVWSTGVGTRPFVKDFMEQVGQEKRRILATDEWLRVKGCSNVYALGDCASVDQHKVMEDISTIFEAADKDDSGTLSVEEFRDVLEDIIIRYPQVDLYLKNKHLLEAKDLFRDSEGNEREEVDIEGFKLALSHVDSQMKSLPATAQVAAQQGTYLARCLNRWDQCKSNPEGPRRFKSSGRHEFLPFEYRHLGQFAPLGGDQAAAELPGDWVSMGHSTQWLWYSVYASKQVSWRTRYLVVGDWVRRYIFGRDSSRI

SEQ ID NO: 17396 - protein, 1614 aa, Gibberella zeae PH-1
MADERPTPRDEDIPGGFPVTPSVNSMNQLTPTIDTADRLEAGFAGRDTDASAGYTTYDNVTSEPGHDNGYRYSGNGTSAALGASAVGAAAGGYLASQHPHEDNIPAQQTETSNAPPPLSERRSSSSTILAPHHDASPTEKRKSSTIANDDSSAVPSTPDDPIFAPIKSNTNEKPDRPPYEKRKSHRTEDDLFRVLSRRKTNASTPAEKEEEQEDNEELNRLMSRIFGQKRQQQSEGEKTRHSGVIFRGLTVRGVGLGSSLQPTVGDFFLGLPRKLGKLFTQGPKAALAKPPVRDLISNFDGCVRPGELLLVLGRPGAGCSTFLKTFCNQRAGFESVEGNVTYGGTDSSVMAKDFRGEIIYNPEDDLHYATLSVKRTLTFALQTRTPGKESRLDGESREDYVREFLRVVTKLFWIEHTLGTKVGNEFIRGVSGGERKRVSIAEAMITRASVQGWDNSSKGLDASTAVEYVKSIRAMTNMADTSTAVSLYQAGEQLYDLADKVLLIDHGQCLYFGRSEDAKNYFLNLGFDCPERWTTADFLTSVTDDHERSIRKGWENRIPRTPEAFADAYRRSEDYQKNLRDIDEFEAELQTLAEERRAHESEKSKKKNYEIAFHKQVMACTHRQFLVMFGDKASLFGKWGGLLFQGLIVGSLFFNLPDTAAGAFPRGGALFFLLLFNALLALAEQTAAFESKPILLKHKSFSFYRPSAFAIAQTVVDVPLVFIQVIIFNVLIYFMAHLARTASQFFISCLILWLVTMVTYAFFRAISAWCGTLDVATRFTGVAIQILVVYTGYLIPPDSMHPWFGWLRWINWIQYGFECLMANEFYNLELSCEGQYLVPQGPGVQPQNQGCALAGSTRGSTTVSGADYIQQSFTYTRSHLWRNFGFLWAFFFFFVFLTALGMELMKPNQGGGAITVFKRGQVPKKVEESIATGGRAKGDNKDEESGQGNTVATGAERTKTDEQVTQEVAKNETVFTFQNINYTIPFENGERKLLQDVQGYVRPGKLTALMGASGAGKTTLLNGLAQRLKFGTITGDFLVDGRPLPKSFQRATGFAEQMDIHEPTATVREALQFSALLRQPQEVPKEEKMAYCETIIDLLEMRDIAGAIIGAVGEGLNAEQRKRLTIGVELASKPELLMFLDEPTSGLDSGAAFNIVRFLRKLADAGQAVLCTIHQPSAVLFENFDELLLLKSGGRVVYHGPLGHDSENLINYFESNGGPKCPPHANPAEYMLDAIGAGNPDYDGQDWGDVWADSSEREKRAKEIDEMIENRRNVEPSKSLKDDREYAMPISTQTWAVVRRSFISYWRSPDYIFGNMMLHVATGLFNCFTFYKVGFASIDYQNRLFSIFMTLTISPPLIQQLQPVFLKSRQIFQWRENNAKIYSWFAWTTAAIIVEIPYRIVAGGIYFNCWWWGVFGWRASSFVSGFAFLLVLLFELYYTSFGQAIAAFAPNELLASLLVPIFFLFVVSFCGVVVPPEGLPTFWREWMYWLTPFHYLLEAFLAAVIHDQPVRCEQGEFARFEPPSGQSCAEYTKSFVEMAGGYVQTGENGICEFCQYEIGDQFGATFSVYYRHIWRDFGIFCAFIAFNYAVVYFATWLKFRGKNPLKKIMQKRKS

SEQ ID NO: 17397 - protein, 542 aa, Nocardioides sp. JS614
MDAVTTPPAPTNEPNLTYAPGAPERATLVAEIEKLQKTQKTLHAYIGGRWRAGGGAEIPVVQPHDHQHVLGTMKNSTQADARAAITAASDAAPQWRDMTFDDRAAVLLKAADLLAGPWRQRLNAATMLGQSKTAFQAEIDSACELVDFWRFNVHYAKQILTDQPIANSPGVWNRTDHRPLEGFVYAITPFNFTAIAGNLPTAPVLMGNTVLWKPSSTQQLAASLTMELLEEAGMPPGVINMLPGDGLAVSEVALAHPDLAGIHFTGSTPLFQRLWKTVGENIARYRSYPRLVGETGGKDFIVAHASADPDVLRTAMIRGAFEFQGQKCSAASRAYVARSVWNKMKDSFLSEIESLTVGDPTDFSHFMGAVIDDRAFARHRAAIDRAKRSGKLDILAGGTLDDTVGWFVRPTAIESGDPTDEIFTTEYFGPILAVHVFDDGDFEKVVHAMESSTPYALTGSIIARDRRTIAWAQETLRFAAGNFYVNDKPTGAVVGQQPFGGGRASGTNDKAGSAANLLRWTSPRSIKETFDPPTDYRYPHLG

SEQ ID NO: 17398 - protein, 129 aa, Methanosarcina barkeri str. Fusaro
MFCNLSPMIDFDALKSEKGLILAVVQDQLSREVLMCAYMNREALEKTVETGITHFWSRSRQQLWKKGETSGHVQKVKEIRVDCDMDSLLLLVEQVGGACHMGYRSCFYRNLEGEVVGEKVFEPDEVYKS

SEQ ID NO: 17399 - protein, 379 aa, Cryptococcus neoformans var. neoformans JEC21
MFARSASKSVVSSLRTVQAPVGVRYYASAFNSSTPTSAFAGKKGADGNYTVTLIPGDGIGPEIANSVKQIFKAAQVPIVWEEVDVTPILKDGKTVIPDDAIKSIKKNTVALKGPLATPIGKGHVSLNLTLRRTFSLFANVRPCVSIKGYKTPYDNVNTVLIRENTEGEYSGIEHEIVDGVVQSIKLITREASERVARYAFHYASESGRNKVTAVHKANIMKMSDGMFLTACRDVAKEYPNISYDEDLLDRVCLRIASDPSPFADRVMVMPNLYGDILSDLSAGLIGGLGLTPSGNIGKDASIFEAVHGSAPDIEGKGLANPTALLLSSLMMLRHMSLYELADKIEKAALSTIAEGKAITRDLGGKAGTKEYTDAILSKL

SEQ ID NO: 17400 - protein, 304 aa, Salmonella enterica subsp. enterica serovar Paratyphi A str.
MDNAILETILQRVRPLIGQGKVADYIPALASVEGSKLGIAICTVDGQHYQAGDAHERFSIQSISKVLSLVVAMRHYPEEEIWQRVGKDPSGSPFNSLVQLEMEQGIPRNPFINAGALVVCDMLQGRLSAPRQRMLEVVRALCGVSDITYDATVARSEFEHSARNAAIAWLMKSFGNFHHDVPTVLQNYFHYCALKMSCMELARTFVFLANQGEAFHLDEPVVTPMQARQINALMATSGMYQNAGEFAWRVGLPAKSGVGGGIVAIVPHEMAIAVWSPELDPAGNSLAGIAALEQLTQTLGRSVY

SEQ ID NO: 17401 - protein, 211 aa, Staphylococcus aureus
PSADMLFEPSFVNDIDVNENDVVHFCSVDLVDSPMRDAHYQLIIKTLNANGTVVFDPNVRLPLWDNAEDLRQTIHTFLPLAHIVKVSDEELEFITGIYDENEAIQSLFTGNVTVVIYTKGADGAAVYLKNGISHYHSGYKVKPIDTTGAGDAFIGAVISRILATDVLNLTQLFENEGEEILAFSNRVAAIVTTKYGAINSLPTLQEVEQAF

SEQ ID NO: 17402 - protein, 160 aa, Brassica napus
  misc_feature (92)..(92): Xaa can be any naturally occurring amino acid
  misc_feature (150)..(150): Xaa can be any naturally occurring amino acid
  misc_feature (158)..(158): Xaa can be any naturally occurring amino acid
  unsure (1)..(160): unsure at all Xaa locations
NNLTNKTTTSFLTLPLVYIGLGLLAAGHSVLYSFGLLYLPVSTFSLISASQLAFNAVFSYFLNSQKFTPCILNSLVLLTTSSTLLVIQPESXSSTSNPSSKYNYVIGYICAIGSSAGYSLVLSLTDYAFEKILKKYTFKAILDMVTYQSXVATCAVVXGL

SEQ ID NO: 17403 - protein, 514 aa, Rhodopseudomonas palustris CGA009
MAQRNSFYITTAIAYPNGAPHIGHAYEAIATDALARFQRLDGKDVFFLTGTDEHGLKMIQTAQKEGLTPHALATRNAGRFREMDDRLGVSYDRFIRTSEEQHHRSVQEVWKRMQDKGDIYLDSYSGWYSVRDEAYYAEDETVVGDDKVRRGPQGTPVEWVEEKSYFFKLSAYQDKLLKLYEDQPDFIGPDSRRNEVISFVKSGLKDLSVSRTTFDWGVKVPGDPEHVMYVWVDALTNYISGVGFPDENDKNWHYWPADVHVIGKDIIRFHAVYWPAFLMSAGIPVQKRVYAHGFLFNKGEKMSKSVGNIVDPFNLADQYGVDQVRYFFLREVPFGSDGSYNHEAIVNRINADLANDLGNLAQRSLTMVAKQCEGKVPEHGAFSETDSAILAMADAMITQARTAMATQQIHQALNAVWAVVAEANRYFAGEAPWALAKTDPARQKTVLYVTAEVLRQIAILAQPAIPTAAAKLLDILGIAEGQRDFAALATRIVPGTPLPAPAPIFPRYVEPATA

SEQ ID NO: 17404 - protein, 179 aa, Capsicum annuum
GVEGSIWQLAKAYAAVNDSGVHQLISHWLNTHAVIEPFVIATNRQLSVLHPIHKLLLPHFRDTMNINALARQILINGGGVLELTVFPAKYSMEMSAVVYKDWIFPEQALPVDLIKRGVAVEDSSSKHGIRLLIQDYPYAADGLEIWSAIKSWVTEYCNFYYKSDDAVQKDAELQAWWKE

SEQ ID NO: 17405 - protein, 549 aa, Rhodopseudomonas palustris CGA009
MSTPQGHYSIGLDKTPANFVPLSPLSFLERTANVYPEMTSVVYEGRHYTWKETRARCRRFASWLTRSGIGRGDTVAVMLPNVPAMVEVHFAVPMAGAVLNALNIRLDAAAIAFQLDHGGAKIILVDPEFSSVVAEALKLMTKPKPLVIDVDDKMYPGSHRIGELEYEYAVASGDPTFAGHRPEDEWDAISLGYTSGTTGNPKGVVTHHRGAYLNAVSNILAGNLGQHPVYLWTLPIFHCNGWCFPWTLAAAAGINVCLRKVDPAKIFELIPKHGVTHMCGAPIVYNALINAPEAPKGVPTKPVVGLIAGAAPPMAVLAGAETIGIKLTHVYGLTEVYGPASVCAEQPGWDELPVAERAKLKRRQGVPYPMQEAVTVLNPETMQEVPRDGETIGEVMFRGNIVMKGYLKNEKATKEALAGGWFHTGDLGVLDADGYVIIKDRSKDIIISGGENVSSVEVEDVLYKHPAILFAAVVAKPDPKWGEVPCAFVELKDGASATEAEIIAYCREHLPGFKTPKSIVFSSIPKTSTGKIQKFMLRDQVKSAKAILE

SEQ ID NO: 17406 - protein, 203 aa, Helianthus annuus
PYGFSVIEKFLAGARSIDQHFHSAPFESNIPVLLGLLSLWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLTFTGNRPSLSLLLPSLDAYRIGQLLAIYEHRI

SEQ ID NO: 17407 - protein, 698 aa, Methanopyrus kandleri AV19
MREPTREESEEIKVVDAYVKRFQRLVQLEREAEMKAMEEEIRKLSGKEREKKGRAVLGLRGTRAGREVGGYYLVKYGRSKEIDTQISVGDLVLVSRGDPLKSDLTGTVVEKTKRSITVAFDSPPPKWAVGKGIRIDLYANDVTFQRMMEALERIRHAEGRLRELRNTIIGLKNPSDAEPIDVDFVDTDLNYSQREAVEHALGAPDFFLIHGPPGTGKTRTITEVIVQEVRRGNKVLATAESNVAADNILEYLVERGVEAVRVGHPARVSKKLKERTLSAIVENHPLYRKAERLRERAYRLIEKRDRYQRPVPRWRRGMSDETILYLAREGKGARGVPPRVIQSMAKWIHINRKVQKLFEEAERLEERAVREVLEEAEVVVTTNASAGLEFLEDIEFDVAVVDEGSQATEPSALIPISRAKRFIMAGDHKQLPPTILSEEAQPELSRTLFERLIEKHPKLSRMLRVQYRMHENIMEFPNREFYNGKLEAHSSVRRHTLEDLGVGDPEVGRPWADVLHPKEPLGFVDTSRLPERLRRERRRPGSKSRENPMEAAIVAFLSEQLVRQGLSQEDLAVISPYDDQVDLISKSLDELGLGDVEVNTVDGFQGREKEAVIVSFVRSNPKGEVGFLRDMRRLNVAITRPRRKLICIGDSGTLSSHPTYRRFIEHVKRSGALIKPNNLREVASYLDLVRLAPGRARG

SEQ ID NO: 17408 - protein, 540 aa, Solanum lycopersicum
MAVSSYARAFPSFECRSEPDFSGSLPHPKAGVRFSGKYNSGSNRSQVYGLSSLIYRFPPNFVRQLSIKARRNCSNIGVAQVVAASWSNNQAGPEFTPAANAVDSSASAAVTSIGITTGDEEVAVVENADCSDQNVQIKGSTGVKYASFLNSDGSVAIHAGERLGRGIVTDAITTPVVNTSAYFFNKTSDLIDFKEKRRASFEYGRYGNPTTVVLEEKISALEGAESTLIVASGMCASTVMFLALVPAGGHIVTTTDCYRKTRVFIETILPKMGITATVIDPADMGALELALNQKKVDLFFTESPTNPFLRCVDIELVSKLCREKGALVCIDGTFATPLNQKALALGADLVVHSATKFLGGHNDVLAGCISGPEKLVSVIRNLHHILGGALNPNAAYLIIRGMKTLHLRVQQQNSTALRMAEILEAHPKVKHVYYPGLPSHPEYHLAKKQMTGFGGVVSFEVDGDLLTTAKFVDALRIPYIAPSFGGCESIVDQPAIMSYWDLSQSDRAKYGILDNLVRFSFGVEDFEDVKADVLQALDSI

SEQ ID NO: 17409 - protein, 608 aa, Silicibacter sp. TM1040
MNTPTRHPTPNVTTGALPASRKIYVAGEMHEGIRVPMREIATHPTAGEAPLPVYDSSGPYTDPDVSTDIREGLAPLRAAWIKARCDVEAYSGRDVTAADNGFVEGDRLVPEFPVKPAPLRGRQRAAPTQLAYARAGIITPEMEFVAIRENQLRDLSPCHCARDGEDFGANIPDYVTPEFVRAEIAAGRAIIPANINHPELEPMIIGRNFKVKINANMGTSSVTSSMEEEVDKLVWAIRWGADTVMDLSTGRNIHNTREWIIRNSPVPIGTVPIYQALEKVNGIAEDLTWEVFRDTLIEQAEQGVDYFTIHAGVRLHMVPMTVERVTGIVSRGGSIMAKWCLHHHRESFLYEHFEEICDICRQYDVSFSLGDGLRPGSIADANDAAQFAELETLGELTKIAWAKDCQVMIEGPGHVAMHKIKENMDKQLECCHEAPFYTLGPLTTDIAPGYDHITSGIGAAMIGWFGCAMLCYVTPKEHLGLPDRDDVKTGVITYKIAAHAADLAKGLPGAQRRDDALSRARFEFRWEDQFNLSLDPETAQSFHDETLPKEAHKVAHFCSMCGPKFCSMRISHDIRAEAQKEGFEAMAAKFREGGELYVPLKDTAPEEA

SEQ ID NO: 17410 - protein, 372 aa, Candida albicans SC5314
MSLPSVATQIVLKNHPAGFINPEFNKLDSTFAVKHASFPKELKEGEVIVKTLYLSNDPTQRSWIRSKLEKRRHYAKPIEEGSPMRSLGLGQIVQSNSSRFKPGDIVYGIILWGDYSVLEDTSLYNSIDTSLGLPLEYYLSVLGMTSLTAFFGLTEAGDLKQYLNSPPGKGPIVCVSAASGATGSVVVQIAKNLLGASKVIGISGSSEKCQWVEKLGADICVNYKDPNYQDQIEKFLGDEFIDTYFDNVGGDILSFVLTKVKKFGNVVACGSIAGYNNREASKVSNWGEITVNSLTVRGFIVTDYQEHFPKAIGILTDAVKAGKIRTDGAYHVENLHGHDLIHRLENIPKIWNKLFEDNKPNGKMITKVALDI

SEQ ID NO: 17411 - protein, 338 aa, Chlamydia trachomatis D/UW-3/CX
MLTLGLESSCDETSCSLVQNGKILANKIASQDIHASYGGVIPELASRAHLQTFPELLTAATQSAGVSLEDIELISVANTPGLIGALSIGVNFAKGLASGLKRPLIGVNHVEAHLYAACMEAPATQFPALGLAISGAHTSLFLMPDATTFLLIGKTRDDAIGETFDKVARFLGLPYPGGQKLEELAREGDADAFAFSPARVSGYDFSFSGLKTAVLYALKGNNSSAKAPFPEVSETQKRNIAASFQKAVFMTIAQKLPDIVKTFSCESLIVGGGVANNSYFRRLLNQICSLPIYFPSSQLCSDNAAMIAGLGERLFCNRTHVSKEVIPCARYQWESACS

SEQ ID NO: 17412 - protein, 413 aa, Kluyvera cryocrescens
MAESSPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVQGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVNALARIKSYHDYGTFTPLQVAAIAALEGDQQCVRDIAEQYKRRRDVLVKGLHEAGWMVELPKASMYVWAKIPDKYAAMGSLEFAKKLLQDAKVCVSPGIGFGEYGDTHVRFALIENRDRIRQAIRGIKAMFRADGLLPSEHKSRIDFCVA

SEQ ID NO: 17413 - protein, 1126 aa, Candida albicans SC5314
MVLNDFDLKTEALNERTTLHTSQNASSKNGSNKESVLAKYEETNQNDEIEGFENLNDLSFSKYSKFSKASIIVGSDPKSRTTTLDSPFAKKLKEDLNVEFTSDNTKPYYPTVYPIYEFDNNDENSDSPFLDYQNEKGNIPQKLSGQKLRKQQQQQQQQSEAEENFKQSNQYARLQSTPKHQRTSSVKVSLTPAQKFEKRTSTRSHNALDNFELTTLVGNGAFASVYRAVNLKTNQVIAIKQIRIEKDQDVGVLMGEIDLLKILKHRNIVKYHGFVKTATSLNVLLEYCEGGSLRQLYKKLKKGLPEYQIINYVRQILEGLNYLHEQGVVHRDVKAANVLLTDKGDVKLADFGVATKVTSQHLTVVGTPNWMAPETVLGGEGICTASDIWSLGATIIELFTTNPPYHDLNAMATLHAIGTDEHPPLPKNMSTLAKDFLLECFQKQANLRISAKLLLKHKWLNQTATAKTSMATLLRQPSRELRSIKIYSESNDENWDEDFEEIKVSKFQNSTSSIIELKPDNTEKQFKLTEYSKKDLLTLFADNKEDTSNNFEFETIGPNKLAVVAESMDESDPFLNIDIENFDTNELEVQSKMEYLVVRLSRKLEQVHLGYEDAVPALVKVTGRMLHLVKKYPVSHDTLIRDHGVLSLLELLESFQDIPSQQQLWYHCLSILNHVFESDLGTLENFCFLGGIPTVAHFRSATYEVQVRLQVAKFIGILNLSEKALSMFVSCGGLRLVSKFVEEDFDTTPTFPLIAIESIHNILAKDLSRSKSDLCRILSKHGVIFWLVVLLNRLVKYDQKPSIKNVSKEQVEITIERIIDIIKYFSQSETKVRISIGSIDLFKLIFKLFDNLKLSHQLTLLKFVKSMSCISEVLKNLYHAEILEFLVKLLKSYIPSKGNYKEIINVLAPILYNSLALNHRRESEFVNLGGLPYLKTLSIINLPFRQFILPIICEFVHCDASVVNELKKNDIVKIYYNLLLDPYWQSNALDSLHCWYKLEPSYIDLNSPMAVDCLVGGFLLPKVSNLESTLEIYFKLLTNNLPLTRDMSNMNVINSILIKLSLHDKKNPVIQLSYLKVLKCLINYLVDSKSSLPFAKPVVNTLQSLKSRQSSLLIEEVTTELLSVLK

SEQ ID NO: 17414 - protein, 612 aa, Bradyrhizobium japonicum USDA 110
MCGIAGIVNLRGSAVEPDDISRLTGLIAHRGPFGQGTWFSADRSLAFGHRRLAIIDPGEGGYQPMRSADGRHVIVFNGEIYNFLELRRELEAQGVVFRSQSDTEVILAAWQAWREDMLPRFNGMWALAIFDTATGELFLARDRFGIKPLLYAVSPERFIFASEQRALVRSGLIDASVDVEVARRLLLDAFGIEGSERTLFRQVRRLQGGHCMWLRQGKVSVRRWWRTVDHLPPVPGTEAEQVARFRELFQDAVALRMRSDVPIGTCLSGGFDSSAVICTMAAHEKAGMGPRDSTAWRHAFVATFPGALNDERPMAEEAAAWAEVAPTFLEIGQADALIDLDQILDDLDDVYIALPSAIWLIYRQLRRQDVTVSLDGHGADELMGGYLQQGQALAFRIRNAAEDFASRSALARRSVDVLRMLALKRRGVYFLRGGLRDLPASLPLVAEDDVLPREWGGLNRRLYRMFHSTVLPTILRNFDRLSMAHGVEVRMPFMDWRLVTYTMALPESSKSSEGYTKAVARRAMANLMPESIRTARRKVGFNSPMPEWLNGPLAGWTADLLDRKVPAFAELVDEAALRTTVSRLTASKSWDWEAVGRIWPYLNMKWMLARYA

SEQ ID NO: 17415 - protein, 296 aa, uncultured archaeon GZfos26D8
MLKIEGVYPALITPFTKDDEVDKEGLRRLVEYMIEGGVAGIVPCGTTGESATLSHKEHEEVIDVVVDCSKVPVIAGTGSNNTKEAVEFTKHAADAGADACLLITPYYNKPNVKGLKEHFKRIGDSVEIPLILYNIPSRTAQNVNAGTMVELASEITNIKGVKEASGDLKQVGAIIRSVAEQGLDFTVVAGDDFLTLPIMSLGGKGVISVAANIAPREMTEMVDAMLKGKVEKAKEINIRLFSLFEAMFLETNPIPVKKAAEMMGLVETGDVRLPLGALSEGNEEKLRAVLKGLGMV

SEQ ID NO: 17416 - protein, 292 aa, Oryza sativa (japonica cultivar-group)
MQVQAASPATAASSPVAPSPPPPPRAALSPCPRRRELLLLSASLPLPLPLLAPAAASARGLFRMPPPRLANRYFLVRAGESVYEGQGVVRTNPVSKTSVDSGLSPAGLRQAARAALELQRLGACEDDCWIWPSITQRAYQAAEIIAAANEINRSHIVPEYSFLDARGLGAFEGKSLETLPEVYASDSISPDIKPPPISDGTPNESVADVFVRVTQLMSILETQYSGDTVVIVSPDSDNLSILQAGLIGLDLRRHSSLFFQPGEVRPVDPASIPEYKQPASTVFKCTNPPSCK

SEQ ID NO: 17417 - protein, 228 aa, uncultured cyanobacterium
HEVAGAGQHELGMKFAELIQAADNTMTYKYVVRNVAKKYGKTATFMPKPVFNDNGSGMHVHQSLWKGGQPLFFGEGTDANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQIDPGAPTNEDLFELSAERLSAIDTVPASLNGALETLNADHHYLMEGGVFTQ

SEQ ID NO: 17418 - protein, 287 aa, Oryza sativa (japonica cultivar-group)
PWVAGVLNGRVEINANKCGTHPTPSKPYYVDKIDTNEQKVVHYQVNCRPARDRNTGSYSVKHHYPSPIVSWIEDLSSFGNVSFSQDPEYADEQSRSSVGQSSASVNLHDMQISVRLTDEFIELAKENTGNNVETCGILGASFRDGTYYVTMLIIPKQEATAHSCQAVSEEEIHAILSEQSLYPAGWIHTHPSQTCFLSSIDLHTQYSYQVMLPEAVAIVIAPTDPTRNCGIFRLTDPGGMGVLRECSESGFHAHRETTDGGPIYETCSKVIFNPNLRFEIVDLRSAP

SEQ ID NO: 17419 - protein, 228 aa, uncultured cyanobacterium
HHEVATAQHELGMKFAELIQAADNVMTYKYVVRNVAKKYGKTATFMPKPVFNDNGTGMHVHQSLWKGGQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 17420 - protein, 228 aa, uncultured cyanobacterium
HEVAGAGQHELGIKFAELIQAADNVMTYKYVVRNVAKKYGKTATFMPKPVFNDNGSGMHVHQSLWKGGQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 17421 - protein, 236 aa, Triticum aestivum
  misc_feature (44)..(44): Xaa can be any naturally occurring amino acid
  unsure (1)..(236): unsure at all Xaa locations
DSKYSIASSHSGSWRRLRANQAGKVLKKGKKKQAKDELDRQKQXAEKKRRRLEKALANSAAIISELEKKKQKKKEEQERLDEEGASIAEAVALHVLVGEDSDESRHLVLNKHRRCNDWDPSAGLDFTLDTQGAADIYSPGGLMCGNQAYASRGRWIDWGNAHPLPTWGEVRDLKASYYQGTCHQSTVACPGFMAAQAVSSLQIREDSSSPGQGVAAATVVNRMLGGANRLNLYREI

SEQ ID NO: 17422 - protein, 228 aa, uncultured cyanobacterium
QHEVATAQHELGMKFAELIQAADNVMIYKYVVRNVAKKYGKTATFMPKPIFADNGSGMHVHQSLWKASQPLFFAPGTYANLSDTARWYIGGILKHAPSFLAFTNPTTNSYKRLVPGFEAPVNLVYSEGNRSAAVRIPLTGPSPKAKRLEFRSGDALANPYLAFSAMMMAGIDGIENQIDPGAGVDVDLFELPADELAKIATVPASLNGALEALRADHHYLLEGGVFTK

SEQ ID NO: 17423 - protein, 428 aa, Pseudomonas aeruginosa
MADKKAQLIIEGSAPVELPVLSGTMGPDVVDVRGLTATGHFTFDPGFMSTASCESKITYIDGDKGVLLHRGYPIEQLAEKSDYLETCYLLLNGELPTAAQKEQFVGTIKNHTMVHEQLKTFFNGFRRDAHPMAVMCGVIGALSAFYHDSLDITNPKHREVSAHRLIAKMPTIAAMVYKYSKGEPMMYPRNDLNYAENFLHMMFNTPCETKPISPVLAKAMDRIFILHADHEQNASTSTVRLAGSSGANPFACIASGIAALWGPAHGGANEAVLRMLDEIGDVSNIDKFVEKAKDKNDPFKLMGFGHRVYKNFDPRAKVMKQTCDEVLQELGINDPQLELAMKLEEIARHDPYFVERNLYPNVDFYSGIILKAIGIPTSMFTVIFALARTVGWISHWQEMLSGPYKIGRPRQLYTGHTQRDFTALKDRG

SEQ ID NO: 17424 - protein, 228 aa, uncultured cyanobacterium
HEVAGAGQHELGMKFAELIQAADNTMTYKYVVRNVAKKYGKTATFMPKPVFNDNGTGMHVHQSLWKGGQPLFFGEGTEANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQVDPGAPTNVDLFELSAERLSEIDTVPASLNGALEALNADHHYLMEGGVFTK

SEQ ID NO: 17425 - protein, 262 aa, Nostoc punctiforme PCC 73102
MSDAYGGLSLRWTLRGKKALITGATKGIGLAVANEFLSLGAEVIIVARNSQDVDQQLIIWRELGLPAYGITADVATAEGRQAIFEQVGKTWDKLDILVNNVGTNISKKVLDYTAAEYQFIIQTNQISIFEMCRLFYPLLQNRENSSIVNISSVAGLVSNRTGAPYGMTKAAINQLTRSLSVEWACDQIRVNTVAPWAIRTPLTESVLDNQDFLKLVLSQTPMGRVGQPEEVAGLVAFLCMPAASFITGQCITVDGGFLAFGF

SEQ ID NO: 17426 - protein, 396 aa, Oryza sativa (japonica cultivar-group)
MEGHEGGEEEGLGDQFERLPDEVLLDVFGRIGDVKALGRCALVSRRFHALVPLVDSVFVRVDCVISDDPPPSSAGSAQAAAAAEGGPPAARGRGALAHLARLVLGGIVRPIQALGQILSPAAATVSRRSAAPPAAPAPAAADVSHHSPSEVLRSFKELRRLHIELPTGELGIEDGVLLKWKADFGSTLGSCVILGASSVTSKPPPPPAAPPPTAADSSAASPDSSREPDELGNIPESLYTNGGLKLRVVWTISSLIAASARHYLLQPIIADHSTLESLDLTDADGQGVLTMDKRQLQELRVRPVSASGNSHRTLMPALSMRLWYAPHIELPGGQLLKGATLVAIRPSEDVLREGGGIEVAGPTGASWILDAFEEPYRTAAQVLLKRRTYSLEMNSF

SEQ ID NO: 17427 - protein, 211 aa, Staphylococcus aureus
PSADMLFEPSFVNDIDVNENDVVHFCSVDLIDSPMREAHYQLITKTLNSNGTVVFDPNVRLPLWDNAEDLRQTIHTFLPLAHIVKVSDEELEFITGIHDENEAIQSLFTGNVTVVIYTKGADGAAVYLKNGNNHYHSGYKVKPVDTTGAGDAFIGAVISRILATDVLNLTQLFENEGEEILAFSNRVAAIVTTKYGAINSLPTLQEVEQAF

SEQ ID NO: 17428 - protein, 449 aa, Bacillus thuringiensis serovar konkukian str. 97-27
MFFTQFFKPAPHAERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFANDWKSIFYFPGILSILVGIYVLITMKDTPQSCGLPSIEEHTGEYPPDEKIKDRERELSAKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSVKQKQA

SEQ ID NO: 17429 - protein, 589 aa, Burkholderia mallei ATCC 23344
MSLIEVKVPDIGDFSGVDVIEVNVKPGDVIEKEQTLITLESDKASMEVPSDVAGTVKEIKIKAGDKVSQGTVIAIVEASAGAAAPAPAKAPEAPKPAAAAPAPAAAPAPAPQAGSSSGSADIECDMLVLGAGPGGYSAAFRAADLGMKTVLVERYSTLGGVCLNVGCIPSKALLHTALVVEEAQALASHGITFGKPQVELDKLRDFKGGVVKKLTTGLAGMAKARKVEVVTGVGAFVDPYHMEVQGENGKKIVKFKQAIIAAGSQAVKLPFMPEDPRVVDSTGALELRQLPKRMLVIGGGIIGLEMATVYSTLGAEIDVVEMMDGLMMGADRDLVKVWEKYNAKRFGNVMLKTKTVGAQAKEDGIYVTFEGEKAPAQAQRYDLVLVAVGRSPNGKKIGADKAGVAVTDRGFIEVDKQMRTNVPHIFAIGDIVGQPMLAHKAVHEGHVAAEAAHGEKAYFDALQIPSVAYTDPEVAWAGKTEDQCKAEGIKYGKAVFPWAASGRAIANGRDEGFTKLLFDEETHRVIGGGIVGLNAGDLISEVCLAVEMGADAEDIGKTIHPHPTLGESIGMAAELYEGVCTDLPPQRKK

SEQ ID NO: 17430 - protein, 529 aa, Burkholderia mallei ATCC 23344
MSQAIEVKVPDIGDYKDVPVIEVLVKPGDAVEPEQSLVTLESDKATMDVPSPSAGTVKEVKVKVGDAVSQGSLIVLLDGAQAAAQPAQANGAATSAAQPAAAPAAAPAPAAAAGGGTVDVKVPDIGDYKDVPVIEIAVKIGDTVEKEQSLVTLESDKATMDVPSPAAGVVKDIKVKVGDAVSEGSLIVVLEASGGAAASAPQAAPAAAPAPAQAPAPAASGEYRASHASPSVRKFARELGVDVSRVTGTGPKSRITKDDVTAFVKGVMTGQRAAPGAAAAPAGGGELNLLPWPKVDFSKFGPFEAKPLSRIKKISGANLHRNWVMIPHVTNNDEADITELEALRVQLNKEHEKAGVKFTMLAFVIKAVVAALKKFPTFNASLDGDNLVFKQYYHIGFAADTPNGLVVPVIRDADKKGLVDIAKEMAELSKAAREGKLKPDQMQGGCFSISSLGGIGGTHFTPIINAPEVAILGLSRGQMKPVWDGKQFVPRLTLPLSLSYDHRVIDGAEAARFNAYLGALLADFRRIIL

SEQ ID NO: 17431 - protein, 195 aa, Deinococcus radiodurans
MPRTAAVTRTTKETDITVRLDLDAAPYEQPATGHGFFDHMLDALARHSRLGISISGTGDLHIEPHHLIEDTGITLGQALSQALGDRKGIERYGSAFVPMDETLAHVVLDLSGRAHLAFEPETLDVYGDAGGMTHYHLREFLRGFCNHAGATLHVRLLAGREAHHVIEAVMKAFARALRDAVAVTSDALPSTKGSL

SEQ ID NO: 17432 - protein, 110 aa, Ehrlichia ruminantium str. Gardel
MTNNIMNRIKHDIETNDVVLYMKGDANMPQCGFSSVVVTILKKMNISFKSINVLEDQELREAIKEFTNWPTIPQLYVKGEFIGGCDIVKEMYHTGELQELFVKNNLITAN

SEQ ID NO: 17433 - protein, 553 aa, Chlamydia trachomatis D/UW-3/CX
MSSNKHASLCQKTPSLCRELQKAPALLLTEDIRFKALLNERIDSVAELFPCTYNSPYYKFISKSDLSAETSPLKVGVMLSGGPAPGGHNVILGLLHSIKKLHPNSQLLGFIRNGEGLLNNNTVEITDEFIEEFRNSGGFNCIGTGRTNIITEENKARCLQTANELDLDGLVIIGGDGSNTATAILAEYFAKHQAKTVLVGVPKTIDGDLQHLFLDLTFGFDTATKFYSSIISNISRDALSCKGHYHFIKLMGRSSSHITLECALQTHPNIALIGEEIAEKSISLETLIHDICETIADRAAMGKYHGVILIPEGVIEFIPEIQSLVKEIESIPEQENLYQALSLSSQQLLCQFPEDICHQLLYNRDAHGNVYVSKISVDKLLIHLVRQHLETHFRQVPFNAISHFLGYEGRSGTPTHFDNVYSYNLGYGAGVLVFNRCNGYLSTIEGLTSPIEKWRLRALPIVRMLTTKQGKDSKHYPLIKKRLVDIASPVFNKFSLYRKIWALEDSYRFVGPLQIHSPEDAHSDDFPPLILFLNHNEWQKRCSICLEIPDQDY

SEQ ID NO: 17434 - protein, 548 aa, Chlamydia trachomatis D/UW-3/CX
MELLSVNKSYFELQRLHYRPDTLSLLNSLCSMHIQEKPSSEPASDLLAKHIPHLCALPDLTLQKDAPSSSEPLRIGVLLSGGQAPGGHNVVIGLFEGLRAFNKETKLFGFIKGPLGLIRGLYKDLDISVIYDYYNAGGFDMLSSSREKIKTKEQKSAILATVKKMKLHGLLIVGGDNSNTDTAMLAEYFIEHNCPTAVIGVPKTIDGDLKNAWIETPLGFHTSCRTYSEMIGNLEKDVLSTRKYHHFVKLMGEQASHSTLECGLQTLPNITLIGEEVAVQHASLQSLSLSIAQGLIERFHRGKDYSTILIPEGLIKQIPDTKRLIQELNTLIAEGQFSVHNLDQQLSPMAIETFSSLPENIRDQLLLDRDSYGNIRVSKIAIEELLASLVSKEISKLEPTMSFSPVTHFLGYESRASFPSNFDSNYGLALGIAASLFLVRGKTGYMVTIGNLAEAYTEWTIAATPLYKMMHLEKRFNQETPVIKTDSVSPDAPMAKYLHKMKKICLLEDSYRFPGPLQYFEEQALVDQRPLTLLWEKGKLSENNATKF

SEQ ID NO: 17435 - protein, 338 aa, Nocardioides sp. JS614
MPVAARLHSVGDLRVEQVAEPPAPTVGWSTVAVTSVGLCGSDLHWFTDGGTGEVTLDRPVVPGHELAGRALDGPYAGRRVAIDPAIPCGVCEQCRAGHGNLCPDVRFAGHAGLDGGLQERLVWPDHLLFPLPDDLSDDAGALLEPLGVAIHAVGVAHVRPGHDVLVVGGGPIGVLTAAVARRTGAAQVVVSEPLAHRRETARRFGADVAVAPEEASSAVDELTGGRGVDVVIEMAGADDAIGTAVACARPGARIALGGIPSVPLSSFPAAPARRKGLTFAMVRRMHETYPRAIELATSGIDLDALVSDRFPLADAPLAFTHAVARTGDKTVIAVSGTR

SEQ ID NO: 17436 - protein, 518 aa, Hordeum vulgare subsp. vulgare
MAAMVEWLPWFGSAVASAIFLWSMVQNHVPDTLRLYLATLAAKITAYINPYLEITISENRAERFQRSELFIAVEAYLSDACARGARRLKAELGKDSKNIQVSVDDHEGVTDDFSGAKLWWYASKQQSKANVISFYPGEDERRFYRVVFHKRHHDLVIDSYLPFILGEGRNVTVKNRQRCLFTNNANNSWSPYRAKKSVWSHIPFEHPATFDTLAMDPKQKEAIIDDLMAFQKSKEYYAKVGKAWKRGYLLYGPPGTGKSTMIAAMANFLDYDVYDLELTAIKNNTELRKLFIETTGKSIIVIEDIDCSLDLTGKRRKEKKAAGDKDSDDNDKAKLPMEPEKDDETKVTLSGLLNFIDGLWSACGGERIIIFTTNHKEKLDPALIRRGRMDKHIEMSYCRFESFKVLAKNYLDIVGHGLFSEIQKLLEETNMSPADVAENLMPMSKKKKRDPDVCLAGLIEVLKQAKEDAAAAKAKEEEEAKEAEAKNAKDKKEGEAKKDEGKDKIMEEANGDLKQGDE

SEQ ID NO: 17437 - protein, 377 aa, Cryptococcus neoformans var. neoformans JEC21
MSMEEEVAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKQNREKMTQIMFETFNAPAFYVSIQAVLSLYASGRTTGIVLDSGDGVTHTVPIYEGFSLPHAILRIDLAGRDLTDYLVKILMERGYLFTTSAEREIVRDIKEKLCYVALDFEQELQTAAQSSQLEKSYELPDGQVITIGNERFRCPEALFQPSLLGLEAAGIHETTYNSIMKCDLDIRKDLYGNIVMSGGTTMYNGIADRMQKEITALAPSSMKVKIVSPPERKYSVWIGGSILASLSTFQQMWIAKSEYDESGPSIVHRKCF

SEQ ID NO: 17438 - protein, 230 aa, Brassica rapa
MVGTRVVGQWTLCVASPRLTPAICSSTSSPTTVNLRAELAAFRPQFRLFSRTSPSRRRLRASTSSAESGIFLPHLVASMEQVEETYIMVKPDGIQRGLVGEIISRFEKKGFKLIGLKMFQCPRELAEEHYKDLSSKSFFSSLIEYITSGPVVCMAWEGVGVVASARKMIGKTDPLQAEPGTIRGDLAVQTGRNIVHGSDSPENGKREIALWFKEGELCEWDSVLAKWLRE

SEQ ID NO: 17439 - protein, 516 aa, Hordeum vulgare subsp. vulgare
MVAMMVERWAGLGSAVATVLFLWSVVQKYVPPTFRLYLTVWAAKLAACFNPYLQITISEYGAERFQRSEFFLAVEAYLSDACARRARKLKAELGKDSKNLQVTVDDHEEVTDDFSGTTIWWYASKKQSKANVISLYPGQDERRFYRVVFHRRNRDLVVDSYLPFVLGEGRAVTVKNRQRRLFTNNASRNSNPYRSNSVWSHVPFEHPATFDTLAMHPDEKEAVVDELMAFQESKDYYAKVGKAWKRGYLLYGPPGTGKSTMIAAMANFLDYDVYDLELTAVKNNTELRKLFIETTGKSIIVIEDIDCSVDLTGKRRKDKKASGDKDSDGDDKPKLPMDPDKDDATKVTLSGLLNFIDGLWSACGGERIIIFTTNHKEKLDPALIRRGRMDKHIEMSYCRFEGFKVLAKNYLDVIEHELFGEIQQLLDETDMSPADVAENLMPMSKKKKRDPDVCLTGLIEALKQAKADAAAVKAKEEEEAAEAKKAKKTEEAEAKKAKEEDNGKDKAPDQEANGDI

SEQ ID NO: 17440 - protein, 211 aa, Brassica napus
  misc_feature (109)..(109): Xaa can be any naturally occurring amino acid
  unsure (1)..(211): unsure at all Xaa locations
MAMKLRQSQRSQARKWSTLMLVLLMLFMLTIVLLMLLSFGVFSLPIDTFDEYSPADLSSFRRAATERSEGIGKRGDQWTEILSWEPRAFLYHGFLSKEECEYLISLAKXYMVKSTVVDSQTGKSKDSRVRTSSGTFLRRGRDKVIKTIEKRIADYTFIPADHGEGLQVLHYEEGQKYEPHCDYFADEFNTKNGGQRMATMLMYLSDVEEGR

SEQ ID NO: 17441 - protein, 486 aa, Acidovorax sp. JS42
MKEFLNFINGEYVRNASGKTFQDINPVNGSVIGNIYEAGQAEVDAAVAAARAALKGDWGRLSVAERCKLLDAVAGEINRRFDDFLQAEIADTGKPHHLASHVDIPRGAANFQIFIDTIKSTATESFNMRTPDGKTALSYGVRVPRGVIAVVCPWNLPLLLMTWKVGPALACGNTVVVKPSEETPATATLLGEVMNQVGMPKGVYNVVHGFGPGSAGEFLTRHPGVNGITFTGETRTGTAIMKAAADGVRPVSLEMGGKNAAVVFADCDFQVTIDTLTRSCFENAGQVCLGTERVYVERPIFDKVVAALKERAEAMKPGLPFDHDTRIGPLISKKHQAKVLGLYKTAKDEGATIVTGGGIPDMPEELKNGSWVQPTIWTGLPETATVVTEEIFGPCCHISPFDSEEEVLGKVNANRYGLATAIFTQDIARANRLAHQIEVGLCWINAWFLRDLRTPFGGSKQSGIGREGGVHSLEFYTELRNVMVKF

SEQ ID NO: 17442 - protein, 228 aa, uncultured cyanobacterium
HEVAGAGQHELGIKFAELIQAADNVMTYKYVVRNVAKKYGKTATFMPKPVFNDNGSGMRVHQSLWKGGQPLFFGEGTYANLSQTARWYIGGILKHAPSFLAFTNPTTNGYKRLVPGFEAPVNLVYSEGNRSAAVRIPLTGPSPKAKRLEFRSGDALANPYLAFSAMMMAGIDGIKNQIDPGEGVDVDLFELPANQLANIATVPASLNGALEALNADKHYLMEGGVFSE

SEQ ID NO: 17443 - protein, 339 aa, Salmonella enterica subsp. enterica serovar Paratyphi A str.
MKSIVIEKPNTLTIETRALPQPAPGEVRIKVKLAGICGSDSHIYRGHNPFAKYPRVIGHEFFGVIDAVGDNVNRDRIGERVSVDPVISCGHCYPCSVGKPNVCTSLVVLGVHRDGGFSEYAVAPARNAHRIPDNIADHHAVMVEPFTIAANVTGQVNPTEQDVALIYGAGPMGLTTVQALKGVYQVKTVIVVDRIEERLAMAKQSGADWSLNNGQHSLAEFLQQKALKPTLIVDAACHPAILQEAITLASPAARIVLMGFSSDPCEIVQQGITGKELAIYSSRLNVNKFPVVIDWLNKGLIDPDKLITHTFDYQHVIDAIELFEKDQRQCCKVLLTFAK

SEQ ID NO: 17444 - protein, 244 aa, Prunus cerasus
MRFTLRKKEILIDILVRLPAKSLVRFLCTCKSWSDLIGSLSFVSTHLHRNVTKHDHVYLLCLHYSNFELQADPDDPHVKQEFQWSLFSNQTFEECSKLSHPLGITEHYVMYGSSNGLICISDEILNFDSPIHIWNPSVRKLRTTPISTNINIKFSHVALQFGFHPGVNDCKAVRVMRTNKNTLAVEVYSLKTDSWKMIEAIPPWLKCTWQHLKGTIFNGVAYHIIQKGPIFSIMSFDSGSEEFE

SEQ ID NO: 17445 - protein, 228 aa, uncultured cyanobacterium
HHEVATAQHELGMKFAELISAADNVMIYKYVVRNIAKKYGKTATFMPKPVFADNGSGMHVHQSLWKAGQPLFWGEGTYANLSQTARWYIGGLLKHAPSFLAFTNPTTNSYKRLVPGFEAPVNLAYSQGNRSAAVRIPLTGTNPKAKRLEFRSGDALSNPYLGFAAMLMAGIDGIKNQIDPGDGTDVDLFELSAEELAKISTVPASLNGSLEALKADHEYLLAGDVFTA

SEQ ID NO: 17446 - protein, 457 aa, Xanthomonas oryzae pv. oryzae KACC10331
MAMDRCAAIILQLVSGVLPPLLVTDRPMTTIAKILAREILDSRGNPTLEAEVTLDDGSFGRAAVPSGASTGTKEAVELRDGDKTRYLGKGVRHAVDNVNGTIAETLKNFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFYSLKSVLKGHGLSTAVGDEGGFAPDFRSNVEALDTILEAIGKAGYTAGEDILLGLDVASSEFYDNGKYNLVGENKRLTSEQFVDFLADWVAQYPIISIEDGLAEDDWAGWKLLTDRVGKHVQLVGDDLFVTNPKIFKQGIDSGTANAILIKVNQIGTLTETLEAIAMAHAANYASIVSHRSGETEDTTIADIAVATTATQIKTGSLCRSDRVAKYNQLLRIEQALGSDARYAGRDAFVSIKR

SEQ ID NO: 17447 - protein, 228 aa, uncultured cyanobacterium
HEVAGAGQHELGMKFAELIQAADNTMTYKYVVRNVAKKYGKTATFMPKPVFNDNGSGMHVHQSLWKGGQPLFFGEGTEANLSQTARWYIGGILKHAPSFLAFSNPTTNSYKRLVPGFEAPVNLVYSEGNRSAAVRIPLTGPNPKAKRLEFRSGDALANPYLAFSATMMAGIDGIKNQIDPGAPTNVDLFELSAERLSEIDTVPASLNGALEALNADHHYLMEGGVFTK

SEQ ID NO: 17448 - protein, 418 aa, Candidatus Pelagibacter ubique HTCC1002
MSKILKIRARQVFDSRGNPTVEAEVYSKNLSASAICPSGASTGTYEAFEKRDDNNKKYLGKSVLGTVNLVNTKISKKLIGTNIHDQTRIDTILINLDGTRQKTNLGANAILAVSMAAKKLSAKIKNVPLYKTFLVKNNYKLPYPLMNIINGGAHANNGLRIQEFMIRPDKAKSFSEAMRICFVVINNLKKLIIKKGLSTSVGDEGGFAPMISNNEKALDLVVAAINKSSFKNGKDVSICLDVAANELMKKDKYSIHSKKFVSVDQSIKEYKKIINKYKIKSIEDPFGENDWMAWSKLMKNTNNVQIVGDDLYVTNLERLKKGFLNNSSNSILIKLNQIGTVSETLEVIKFAQIIGYKTIISHRSGDSEDTFIADLAVGTNSNQIKTGSLARSERVAKYNQLLRIEEELGKKASMSKIH

SEQ ID NO: 17449 - protein, 228 aa, uncultured cyanobacterium
HEVAGAGQHELGMKFAELIQAADNVMTYKYVVRNVAKKYGKTATFMPKPVFNDNGTGMHVHQSLWKGGEPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADQLAQIATVPASLNGALEALNADKHYLMEGGVFSE

SEQ ID NO: 17450 - protein, 228 aa, uncultured cyanobacterium
HHEVATGGQCELGIRFGKLVEAADWLMIYKYCIKNVAKQYGKTVTFMPKPLFNDNGSGMHTHQSIWNGGQPMFAGDRYAGLSQMALWYIGGILKHAPALLALTNPTTNSYKRLVPGFEAPVNLAYSQGNRSASVRIPLSGDNPKAKRLEFRCPDATSNPYLAFAAMLCAGIDGIKNQIDPGDPLDVDIYDLSPEELAKIPSTPGSLLDALKALEADYEFLTSTGVFTP

SEQ ID NO: 17451 - protein, 372 aa, Streptococcus mutans
MAETNGLKDMIACDTRISAIKDNKLSYAGYDIADLMDNKTRFEEVIYLLWNLHLPTAIELKQFEEKLRKNYAISDAIEQCILIQSRQHLHPMSVLRSTVSLLGVYNLKAEERSVEATYDQSIQLMAKIPTIIATFARLRQGLSPIAPRKDLGFAANFLYMLNGRLPSELEILAMNRALVLHAEHELNASTFAARVCASTLSDIYSCVTTAIGTLKGPLHGGANERVFDMLREIREYGDVDSYLQEKLNSKEKIMGFGHRVYQTQDPREKYLREMARELTKGTEHDIWYQLSKKVEMCMKQKKNLIPNVDFYSATVYHVLGIDSSIFTLIFAMSRVSGWIAHIQEQQKNNKLIRPRSHYTGMRKLRYIPIERR

SEQ ID NO: 17452 - protein, 198 aa, Brassica rapa
MSASRFIKCVTVGNGAVGKTCLLISYTSNTFPTDYVPTVFDNLSANVIVDGNTINLGLWDTAGQEDYNRLRPLSYRGADVFLLAFSLVSKASYENVSKKWVPELRHYAPGVPIILVGTKLDLRDDKQFFVEHPGAVPISTAQGEELKKLIGAPAYIECSAKTQQNVKAVFDAAIKVVLQPPKNKKRKKRKSQKGCSIL

SEQ ID NO: 17453 - protein, 1077 aa, Yersinia pestis CO92
MPKRTDIKSILILGAGPIVIGQACEFDYSGAQACKALREEGYRVILVNSNLATIMTDPEMADATYIEPIHWEVVRKIIEKERPDAVLPTMGGQTALNCALELERQGVLAEFGVTMIGATADAIDKAEDRRRFDIAMKKIGLDTARSGIAHNMEEALAVAADVGFPCIIRPSFTMGGTGGGIAYNREEFEEICERGLDLSPTKELLIDESLIGWKEYEMEVVRDKNDNCIIVCSIENFDAMGIHTGDSITVAPAQTLTDKEYQIMRNASMAVLREIGVETGGSNVQFSVNPKNGRLIVIEMNPRVSRSSALASKATGFPIAKIAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKEAGAERIWYIADAFRAGMSVDGVFNLTNVDRWFLVQIEELVRLEESVAELGINGLTAEFMRHLKRKGFADARLAKLVGAAESEVRKLRYKYGLHPVYKRVDTCAAEFSTDTAYMYSTYEEECESNPTSDRPKVMVLGGGPNRIGQGIEFDYCCVHASLALREDGYETIMVNCNPETVSTDYDTSDRLYFESVTLEDVLEIVRIEKPQGVIVQYGGQTPLKLARELEAAGVPIIGTSPDAIDRAEDRERFQQAVNRLGLKQPANATVATIEQAVEKATGLGYPLVVRPSYVLGGRAMEIVYDEIDLRRYFQNAVSVSNDAPVLLDRFLDDAVEVDVDAICDGERVLIGGIMEHIEQAGVHSGDSACSLPAYTLSKEIQDVMRQQVEKLAFELCVRGLMNVQFAVKNNEVYLIEVNPRAARTVPFVSKATGMPLAKIAARVMVGQSLAEQGMLEEIIPPYYSVKEVVLPFNKFPGVDPILGPEMRSTGEVMGVGRTFAEAFSKAMLGSQSGMKKSGRALLSVREGDKHRVVDLAAKLLKQGFELDATHGTAVVLGEAGINPRLVNKVHEGRPHIQDRIKNGEYTYIVNTTAGRQAIEDSKLIRRSALQYKVHYDTTLNGGFATAMALNADPTDQVISVQEMHAKIKNMKA

SEQ ID NO: 17454 - protein, 567 aa, Zea mays
GRTGRARAAVSVPPPAGEQVPTERLEPRVEERAGGYWVLKEKYRAGLNPQEKVKLEKEPMALFMEGGIQDLARVPMEQIDAAKLTKDDVDVRLKWLGLFHRRKHQYGRFMMRLKLPNGVTTSEQTRYLASVIEAYGADGCADVTTRQNWQIRGVTLPDVPAILDGLRAVGLTSLQSGMDNVRNPVGNPLAGVDPHEIVDTRPYTNLLSSYVTNNSQGNPTITNLPRKWNVCVIGSHDLYEHPHINDLAYMPAVKDGEFGFNLLVGGFISPKRWAEALPLDAWVAGDDVVPVCKAILEAYRDLGSRGNRQKTRMMWLIDELGMEVFRSEVEKRMPNGVLERAAPEDLVDKRWERRDYLGVHPQKQEGLSYVGLHVPVGRLQAADMFELARLADEYGTGELRLTVEQNIVLPNVSNERLDALLAEPLLQEQRLSPRPSMLLRGLVACTGNQFCGQAIIETKARALQVAREVEKRVAVPRPVRMHWTGCPNSCGQVQVADIGFMGCLTKDSDGKIVEAADIFVGGRVGSDSHLADVYRKSVPCKDLVPIVADLLVERFGAVPREREEDEE

SEQ ID NO: 17455 - protein, 183 aa, Methanopyrus kandleri AV19
MITVLVLGDAHIPERAQEVPHTLKRKIEELAPVDVVISPGDYTTEDTIEWIASLGEKALMVVGNCDFGLPLPPRVTEDIGEVKVTVDHGSGVHPRGDPDQLAAIAEEEGADVIFTGHTHRPEFKEHRGVLIVNPGSLTGVPSGGGPSPGPSFMYGTIDGKEVWMKLYMLKGDRLETEEFETEL

SEQ ID NO: 17456 - protein, 422 aa, Chlamydia trachomatis D/UW-3/CX
MSHLFSKACQYFPGGVNSPVRACRAVNITPPIVARASKEVFVDSLDKTFIDFCGSWGSLIHGHSHPKICTAIRQGLERGSSYGLTSEQEILFAEEIFSYLGLETNYKIRFMSTGSEATMTAVRLARGITGRPIIIKFLGCYHGHADTFLQEKPFSHTSLETLDLAHPLTLSLPFNDFPLFQTVMNSLGHKVAGVIFEPVCANMGVILPVPGFIEGVIQTCQQTGSFSIMDEVVTGFRVAQGGAAALYHVKPDILVFGKILGGGLPASAVVTPKDIMDHLAPEGKIFQAGTLSGNPLAMIAGKVSVNLCREQGFYTQLATIEQNFLSPIEHMIRTTGIPVTLVRYGSLFSFFFNPNRPNNLADAQLSDIEAFQKFYQSAFSKGVYLSPSPFEASFLSAAHSMESLDYAQTALIESLEQVFSLV

SEQ ID NO: 17457 - protein, 530 aa, Aspergillus oryzae
MDSDSLQISENKAEIFHDEDLVSIALDDSIEETHPGKAVWLIVCAVSMGGFLFGYDTGVISSVLVNLGSDLGKPLSSNEQELITSITSGGALIGSVAAGMTADKYGRKLAIYVGCIIFFIGSIIQAAAYSLPQMTVGRLVVGFGVGEAAMIVPLYIGEMAPARFRGRLIVFDNICVTFGQLVSYALGAAFTDVASGWRYMVGLGAVPALLLVAMMPFCPETPRQLVLHGRLEEARRVISKIFPRATDRQVDAKARLIRYSIEEATASISNKSLAWQMRQLFTVGQNVRALITACAVMAVSQLGGFNSLMYYASTLFSMVGFDKPTVVSIVVGATNFIFGFPNFIFIDRFGRRRMLLVTILGMASILFKICLSLVVASVAFHWIPVNHDLTAVETREMGWPNILLLVSLIVYIAFYSAGVAPISWVGTEFLPLEVRALGTMMNSVTCWGCNIIISSTFLSMMKGMTPSGTFGFYAGICLLGFIFAIFCYAEVHNMPLESVREIYNHGFGVKYAREVQKELHEARDAEGSTA

SEQ ID NO: 17458 - protein, 242 aa, Chlamydia trachomatis D/UW-3/CX
MSKQPENSFSSDKFFPIKQKLALEAVALVEPGMCVGLGSGSTAREFILALGDRVRTERLVITAVASSRISQLLAEAVGIPLSDHSLLQDVDLVVDGADEVDPCLRMIKGGGGALFREKILLQSGKRNVILVDERKLVPTLGKFSLPIEIAPFGCSSVQRILNKQGYFGEWRETSAGERFITDNGNYIYDVRTPDSYANPEEDMIRLLQIRGIIDVGFVIAKAEVWVGYADGSIVRKKEHNEY

SEQ ID NO: 17459 - protein, 476 aa, Bradyrhizobium japonicum USDA 110
MVAKCTTAEDLVKAITDEKVQMIDLRFTDLPGVWQHFSVPPSAVNADALNEGIGFDGSSIRGFQEIQESDMLVVADPTTAFVDPYSPAKTLVLICNIRDPVTGQSYSRDARYIAQKAEIHLKGTGRADTSYFGPEAEFFVFDEVRYAQGINYAMHAVDSSEGSWNTGSEEGPNLGHKPRPKEGYFPVPPTDSMQALRTEMVLTMESLGIQIEAHHHEVATGGQNEIDMRFTTLTRMADNLMIYKYVVKNTAHQHGKTATFMPKPLFEDNASGMHVHQSLWKGETNLFYDKGDYAELSQLGRYYIGGLLSHAWALCGLCAPTTNSYRRLVPGYEAPINLVYSQRNRSACCRIPMYSPNPRAKRVEFRSPDPSCNPYLAFAAMLMAGLDGIDKQIDPGSPIDKNLYDLPPTEAKEVKSTPGSLDQALDALERDHAFLLRGDVFTADVIETWLDYKRKKEVDPIRLRPHPYEFHLYYDI

SEQ ID NO: 17460 - protein, 489 aa, Arabidopsis thaliana
MEGENSSIEKGLLLIRKEESANTTPFLVFTTFIIVSASFSFGVALGHTAGTMASIMEDLDLSITQFSVFGSLLTFGGMIGALFSATIADSFGCKMTLWITEVFCISGWLAIALAKNIIWLDLGRFFVGIGVGLLSYVVPVYIAEITPKTVRGTFTFSNQLLQNCGVATAYYLGNFMSWRIIALIGILPCLIQLVGLFFVPESPRWLAKEGRDEECEVVLQKLRGDEADIVKETQEILISVEASANISMRSLFKKKYTHQLTIGIGLMLLQQLSGSAGLGYYTGSVFDLAGFPSRIGMTVLSIVVVPKAILGLILVERWGRRPLLMASAFGLCLGCISLALAFGLKGVPGVNVNVTPTLAFIGIMVSKNQFSNLYYLQNKKSYFFVLCKCYFLVITFVMMFAAGLGALPWIIMSEIFPMDMKVVAGSLVSITNWFTGWIVSYCFNFMLLWSPTGTFIIFATISGATVVFAWCLVPETRGLTLEEIQRRAN

SEQ ID NO: 17461 - protein, 321 aa, Escherichia coli CFT073
MSEALLNAGRQTLMLELQEASHLPERLGDDFVRAANIILHCEGKVVVSGIGKSGHIGKKIAATLASTGTPAFFVHPAEALHGDLGMIESRDVMLFISYSGGAKELDLIIPRLEDKSIALLAMTGKPTSPLGLAAKAVLDISVEREACPMHLAPTSSTVNTLMMGDALAMAVMQARGFNEEDFARSHPAGALGARLLNKVHHLMRRDDAIPQVALTASVMDAMLELSRTGLGLVAVCDDQRLVKGVFTDGDLRRWLVGGGALTTPVNEAMTVGGTTLQSQSRAIDAKEILMKRKITAAPVVDENGKLTGAINLQDFYQAGII

SEQ ID NO: 17462 - protein, 457 aa, Nocardioides sp. JS614
MAATASSYSITMRLHTAPDHGVVGAVATAISAAGGIVTAIDVADSSHARLVVDVTCSASDAEHAERLHAAAESVEGVAVHRVSDRTFLLHIGGKIEVTSKVPLRNRDDLSMAYTPGVGRVSMALAESPGDVPRLTVKGNSVAVVTDGSAVLGLGNIGPGAALPVMEGKAALFKRFADIDAWPICLASQDTDEIVRAVEMIAPGFGGINLEDIAAPRCFEIERRLRESLDIPVFHDDQHGTAIVVLAALTNALRVVKKDITDVRIVVSGGGAAGTAIVTLLLAAGAPDIVVWDREGCLSRDDDTLPPAKRQLAEMTNPRLVRGDLRAGLDGADVFIGVSGPGVLDAEWIKDMAPDPVVFALANPDPEVDPAEAEKYAAVVASGRSDYPNQINNVLAFPGVFRGLLDARASEITLDMLLRAAEAIALVVKDEELNPAFIIPTVFHPDVQRKVAAAVRGV

SEQ ID NO: 17463 - protein, 430 aa, Campylobacter jejuni RM1221
MKTQMNYAKEGIFTKEMQIVAQKENLSKDFLLENIACGKIIIPANINHKSLDPNGIGFGLRTKVNVNLGVSNDCVDYSEEMKKVELAHKFDIEAIMDLSNYGKTSRFRDELVNVSKAMIGTVPVYDAVGFLEKDLKQIGAKDFLDVVYHHAKSGVDFMTIHAGINSRAAHIFKQSKRLTNIVSRGGSVLYAWMMMKDAENPFFEYYDDLLDICLKYDVTLSLGDALRPGSTHDASDGAQISELIELSLLTQRAWDVGVQVMIEGPGHMAINEIEANMQLEKRLCKGAPFYVLGPLVTDIGAGYDHISGAIGGAVAAASGADMLCYVTPAEHLRLPNLEDVREGIVATKIAAHAGDIAKLPKERARDDEMSKARQEIDWEKMFKLAIDGEKAKKMFNERRPDDLNSCSMCGKMCAMNTMNQILKGEDVSLA

SEQ ID NO: 17464 - protein, 228 aa, uncultured cyanobacterium
HEVATGGQCELGFRFGKLIEAADWLMTYKYVIKNVARKYGKAVTFMPKPIFGDNGSGMHCHQSIWKDGQPLFAGDKYAGMSEMGLYYIGGILKHAPALLAITNPTTNSYKRLVPGYEAPVNLAYSQGNRSASVRIPLSGGNPKAKRLEFRCPDATSNPYLAFAAMLCAGIDGIKNKIHPGEPLDKNIYELSPEELSKIPSTPGSLELALEALENDHAFLTESGVFSED

SEQ ID NO: 17465 - protein, 100 aa, Glycine max
  misc_feature (68)..(68): Xaa can be any naturally occurring amino acid
  unsure (1)..(100): unsure at all Xaa locations
MTRPQDAIRAFFRSGNASRMISPKGPRTSSQLATIVHAFEATVDERLKKLIPPSLDDILHLTWMALCXQALCKSHNDFLTPEPQTELTGPECDEKRIDEY

SEQ ID NO: 17466 - protein, 323 aa, Bacillus anthracis str. Sterne
MNNMKLQLMYSFLRSDINVIEKELKKTVASEQPLVEEAALQLIEAGGKRIRPVFVLLAGKFGDYKLDAIKHVAVALELIHMASLVHDDVIDAAFLRRGSATVNAKWGDRIAMYTGDYLFAKSLECITNIEIPEAHQALSHTILEVCKGEIEQIKDKYNYDQNLRTYLRRIKRKTALLIAASCQLGAIAAGANRDTVSRLFWYGYFVGMSYQIIDDILDFVSTEEKLGKPAGGDLLQGNITLPALYAMEDPILCKKIRSVHENTTADEMKEIIEAVKNSAAIDKAFAFSERYLHKALEMIKPLPRGQAKYALQNVAKYIGKRKF

SEQ ID NO: 17467 - protein, 228 aa, uncultured cyanobacterium
HHEVATGGQNELGIRFATLVSAADYLMTYKYVIKNVAKKYGRTVTFMPKPLFNDNGSGMHTHMSIWKEGQPQFWGEGYANLSPMALHAIGGILKHAPALLALTNPTTNSYKRLVPGFEAPVNLAYSQGNRSASVRIPLSGGNPKAKRFEFRCPDATCNPYLAFAAMLCAAVDGIKNEIAPGDPLDVDIYDLSPEELSKIPSTPGSLEAALEALEKDRTFLTDTGVFTQ

SEQ ID NO: 17468 - protein, 228 aa, uncultured cyanobacterium
HHEVATGGQNELGIRFATLVSAADYLMTYKYVIKNVAKKYGRTVTFMPKPLFNDNGSGMHTHMSIWKEGQPQFWGEGYANLSPMALHAIGGILKHAPALLALTNPTTNSYKRLVPGFEAPVNLAYSQGNRSASVRIPLSGGNPKAKRFEFRCPDATCNPYLAFAAMLCAAVDGIKNEIAPGDPLDVDIYDLSPEELSKIPSTPGSLEAALEAVGEGSHFPDGYGVFTQ

SEQ ID NO: 17469 - protein, 362 aa, Vibrio angustum S14
MAGSYNIAVLPGDGIGPEVMQQAHKVLNAIEAKFNLTFNRTEYDVGGIAIDNHGSPLPDATLKGCEQSDAVLFGSVGGPKWEHLAPNDQPERGALLPLRKHFQLFCNLRPAQIHRGLEKFSPLRADISERGFDIAVVRELTGGIYFGQPKGREGEGAQEKAFDTEVYYRYEIERIAKIAFESARLRSKKVCSIDKANVLQSSILWREVVEEIAKDYPDVTLTHMYIDNATMQLIKDPSQFDVMLCSNIFGDIISDECAMITGSMGMLPSASLNQDKFGMYEPAGGSAPDIAGKNIANPVAQILSAALMLRYSLGEETAARAIEQAVSQALEAGELTADLASDKPALTTSEMGDKIAAYIQQA

SEQ ID NO: 17470 - protein, 337 aa, Nostoc punctiforme PCC 73102
MIRVAINGFGRIGRNFARCWVGRENSQIDLVAINDTSDPRTNAHLLKYDSMLGKIKGAEISADDNSIIVNGKTIKCVSDRNPEKLPWRDWGIDLIIEATGVFTSKEGALKHVNAGAKKVLITAPGKNEDGTFVVGVNHHDYDHNIHNIISNASCTTNCLAPIAKVLNDKFGIIKGTMTTTHSYTGDQRLLDASHRDLRRARAAAINIVPTSTGAAKAVALVIPDLKGKLNGVALRVPTPNVSMVDFVVQVEKRTITEEVNQALKDAAEGPLKGILDYSELELVSSDYQGSDASSIVDSSLTLVMGNDLVKVMAWYDNEWGYSQRVLDLAELVAEKWQ

SEQ ID NO: 17471 - protein, 228 aa, uncultured cyanobacterium
HEVAGAGQHELGMKYAELIEAADNVMIYKYIVRNVARKYGKTATFMPKPVFNDNGTGMHVHQSLFKGGQPLFFGEGTYANLSQTARWYIGGILKHAPSFLAFANPTTNSYKRLVPGFEAPVNLVYSKGNRSAAVRIPLTGPNPKAKRLEFRPGDALANPYLAFSAMMMAGVDGIKNQIDPGDGFDEDLFELSAERLASIPTVPASLNGALEALNADKNYLMEGGVFTE

SEQ ID NO: 17472 - protein, 228 aa, uncultured cyanobacterium
HEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSASVRIPLTGPSPKAKRLEFRSGDALANPYLAFSAMVMAGLDGIKNQIDPGDGEDRDLFELPAEELAKIATVPPSLNGALEALNADRGFLTAGGVFSD

SEQ ID NO: 17473 - protein, 514 aa, Arabidopsis thaliana
  misc_feature (328)..(328): Xaa can be any naturally occurring amino acid
  unsure (1)..(514): unsure at all Xaa locations
MSFLSFSPISLDLLSSNVFLTILAIIISGLLKTITYRKHNSNHLNLPPGPPGWPVIGNLFQFTRSGKQFFEYVEDLVKIYGPILTLRLGTRTMIIISDASLAHEALIERGAQFATRPVETPTRKIFSSSEITVHSAMYGPVWRSLRRNMVQNMLSSNRLKEFGSVRKSAMDKLIERIKSEARDNDGLVWVLQNSRYAAFCVLLDICFGVEMEEESIEKMDQLMTAILNAVDPKLHDYLPILTPFNYNERNRALKLRRELVDFVVGFIEKRRKAIRTATVSSFSYLDTLFDLRIIEGSETTPSDEDLVTLCSEFLNAGTDTTGAAIECXIAELIANPEIQSRLYDEIKSTVGDRAVDERDVDKMVLLQAVVKEILRRHPPTYFTLSHGVTEPTTLSGYNIPVGVNIEFYLPGISEDPKIWSEPKKFDPDRFLSGREDADITGVAGVKMMPFGVGRRICPGMGMATVHVHLMIARMVQEFEWLAYPPQSEMDFAGKLVFAVVMKKPLRAMVRPRVQ

SEQ ID NO: 17474 - protein, 434 aa, Bradyrhizobium japonicum USDA 110
MDAKASNKTATLTVGNKNYDLPIHSGSVGPDVIDIGKLYGQSGLFTYDPGFTSTASCQSKITYIDGDAGVLEYRGYPIEQLAENGDFLETCYLLLYGNLPTAAQKKDFDDRVIHHTMVHEQMARFFQGFRRDAHPMAVMVASVGALAAFYHDSTDINDPKQRMIASMRMIAKIPTLAAMAYKYTIGQPFVYPKNSLKFAENFLHMCFAVPCEEYKINPVLADALDKIFILHADHEQNASTSTVRIAGSSGANPFACIAAGIACLWGPAHGGANEAALAMLAEIGSVDKIPEFIAKVKDKNSEVRLMGFGHRVYKNYDPRAKIMQKMCHAVLKETGHGDDPMLKVAMELEKIALSDQYFIDRKLYPNVDFYSGITLKAMGFPVSMFTVLFAVARTVGWISQWSEMIEDPQQKIGRPRQLYTGVTRRDYVAIKDRK

SEQ ID NO: 17475 - protein, 310 aa, Vigna angularis
MENFPVINLENINGEERKAVLEKIEDACENWGFFELVNHGIPLELLDTVERLTKEHYRKCMEQRFKEAVASKGLEGVQGEIKDMDWESTFFLRHLPHSNISEIPDLSEEYRKAMKDFAQKLEKLAEELLDLLCENLGLEKGYLKKAFYGSKGPNFGTKVANYPPCPKPELVKGLRAHTDAGGIILLLQDDKVSGLQLLKDGQWVDVPPMRHSIVVNLGDQLEVITNGKYKSVEHRVIARTDGTRMSIASFYNPAGDAVIYPAPALLERKTQVIDKVYPKFVFEDYMRLYATLKFQPKEPRFEAMKGVNTV

SEQ ID NO: 17476 - protein, 152 aa, Triticum aestivum
  misc_feature (133)..(133): Xaa can be any naturally occurring amino acid
  unsure (1)..(152): unsure at all Xaa locations
MTTAPFLFPSLSRLHSARASSFPKPPVGSGAGVAFPARPYGSSLRLRSSVMAATGVGGNGSPMAPEESTVSSRLGEVKRVTKETNVHVKINLDGTGVANSSTGIPFLDHMLDQLASHGLFDVYVKATGDTHIXDDHHSNEDIALAIGTALLQ

SEQ ID NO: 17477 - protein, 429 aa, Methanopyrus kandleri AV19
MTLMEECRRTVPDTVRKIAEEEGVRPEKLARRVAEGRVVVPAHADRRDEVRPVGIGEGLRVKINANVGTSPEVCDPDLEVEKARAAVDHGADTVMDLSTGGDLREIRRRIMKAVDVPVGTVPVYEAAVEMTRRGRAVVDMDEDDMLRAIERHMEDGVDFMTVHCAVTLDALEDVLRRGRALGIVSRGGAIVAAWMIHHDAENPLYENFDYILELAREHDVTLSLGDAMRPGSVLDANDAAQHRELVVQGELVDRCREAGVQAMVEGPGHVPLDQIPAVVRLQKRVCDGAPFYVLGPVPTDVAPGYDHIAAAIGGAIAAYHGADFLCYVTPAEHLALPDVKDVILGVIATRIAAHAADTARGMKYARRENEEMAEARWNLDWDRQFELAIDPKKPRHYREERPPQAKELCSMCGEYCAIKILKDALEERR

SEQ ID NO: 17478 - protein, 257 aa, Thermococcus kodakarensis KOD1
MLGHAAKLLARARFAIAFTGAGISAESGIPTFRGRNGLWKTYRAEELATPEAFKRDPHLVWEFYKWRMRKILKAEPNPAHKALAELENMGVLKAVITQNVDDLHREAGSRKVVELHGNIFRVRCVSCSYRENLKESGRVFEFVREKELPKCPKCGSLLRPDVVWFGEPLPREALEEAFSLAERADVVLVVGTSGVVYPAAYVPYIVKERGGKVIEVNVERSGITPIADVFIRGKAGEVMPELLRRVKDIMAERNHYG

SEQ ID NO: 17479 - protein, 389 aa, Oryza sativa (japonica cultivar-group)
MDGFPFPPPFDGSYRGGFPSSSAWLDASGGDESSPGSWDKDVHPRGGFMSYFGNHAQNSHLVGAPIYIADASSPPEVEILQGNDDGNGNGNVRTEKRILWTEEEDIILMSAWIEHSTDSTCGADKGGGQYWGEVVESYNKTTPPLRKRNLKQCKDRWHKINRWTDLFECAYVKARRIFTSGYSNQMWIDAAHKFYVDDNKEAKLGPFVLMEVWKICREVSKWKTYNDNLRNARKRKSFHLEGDSEEADDTFDEMPKRPMGQKAAKKAALDAKIKSNGLGSSDDGHSKESPIQLDKFDRYSKFQEENNDKRMKLLDRQEKISSEKLEATKIAHLTAQEYKEGRKLEKESKMMETYNSLISQDTSSMSAEEKAQRVSMMKCLMKTLFPESD

SEQ ID NO: 17480 - protein, 540 aa, Gibberella zeae PH-1
MTFNPPSWAPQLPSQSRSATEVAQRVDFLARGLSKAVGFDAHDGTAWERVVAIYALNTIDYIPVTHAIHRVDGIVTPASSAHSVSELEHQLRSSRAKALFTCAPLLDTAVKAAKTVGIPDKNIFLLPLPDVPSDGSYKSIEDLISEGQNLPPLSIPAWIPGQGKRQTAYLCYSSGTSGLPKAVMISHYNVIACTIMIHTYETMTRQQDGIDTQVALGLLPFSHIYGLVVIAHIAQYRGDETVVMQRFQLDQLLACIQKFRIEQLSVVPPIIVQLLSSQDKCRKYDLSSVRLVFSGAAPLGGETIQKLLEHYPKWRISQGYGLTEASPSVFHTSEADAFLGSSGSLLPGVKVKIIDQHGNEVTEHETPGELYVQGPNVVLGYLHNEKANAETFVWREDGRWLRTGDEVLVRKSERGFEHFFVVDRIKELIKVKGHQVAPAELEAHLLDHPYVADSAVIGIVDERAGEVPLAFIVKSREASGISDEDVVKAVHQHVEEHKARHKWLKGGVRVLDVIPKSPSGKILRRVLKAKVAAEKPVAKL

SEQ ID NO: 17481 - protein, 498 aa, Leptospira interrogans serovar Copenhageni str. Fiocruz L1-130
MQTALYISVLIISSCGLVYELLAGTIASYLLGETVTQFSLIIGTYLFSMGVGSWLSKYLEKDLIPKFLEIELAIGLVGGFSSAILYLSFGQIRYFQIPLFLLVILIGILVGLEIPVLLRILKKELQFKELVSRVLSLDYVGALLASILFPIFFAPKLGLMRTGFIFGILNVGVALWGTWVLPLRQSKIIILRAQSVVVLTLLILGFSYSDLITYYSEESLYTDEIILSKQTQYQRIIVTRWKNEIRLFLNGHLQFSSRDEYRYHETLVHPALLAHPTPKKVLVLGGGDGLAVREILKHKNVESVTLVDLDSAITNLFSEHGILKKLNEESLKNSKVTVINTDAFLWLEESDQIFDVVLIDFPDPSNFSLGKLYTTAFFHTLKRRMNETSVLEIQSTSPLFARSSYWCIERTIASLGFYTLPLHVYVPSFGEWGFVLAGQRPIQFKKDFPKDLKFLNIQELESIQTFPQDMSRVPVEINRLDNQALVRYYDREWNRILD

SEQ ID NO: 17482 - protein, 203 aa, Listeria innocua Clip11262
MYKAIIFDVDGTILDTERAVLHSLQAVLAEEGLSYELDELRFVLGITGAAAVEQLNILDSEKVLDKWIEREATFIEEVEVFEGIHKVLHAIPESGVVTSKNALEMEKGFYPFDIQDHFQAIVCASDTENHKPHPDPLLKGLEILGREPHEVLYVGDSSYDMKCAHAAGAHFGLALWGAKTTDGFEKAELVFEKPEDILAYVSK

SEQ ID NO: 17483 - protein, 264 aa, Manihot esculenta
MLPTESSREENVYMAKLAEQAERYEEMVEFMEKVAKTVDVEELTVEERNLLSVAYKNVIGARRASWRIISSIEQKEESRGNEDHVSIIKEYRGKIEAELSKICDGILSLLESHLIPSASSAESKVFYLKMKGDYHRYLAEFKTAAERKEAAESTLLAYKSAQDIALADLAPTHPIRLGLALNFSVFYYEILNSPDRACNLAKQAFDEAISELDTLGEESYKDSTLIMQLLRDNLTLWTSDITDEAGDEIKDASKRESGEGQPQQ

SEQ ID NO: 17484 - protein, 486 aa, Zea mays
ASRRASPARRAGPGPEQRTARVGAALPLVQPPRPPPGLTPQRREVYLFLLLLRTSASFQLAKRSRAAAMAGAGAPAVPQAGRPAPNFDVIVVGAGIMGSCTAHAAASRGARVLLLERFDLLHPLGSSHGDSRIIRDAYAQPRYLRMVRLARRLWAAAEAEAGYRVLTPTPHLSMGPRSSASLAAAIANIGAEEVDEDDLHRRWGGAFALTVPGPVDAWVTALSDHGGVLSATKAVAMFQSLAVAKGAVVRDNTEVVGIDRAPEPDGGGVVVRAAGGEAFRGARCVVTVGAWAAKLLGSWGVDLPIRPLHTLHLYWRVKPGQEQTVSASAGFPTFSSYGDPPVYGAPSLELPGLIKISCDGGPPCDPDARDWLAGDAEVTHRVARWIQEAMPDHVDAAGGPVVRQSCICSMTPDADFVMDFLGGGRDVVVGAGFSGHGFKMGPAVGKILAEMAIDGGSETAEEAGLDLGFFRIGRFDGNPMGNAKKD

SEQ ID NO: 17485 - protein, 228 aa, uncultured cyanobacterium
HEVAGAGQHELGMKFAELIQAADNVMTYKYVVRNVAKKYGKTATFMPKPVFNDNGTGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELPAEELSKIATVPASLNGALEALNADRGFLTAGGVFSD

SEQ ID NO: 17486 - protein, 228 aa, uncultured cyanobacterium
HEVAGAGQHELGMKFAELIQAADNVMTYKYVVRNVAKKYGKTATFMPKPVFNDNGTGMHVHQSLWKGGQPLFFGEGTYANLSQTARWYIGGILKHAPAFLAFTNPTTNSYKRLVPGFEVPVNLVYSEGNRSAAVRIPLTGPSPKAKRLEFRSGDALANPYLAFSAMMMAGLDGIKNQIDPGDGEDRDLFELPSEELSKIATVPASLNGALEALNTDRGFLTAGGVFSD

SEQ ID NO: 17487 - protein, 228 aa, uncultured cyanobacterium
HEVAGAGQHELGMKFAELIQAADNVMTYKYVVRNVAKKYGKTATFMPRPVFNDNGTGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELPAEELSKIATVPASLNGALEALNADRGFLTAAAFSAT

SEQ ID NO: 17488 - protein, 458 aa, Mycoplasma genitalium G37 [sequence omitted]

SEQ ID NO: 17489 - protein, 228 aa, uncultured cyanobacterium
HEVADAGQHELGMKFAQLIEAADNVMTYKYVVRNVAKKYGKTATFMPKPVFNDNGTGMHVHQSLWKGGQPLFFGEGTYANLSQTARWYIGGILNHAPAFLAFTNPTTNSYKRLVPGFEAPVNLVYSEGNRSAAVRIPLTGPSPKAKRLEFRSGDALANPYLAFSAMLMAGLDGIKNQIDPGDGEDRDLFELAAEELSKIATVPASLNGALEALNADRAFLTAGGVFTD

SEQ ID NO: 17490 - protein, 326 aa, Ralstonia solanacearum GMI1000
MADVNLVEAVNLALAHALEHDPSVVLLGEDIGVNGGVFRATVGLQARFGAERVIDTPLAETALAGAAIGMAAMGLRPVVEIQFSGFIYPAIDHVLNHAARLRHRTRGRLSCPLVIRSPCGAGIHAPEHHSESPEALFAHMPGLRVVIPSSPARAYGLLLAAIRDPDPVIVFEPTRLYRVFRQPVEDNGEALPLDTCFTLRDGTDVTLVSWGGALQAAQAAADQLAQDGVLAEVIDVATLKPLDMETILASVAKTGRCVIVHEAPRTSGFGAEIAANLAEHGLYSLLAPVQRVTGYDVVMPLPRLENQYLPGVERILAAVRKTLEAA

SEQ ID NO: 17491 - protein, 228 aa, uncultured cyanobacterium
HEVAGAGQHQLGMKFAQLIEAADNVMIYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVPPSLNGALEGLSANRAFLTEGGVFTD

SEQ ID NO: 17492 - protein, 256 aa, Aspergillus oryzae
MMGRSSEDEAPHDLQSDVVSRWTQSDLGPAREDKEGALKSDGIEQMPPDSALGLLCVYIELLAKQTIDDPDDCRVDAFSLTKNRAQGDSVSSGEVTPVNGTEIHCCPAGYSDAGRDHVQLGILSKRFLSKRVPSITLKDYLLRLHRYCPMSTAVYLATSMYFTRMVTVDRTISLNHKNMHRLVLAGLRVAMKALEDLSYPHSRIAKVGGVTERELSKLEISFCFLADFELRVDVSMLTNQARALEKNVLHHGEIAS

SEQ ID NO: 17493 - protein, 574 aa, Avena sativa
MALLCSALSNSTHPSFRSHIGANSENLWHLSADPAQKSKRRCNLTLSSRAARISSALESAKQVKPWQVPKRDWFPPEFMFGAASAAYQIEGAWNEGGKGPSSWDNFCHSHPDRIMDKSNADVAANSYYMYKEDVRMLKEIGMDSYRFSISWPRILPKGTLDGGINHEGIQYYNDLLDCLIENGIKPYITLFHWDTPQALADEYKDFLDRRIVKDYTDYATVCFEHFGDKVKNWFTFNEPHSFCGLGYGTGLHAPGARCSAGMTCVIPEEDALRNPYIVGHNLLLAHAETVDVYNKFYKGDDGQIGMVLDVMAYEPYGNNFLDQQAQERAIDFHIGWFLEPMVRGDYPFSMRSLVGDRLPFFTKSEQEKLVSSYDFVGINYYTSRFAKHIDISPEFIPKINTDDVYSNPEVNDSNGIPIGPDVGMYFIYSYPKGLKNILLRMKEKYGNPPIYITENGTADMDGWGNPPMTDPLDDPLRIEYLQQHMTAIKEAIDLGRRTLRGHFTWSLIDNFEWSLGYLSRFGIVYIDRNDGCKRIMKKSAKWLKEFNGATKKLNNKILGASSCCSGVTHGGGTA

SEQ ID NO: 17494 - protein, 574 aa, Corynebacterium glutamicum ATCC 13032
MKPVFSVDQIRRAENTLFELQADPDELMISAASAVADVALAMVDGPAPAVSSEESILLLVGPGGNGGDALYAGAFLAEEGHHVDALLLGNGKVHQSALAYYESLGGQIISDFPPHYLYRLVIDGLFGIGGRGGLTPELASLVESFSASGIPILAIDVPSGVHADSGELPPGVMVTVEGFDNDAPMARQKIPAHIDADVTITFGGLRRAHAVSPACGEVLCADINIAGGGGKSLSAELSQVQAEDATPQMFASKAYQRKDSLFERANLKATAPHIHRIGQHFTVLNMEPGPDHDKYSGGIVGIVAGSGTYPGAAVLSVKAAVRATSAMVRYVGPALNFVIQSLPEVVATQSLATAGRVQAWVHGPGRGLEAEQSAELAELLSRPEPVLIDADSLSLLQLSAELRQALRERKAPTVLTPHKGEFERIAAELRSEGVEIPQADKDPIGAAQALAKEFDCCVLLKGKYTVIAAHDFVHAINAGHSWLATPGSGDVLSGLVGAHLAQSYAELNRLPEFFPDVTLSDSAIYTQIAPAATIHAVAAGLAARTEFGFAPTSASLIADAIPAATAKVDLKRIV

SEQ ID NO: 17495 - protein, 299 aa, Leifsonia xyli subsp. xyli str. CTCB07
MTDSEHSTTGSSRVKRGLAEMLKGGVIMDVVTPEQARIAEDAGAVAVMALERVPADIRAQGGVARMSDPDLIEAIIAEVRIPVMAKARIGHFVEAQVLQALDVDYIDESEVLSPADYVNHIDKWDFTVPFVCGATNLGEALRRIIEGAAMIRSKGEAGTGDVSEATKHIRKITAEIKALTAMSRDELYVAAKELQAPYELVAEIAETGTLPVVLFTAGGVATPADAAMMMQLGADGVFVGSGIFKSGNPERRAAAIVRATTFSDDPSVVAEVSRGLGEAMVGINVADLAAPHRLAERGW

SEQ ID NO: 17496 - protein, 604 aa, Ustilago maydis
MAQPAVRQPTVTRSRISRPGGIPASRSGDRIHLTEAASTSHLAKAKSTKLVGPSTAGKLRADSRSMPQRAALSDVSNRAGVARANALADGAVKLAPGHNGLRSQHTKSMTRLRDARSRSTSEQRLSGPTRSVSEQRDCAPAAAESMHVEASQLLPPFQSSASVKVGISDEAGSSRLHEDADIRDLAGSQHSDHVEEDEMSDVASTSSSDDDTAEDIGVDKANWLDSERLDAGARPESVTSAEDGDMLDFNIDPEGLVSLHPELEEAARRKVALIKSRYQEEVIQPRAARAQAQHAEAVAAGQLSAELAAHEDELIVMGLDPEEVRDTSMVAEYSNEIFSYMARCERETMANPNYMEFQSEIHWHMRATLVDWLLQVHMRYHMLPETLWIAINVVDRFLSVRVVSLAKLQLVGVTAMFIAAKYEEILAPSVKEFVYMTEGGYSQEEILKGERIILSTLGFNISSYCSPYSWVRKISKADDYDIRTRTLSKFLMELALLDHRFLRARPSLVAAVGMFLAKKMLGGEWDDAFVYYSDFTEEQLVPGANLLLERLLDQGFEEQFVYRKYSNKKFLRASVFARDWAFQNHSALLAAAAAAAGSTQAGQP

SEQ ID NO: 17497 - protein, 290 aa, Methanopyrus kandleri AV19
MSVSVSVDAETNVVGLIGHPVEHSLSPAMHNAAFKELGLNYVYLAFDVPPERLEGAVRGAADLGIVGLNVTIPHKEAVMELCDELDRDAELIGAVNTVRFSRGKIEGFNTDGEGFLRALREETYFDPRGTKSVILGAGGAARAVSFKLATEGADEIVIANRTVDRAERLAEELKEKVGVKARAIGLDGDEIERELRDADLLVDATPVGMYPNEDEPPLVTADQMHEDLIVNDLVYNPPRTRLLEEAEKAGATPVSGVGMLVYQGALAFELWTGEEAPVEVMREAVLEHLR

SEQ ID NO: 17498 - protein, 444 aa, Listeria innocua Clip11262
MNPDPESQQIILQLILIVVLTMLNAFFASAEMALVSLNKNRVKNQAETGDKKAVMLAKLVDDPSKFLATIQVGITLAGFFSSASAATSIATRLESVFGGSSFAKELSIIVVTIVLSYITLVFGELYPKRLALQKSEKIARVSVRPIMAVGVVLRPFVKFLSFSTDILVKLTRMEKNTDNEKMTREEMQLLIETGRRDGIIEVEELQMLRGVFEMDNKYAREVMVPRTDAFMIDAETESEELCDALLSENFSRVPVYTGDQDSVLGILHMKDFFAEARKSGFENIDVKSLVKNAYFAQETMFIDDLLKNMQRTRNQMAILMDEYGGVAGIVTVEDLLEEIVGEIDDENDVFSDEVKKIDDNTFIVEGRMPLDDFNKMFHVELPARGVDTVAGFVLTLTGTIPEEDDKVVVEYDTLRFTVEEMNDARLVSVRVEKDIQTSELEQLA

SEQ ID NO: 17499 - protein, 229 aa, Listeria innocua Clip11262
MNNLKEAIKQAEHIVFLTGAGVSVPSGIPDYRSKNGLYAGMSSPEYMLSHTCLVREPEKFYQFVTENMYYPDAVPNTIHRKMAEIEADKNVTVITQNIDGLHEKAGSKKVVNFHGSLYHCYCQKCGRSVSASDYLQSDIHADCGGVVRPDVVLYEEAISESAIDQSLAAIREADLIVIVGTSFRVSPFCNLTDYRNKKARIFAVNKERISLPYPFEMIENDAVKVFAEI

SEQ ID NO: 17500 - protein, 129 aa, Exiguobacterium sibiricum 255-15
MSSFQKIETTNAPAAIGPYSQGFIANGTLYASGQIPINPATGEMVAGGITEQTEQVMKNVDAILKEAGLTPNRVVKTTCYLTSMDHFAAFNDIYSDYFAPHNHFPARSCIAVKELPKGALVEVEILGLV

SEQ ID NO: 17501 - protein, 451 aa, Zea mays
MGNCCPGSGDAEPAPAASADPSSRLHSGGTSLKAGASVSSAPTPTKPPAPIGPVLGRPMEDVRSIYTVGKELGRGQFGVTSLCTHKATGERFACKTIAKRKLSTKEDVEDVRREVQIMYHLAGQPNIVELKGAYEDKQSVHLVMELCAGGELFDRIIAKGKYTERAAASLLRTIVEIVHTCHSMGVIHRDLKPENFLLLSKDDNAPLKATDFGLSVFFKQGEVFKDIVGSAYYIAPEVLKRNYGPEADIWSIGVIVYILLCGVPPFWAESEHGIFNSILRGQVDFTSDPWPRISPSAKDLVRKMLTSDPKKRISAYDVLNHPWIKEDGEAPDTPLDNAVMNRLKQFKAMNQFKKAALRVIAGCLSEEEIRGLKEMFKSMDADNSGTITVDELRRGLAKQGTKLSEAEVEQLMEAADADGNGTIDYEEFITATMHMNRMDRDEHLYTAFQYF

SEQ ID NO: 17502 - protein, 258 aa, Prochlorococcus marinus subsp. pastoris str. CCMP1986
MSSHKLFLFDFDGVIVDGMNEYWHSSLLAFEKFINSPKILIDQNLYKQVSNTFIEMRPWVKYGWEMLIIVHQIIKSEDPLNNQNKINFLNKYHQNCQKVLLENSWVAEDLQKCLDKARKYQIENDFDNWIRLHRPFYEVIVFIEKLKKEKIKTGIITTKGKIFAGKILEKLNIYPELIFGYESGTKVEIISELWREYEIMGFIEDRRNTLLDIKQNPVTSNIPCYLADWGYLKNIDRLNLPLEIKLLKLKSLEDLLAI

SEQ ID NO: 17503 - protein, 507 aa, Ashbya gossypii ATCC 10895
MSKNAEGNNKENGSESDLSVTIKLPNGVEYEQPTGLFINNEFVRSKLGGMMEVIAPATEEVVTRVYEGTSEDVDIAVSAAQKAFKSGKWFGADPMVRVKALSKLADLIEEDLEVIASIEFLDNGKVFSHARFDIGMVVNYLRCCAGLADKVDGRSIDTGSSHLTYTRREPIGVCGQIIPWNFPLLMWAWKVGPALATGNTVVLKTAEFTPLSALYVSNHVRKAGIPAGVVNIISGYGKTVGEAIIRHPGVKKIAFTGSTATGRHIYEVAAKDLKKVSLELGGKSPNIIFADADLKKAAQNVLNSIFFNGGEVCCAGSRMYIEEPIYEEFLQEIKAVAESVKVGDPSWKDTFQGAQTSQMQLDKILSYIEIGKQEGARVVTGGERLGEKGYYVKPTIFADVREDMRIVKEEIFGPVVTVTKFTNIDDLLEMANDTQYGLAAGVYSSSMKKAIDVANRLDAGTVWINTYNDFHCSVPFGGYKGSGFGREMGAEVVENYTQVKAVRALLL

SEQ ID NO: 17504 - protein, 228 aa, uncultured cyanobacterium
HEVAGAGQHELGMKFAELIQAADNVMTYKYIVRNVAKKYGKTATFMPKPVLNDNGSGMHVHQSLWKGGQPLFFGEGTYANLSQTTRWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGDGVDVDLFELAADELKKIATVPASLNGALEALNSDHHYLLEGGVFTK

SEQ ID NO: 17505 - protein, 530 aa, Triticum aestivum
  misc_feature (32)..(32): Xaa can be any naturally occurring amino acid
  unsure (1)..(530): unsure at all Xaa locations
MNLESVLSPAALPWSYLACGLLSLALLYGQPXRLLEQLWWRPRRLERALRAQGLRGTSYSFLLGDMSDYGRQNKEAWSKPLPLRCHDIGAHVMPFLYSTVQEHGKQCISWFGPVPKVSITDPNLVREIMSNKFGHIQKVKFPALSKLLAVGVATHEGEKWVKHRRILNPAFHVEKLKIMLPAFSLCCEELVNKWAQSLGPDGSCEVDASLELQSLTGDVISRTAFGSSYLEGRRIFQLQSEQVGRFMAAIHKIMIPGYMSFPTKNNRRMRQINNEIESILRGLIGKRMQAMQEGESTNDDLLGLLLESNKTDVNENGQSIPGMSTEEVIEECKLFYFAGMETTSILLTWMMVVLSMHPEWQDRAREEVLGLFGKHKLDYEGLNRLKTVTMILYEVLRLYPPASAFTRQTYKEIEIRGIRYPPGVIFEMSVLHIHHDKDIWGDDVHQFRPDRFAEGISKASKEPGAFFPFGWGPRICIGQNFALLEAKMALCMILRRFEFELAPSYTHAPHTVMMLRPMHGAQIKLRAISL

SEQ ID NO: 17506 - protein, 211 aa, Staphylococcus aureus
PSADMLFEPSFVNDIDVNENDVVHFCSVDLIDSPMREAHYQLITKTLNANGTVVFDPNVRLPLWDNAEDLRQTIHTFLPLAHIVKVSDEELEFITGIHDENKAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 17507 - protein, 1191 aa, Arabidopsis thaliana
MDQAKGYEHVRYTAPDPRDEGLGSINQRFSHDSSTNVNTYVRPPDYGVSTPARPVLNYSIQTGEEFAFEFMRDRVIMKPQFIPNVYGEHSGMPVSVNLSALGMVHPMSESGPNATVLNIEEKRQSFEHERKPPSRIEDKTYHELVQSAPVISSKNDTGQRRHSLVSSRASDSSLNRAKFLCSFGGKVIPRPRDQKLRYVGGETRIIRISKTISFQELMHKMKEIFPEARTIKYQLPGEDLDALVSVSSDEDLQNMMEECIVFGNGGSEKPRMFLFSSSDIEEAQFVMEHAEGDSEVQYVVAVNGMDLSSRRSSLGLSPPGNNLDELLHGNFDRKIDRAATEPAVASLTPLAGNESLPASQTSQPVTGFSTGNEPFSQPYLGQQLQFPGLGNHQIYTSGHMASIGYIDEKRSAPLHVQPQPHYIPYSVNPETPLESLVPHYPQKPEQGFLREEQIFHVQDPETSSKEAKMRRDDSFQKVNDHPISTVESNLSAKEPKMRRESSTPRVNEYPVSSMPSDLIVPDDLPKEEAPIVTQTSSSTPDPSSSTLSEKSLRKSEDHVENNLSAKEPKMRKEHSTTRVNEYSVSSVSSDSMVPDQALKEEAPISMKISNSTPDPKSLVYPEKSLRTSQEKTGAFDTTNEGMKKNQDNQFCLLGGFSVSGHGTSNNSSSNVSNFDQPVTQQRVFHSERTVRDPTETNRLSKSDDSLASQFVMAQTTSDAFLPISESSETSHEANMESQNVHPTAPVIPAPDSIWTAEGSMSQSEKKNVETNTPEHVSQTETSAKAVPQGHNEKGDIVVDINDRFPREFLADILKTKESLNFPGLGPLHADGAGVSLNIQNNDPKTWSYFRNLAQDEFERKDLSLMDQDHPGFPTSMTNTNGNAGVPLIDFMAADSGMRSLQVIKNDDLEELKELGSGTFGTVYHGKWRGTDVAIKRIKRSCFIGRSSEQERLTSEFWHEAEILSKLHHPNVMAFYGVVKDGPGGTLATVTEYMVNGSLRHVLLSNRHLDRRKRLIIAMDAAFGMEYLHSKSIVHFDLKCDNLLVNLKDPARPICKVGDFGLSKIKRNTLVTGGVRGTLPWMAPELLSGSSSKVSEKVDVFSFGIVLWEILTGEEPYANMHYGAIIGGIVNNTLRPTVPNYCDPEWRMLMEQCWAPDPFVRPAFPEIARRLRTMSSSAVHTKPHAVNHQIHK

SEQ ID NO: 17508 - protein, 421 aa, Arabidopsis thaliana
MVSYRATTETISLALEANSSEAITILYQVLEDPSSSPEAIRIKEQAITNLCDRLTEEKRGEDLRKLLTKLRPFFSLIPKAKTAKIVRRIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKDYKTGYSYFFEAFESFNALGDPRAVFSLKYMLLCKIMVSQADDVAGNNLLKGWTTVGPDLDAMKAVADAHSKRSLKLFENALRDYKAQLEDDPIVHRHLSSLYDTLLEQNLCRLIEPFSRVEIAHIAELIGLPLDHVEKKLSQMILDKKFAGTLDQGAGCLIIFEDPKADAIYSATLETIANMGKVVDSLYVPVCQNHVPEK

SEQ ID NO: 17509 - protein, 246 aa, Bradyrhizobium japonicum USDA 110
MCENCGSVRGAHIRPSRRSLIHFTVSAIGLAFAGTAFAKEAKAPPKPQNVLAPDAALKRLMEGNARYVEGVSRRHDFKHEREALAGGQNPFAAVLSCADSRIAPEYAFDTGRGDLFVCRVAGNFAGTETIASMEYAVAVLGAPLILVLGHDSCGAVDATLKAIKDNTSPPGHIPSLIDAIAPAAKAAMQQGGDVLDKATRQNVIDNVAKLKSAAPILNAAVEQGKLKVMGGIYRLTTGTVDLIAQG

SEQ ID NO: 17510 - protein, 226 aa, Brassica napus
EFLILKSRGGESPLSPIKILSRLQKIGKHLGPGKQEDAHEFLRCAVDTMQSVFLKEADAAGPFAEETTLVGLTFGGYLHSKIKCMKCLHKSERTELMMDLTVEIGGDIGSLEEALAQFTAYEVLDGENRYLCDRCKSYQKAKKKLMILEGPNILTVVLKRFESDNFGKLSKPIHFPELLDISPYMSNPNHGDHHPVYSLYAVVVHLDATSYSGHYVCYIKNLHGDW

SEQ ID NO: 17511 - protein, 636 aa, Candidatus Carsonella ruddii
MLYNIINNIRLICIKSISKANSGHPGMPLGICDVFTIFFLNFYKINFNNLKSINKDKLIISNGHGIITNYVLLYLYNVYKIKDLINFRRFNSNTPGHPEIGNFIDASTGPLGQGIGIGIGIGLKSKKYKNKFNNFFNIFNNKVWIFCGDGCLMEGVSSESCSFCGCYNINNIILLYDSNNISIDGNVKNYFNENIKLKFISLNWNVIGPINGHCYFSIIKSLLKAKKSYFPTIIIYNTIIGFISPCKSYKENSHGNIFTKFEFLEILKNFTLTYDYVKKMFFDNKKKYLIYYKKKYKKYFFELIRIFNNIIPKINFLKLYFKYYKINLNKSTRFVCSNILKNIYAINETFGGSADLTNSNLTKNNFINSIRYKNFKNRYINYGVREFTMGLINYGLSSDKIGINYCSTFLVFSNYMYSAIRNFCLSKLKNIFIFTHDSILVGEDGPSHQPIEQLHSIRIIPRNYIFRPYNYIELILCWILILKFLNNCSSLILSRQNFKNNFIKIYNIKNIITGTYSCFYKKKIELIIVSNGSDLEICFECYFFLKKYFIIQIISLFCNKLFDKQKKIYKNKILNCKKIIFVESSNDDFWYKYKKYFTYVLNIKKFGYSSNELELKKKTNLNKKFLIKLCLFVIKL

SEQ ID NO: 17512 - protein, 507 aa, Thermococcus kodakarensis KOD1
MVEPFVPEGEIFEGIFRQNEGIPEFATYVNGEWVFTGKTAEVRSPIDGSLIARVSLSDMALSNRAVAAAYSAGRHEIRDTPGEKRLEAFLKVAELIRDSFDDFVTALVLDAGKPLSNARGEVTATIERLEKTTMEFGRLIGDYIPGDWSAESLGSEGIVKREPYGVVLAISPYNYPLFISTAKIVPALLAGNAVLLKPSSQDPLAPLLLSRVLQLAGIPESAYHLLTVPGALMDSILADRRIRAVTFTGSTEVGEHILSMGGIKFYHMELGGKDPAVVLDDAPLEETVEKLVKGMVSYSGQRCDAIRLIIAEEGIYEQLKRELVAALSKIEPENPLEDEDAIMGPLINERSAEKIEEVYRDALEKGAVPLTGFKRKGAYVWPVLLEASREVLPGLRAFQEDVFGPLTILVKVSNEDEAVELANSSRFGLDAAVFSGDDSRARKVARRLEVGAVFINEFPRHGIGYYPFGGMKDSGIGREGIGYSIETLTTTKTIVRNYRGRGVWDYI

SEQ ID NO: 17513 - protein, 340 aa, Chlamydia trachomatis D/UW-3/CX
MHPLTLNIASEETTEARVFHVIENFGNSFCIDLLKKMLLIREFEIRGEEAYLEGLVGGFYHSYIGQEAVATAAIACTGKDHWFFSSYRCHGVALLLDIPLRQLAAELLGKETGCALGRGGSMHMCGDRLPGGFGIVGGQIPLAAGAAFSMKYQNSSSISMCFIGDGAVAQGVFHETLNFVALHSLPLMLIIENNGWSMGTALHRAIAKQPIAESQAISYGLSSITLNGFDLFNSLIGFREAYHHMQQTGSPIIVEALCSRFRGHSISDPNLYRSKEEMQCLLKRDPILFAKEWLIRANVLSEDDFKDLRQTSKTAVLEAVAQARLDPEPAVATLEEGVYA

SEQ ID NO: 17514 - protein, 328 aa, Chlamydia trachomatis D/UW-3/CX
MPNFVTLEIREAIRQAIDEEMTRDPNVCILGEEVAEYNGAYKVTKNLLDKWGPTRVIDTPISEAAFSGIGIGAALTGLRPIIEFMSWNFSLVAADQIISHAAKMYYMTGGKFAVPIVFRGANGAAAQVSCQHSHCIEALYANIPGLIVIAPSTPADAKGLLKSAIRDNNPVLFLENELDYNLKGEVPSEEYLIPIGKARIVQEGKDLTIISHSRMVSIVEQAAKTAKQRWGLSIETIDLRTIKPLDVATLLTSVKKTGNCLVVEEGHYFCGISSEVITTITEHIFDYLDHPPLRVCQKETPMPYNKTLEMATLPNINRILDAIEKIMR

SEQ ID NO: 17515 - protein, 429 aa, Chlamydia trachomatis D/UW-3/CX
MVSLLKMPKLSPTMEIGILVKWHKKAGDEIHFGDVLLEISTDKAVLEHTASEDGWLLEILVEEGTKTPIGTPIAVFSTEQNAQYDLKQLLPLEGTVVTDAATEASPKNSAQTDSQYTSGPSITMMGFRPEPPLAIPLTIKHSNDPVLASPLAKKLAKEQNLDLSGVTGSGPGGRIVKKDLEKAPPLRIAGFGYPEAPNVNPGSYIEEPLSPVREVISKRLQAAKTFIPHFYVRQRIYASPLLALLKELQEQNIKLSINDCIVRACALALKEFPEINSGFNSVDNKIIRFSTIDISIAVAIPDGVIAPIVRCADRKNIGMISAEIKGLATKAKQQSLAEEEYKGGSFCVSNLGMTGISDFTAILNPPQAAILAVGSVEEQPVVLNGELAVGLTCMLTLSVDHRVIDGYPAAMFMKRLQRLLEAPSVLLLN

SEQ ID NO: 17516 - protein, 547 aa, Corynebacterium diphtheriae NCTC 13129
MSFDVTTTEPWATLSERYTAMKATTLRDLFASNPNRAQELSFEAAGLHVDLSKNLIDAETVAAFTALAKASGMREKIKAMFDGEHINNTEDRAVLHTALRLAVDAELNVDGQDVAADVHEVLGRMRDFATSLRNGSWRGYSNHTIKTIVNIGIGGSDLGPAMATKALRTYATAGINAKFVSNVDPADMHAVLDELDPESTLFVVASKTFTTQETLANAHAAKRWLVAAAGGDESAVAKHFVAVSTNAEKVAEFGIDTKNMFGFWNWVGGRYSVDSAIGLSLMSVIGPMDFMRFLDGFRAMDEHFRTADFESNIPVLMGMLNVFYNDFFGAETHAVLPYSQDLGRFPAYLQQLTMESNGKSVRHDGSAVTTNTGEIYWGEPGTNGQHAFFQLIHQGTKLIPADFIGFARPKEDLPTASGEGSMHDLLMSNFFAQTKVLAFGKTAEEIAAEGVSPELVAHKVMPGNRPTTTIMAEELTPFALGALIALYEHIVFVEGVIWDINSFDQWGVELGKQQANDLAPAVAGEVAVDSGDSSTDALISWYRSHRG

SEQ ID NO: 17517 - protein, 86 aa, Triticum aestivum
MPCDDKCGCAVPCPGGAACRCAGKKQSSGGGGAVPVNPAAVAHTTCTCGEHCSCRPCACGRLGSGDGAGRADCTCGPTYTCVVCTA

SEQ ID NO: 17518 - protein, 363 aa, Vibrio fischeri ES114
MTNKTYKIAVLPGDGIGPEVMEQAHKVLDAIEKKHAISFSREQHDVGGIAIDNHGCPLPESTVKGCEESDAVLFGSVGGPKWEHLPPNDQPERGALLPLRKHFQLFCNLRPAQIHKGLENFSPLRADISERGFDIVVVRELTGGIYFGQPKGREGEGPQEKAYDTEIYHRYEIERIAKIAFESARLRNKNVYSIDKANVLQSSILWREVVEEVAKGYPDVTLNHMYIDNATMQLIKDPSQFDVMLCSNIFGDIISDECAMITGSMGMLPSASLNESNFGLYEPAGGSAPDIAGKNIANPVAQILSAALMLRYSLGEEEAAQSIEAAVSKALSAGELTADLAGDKPALTTSAMGDKIAEYILNS

SEQ ID NO: 17519 - protein, 456 aa, Kluyveromyces lactis NRRL Y-1140
MSSSVQSGVITLLHTACGAGILAMPYAFKPFGLILGLSMIIFCGLCSSTGLYLQSYVSKYVPPGHASFFTLCRLTRPELSVVFDAAIAVKCFGVGVSYLVVVGDLLPQIMSTFTTHGWLLSRQFHITAVTLIIVTPLCFIKKLDSLRYTSSIAITAVGYLCVLVVFHFAVPNSEIDHLRGHVSIWKPSDVDSSMLSSFPIFVFAYTCHHNMFSIINEQSDKSLDSITKLIRIAITLAMSLYISIGALGYCTFGDHITGNIITLYPNSISSTIGRIAIALLVILAFPLQCHPARASVNHILHYFSKGNTHPPMTTTSAEQNSLLRDSELESSEQLTYECEDELIEENSANQPPVVTLEGPRFIFITSGILLFSYILAMSVTSLANVLSIVGATGSTSISFILPGIFGYKLIASEYAKSVVPPAKERILRIISLLLAIWGFIVMITSLSATIFLHATH

SEQ ID NO: 17520 - protein, 652 aa, Blastopirellula marina DSM 3645
MGAAQQTLVVVGNGMVSHALCQRLVADRERLSYSIIVIGEEPRTAYDRVRLTKYFETPDPEVLQLATRQWYEDHGIQLRTGDAVIEIDRDRHEVTCASGDKLGYDRLVMATGSRAWRPDVPGVELDGVYLYRTLDDVDAIRNHALRAKSAAVIGGGLLGLEAAKALHDYGLEVHIIEVAPGLMPRQLDADCGAFLKEKIEQLGCQVHLIKRSTEIIADGHSRVLQFASGDSLSVDMVVISAGIRPRAELAAQAELAIGKRGGIEVDDALRTSDPQIFAIGECAEHRGMVYGLVGPGIAMATTLGDNLLGGSSRFVGADQSARLKLLDIDVTSLGSPLGDSPNITLIAAAGDDYARKILLLGGKAVGAFGVGPWSECERLRTVIDAGGRIWPWQQARFQRTGNVWGSDASVQQWPDGAIICSCKNVTKGAIDLAVASGCASVAEVAHATGASTSCGSCQPLVKQILGSSEVVTRIPGRNSLLSASILTLLGMTTLLLIGQVAAAESVDSFRYQLSLLWRNDLLKQITGYGLLAVMLASTLFTLRKRWPRMTWGEYGYWRAFHAIVGFTTLGGLWLHTGGGLGANLNLWLSLAFIALAITGGLTGAAAALESQFTGDVAIWLRKYRPWINQIHIWILVPLGVFLAFHVTCVYYF

SEQ ID NO: 17521 - protein, 357 aa, Kluyveromyces lactis NRRL Y-1140
MALIKASQARAVRENPHVSHQFNISSFLGDPFAIGTLSIALISWIIALAGSIAVAASTSPFPRFSWWTIVYEILLMITLFIVYCLDLVDYYRMFITCAVGIAFVYTSNSTNSIVYYEGSKSGAAAAGFILLSMINLVWVIYFGGDNASPTNRWIDSFSLRGIRPSVLETSMAIARSQRLPVKPSYPYQYQEDLRSASLPDVHHDDEGEGHSGNMYAPELQSSTKYVSSTVLNGFENTDHSSSKPNLDVNAQNTATLNTQATGTFITDTTNANTDTTMGDTLGLYSDIGEELNSFPYTAEALYTYQADQTDAYEISFEQGEILRVGDIEGRWWKAKKSNGETGIIPSNYVKLLDGKSH

SEQ ID NO: 17522 - protein, 113 aa, Chlamydomonas reinhardtii
MGGSVIVIDSKAAWDAQLAKGKEEHKPIVVDFTATWCGPCKMIAPLFETLSNDYAGKVIFLKVDVDAVAAVAEAAGITAMPTFHVYKDGVKADDLVGASQDKLKALVAKHAAA

SEQ ID NO: 17523 - protein, 211 aa, Staphylococcus aureus
PSADMLFEPSFVKDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 17524 - protein, 95 aa, Oryza sativa
YALVLSGNRHYGGAWRHGLGKGGAKRHRKVLRDNIQGITKPAIRRLARRGGVKRISGLIYEETRGVLKIFLENVTAMDVVYALKRQGRTLYGFGG

SEQ ID NO: 17525 - protein, 523 aa, Corynebacterium glutamicum ATCC 13032
MSLQTNHRPVLVVDFGAQYAQLIARRVREAGIYSEVIPHTATADDVRAKNAAALVLSGGPSSVYAEGAPSLDAEILDLGLPVFGICYGFQAMTHALGGTVANTGKREYGRTDINVAGGVLHEGLEACHKVWMSHGDAVSEAPEGFVVTASSEGAPVAAFENKERKMAGVQYHPEVLHSPHGQAVLTRFLTEIAGLEQNWTAANIAEELIEKVREQIGEDGRAICGLSGGVDSAVAGALVQRAIGDRLTCVFVDHGLLRAGEREQVEKDFVAATGAKLVTVDERQAFLSKLAGVTEPEAKRKAIGAEFIRSFERAVAGVLEEAPEGSTVDFLVQGTLYPDVVESGGGSGTANIKSHHNVGGLPDDVEFKLVEPLRDLFKDEVRAVGRELGLPEEIVGRQPFPGPGLGIRIIGEVTEDRLETLRHADLIARTELTEAGLDGVIWQCPVVLLADVRSVGVQGDGRTYGHPIVLRPVSSEDAMTADWTRLPYEVLEKISTRITNEVPDVNRVVLDVTSKPPGTIEWE

SEQ ID NO: 17526 - protein, 161 aa, Brassica napus
CLAFILQWRGGGLADPASASVISSTSVPGGGNSDLNHEVFPGMETVSSVSPKAHQSSSSDCSNLARSSSPSFPYYGDWNFGVDSNLKPKICITTSTSAGLDQILPWMFYHKVLGVSTFFLFVEGKAATPTISKVLESMPGVKVIYRTKDLEEKQAKSRIWN

SEQ ID NO: 17527 - protein, 114 aa, Clostridium acetobutylicum ATCC 824
MLDVIKEIEAEQIRTDLPSFNVGDTVRIEVRIKEGEKERLQAFEGTVIKRQNGGLRETFTVRRVAYGVGVERTFPLNAPVIAGLKVVRRGKVRRAKLYYLRDRVGKAAKVKEIR

SEQ ID NO: 17528 - protein, 587 aa, Glycine max
MGKSPGKWIKTVLFGKKSSKSNISKGREVKLVNQKGVVVTSKVPETGLALEPTSDTIARHEEDPELENKEAENVLPGNQEIDTVGSINEDAALDPEKMRLEEAATKAQAAFRGYLARRAFRALKGIIRLQALIRGHLVRRQAVVTLCSMYGIVKFQALVRGGIVRQSNVGSEIHEKSNILNPLDGKLVKPNAMFTKITKLSANAFIRKLLTSSTTIMALRLQYVPGDPNSVLSWLERWSASHFWKPVPQPKKIRDTKSQRKHGNISVGDTHVSKSKRINRKLPTASFDSVPVQANPEFEKPKRNTRKISNQSSDPHVQENPQSELEKIKRNLRKVYNPVVENAVPSEVESEMPKDHLEKVTVTSCLAVSEQEVISSNEKIKKEAILTVSSVPDIETTPRLSVSKEVSDTPSSYQVTVESKPLTEITTKDKNISVSDEVKNEPIDLPEPICKDENSHLTNGDLSHKEDQIGSENQKPNQKASIVAKQERAENGIQNSPTLPSYMAATESAKAKLRAQGSPRFGQDGSERNNHTRRHSLPSSTNSKINSPSPRTQRPVQSGGKGGHRSDRTVSSSRDGNGKVIQAEWRR

SEQ ID NO: 17529 - protein, 479 aa, Campylobacter jejuni RM1221
MTTYLNYIDGKFIPHNGEFIEVLNPATKEVISRVASASLEDTKRAIEAAKKAQKVWEAKPAIERANHLKEIASLIRKNANFLTEVLMQEQGKTRVLASIEINFTADYMDYTAEWARRYEGEIIQSDRANEHIYLYKSAIGVIGGILPWNFPFFLIARKMAPALLTGNTIVIKPSSETPNNAFEFAKLVSQSSLPKGVFNLVAGKGSVVGYELSSNENIGMVSLTGSVEAGTRVMEAAAKNIIKVSLELGGKAPAIVCKDADIDLAVEAIKASRICNNGQVCNCAERAYVHTSVYDEFVDKFVKAMSKVSVGNTLKGDFDMGPLVNQAGVDNALAMLQRATAKGAIVECGGKIIDTSGYYFPASVLTNVKHEDEIMQKEIFAPILPIAKFDTLDEAIDMANDCEYGLTSSIYTQNLDIAMRASREIKFGETYINRENFEAMQGFHAGFRKSGIGGADGKHGLEEYLATHVVYLQYNTNKQ

SEQ ID NO: 17530 - protein, 494 aa, Corynebacterium diphtheriae NCTC 13129
MTHTTQTLDDRIHELLQRIPTELFIAGQFQPAHNGATLSVTNPSDGSELATVASASEKEARAALDAAEKAQPTWAATPARERSEILRRAYDLVIEHKDDLAMIQSLELGRALPDSEAEVTYAAEFFRWFAEEAVRIRGDYRHNPTGNARIITHQQPVGPCLAITPWNFPLAMGARKLAPALAAGCTMILKPASKTPLTMLYLAQLLAEAGVPHGVVSVLPTANASVVSDLLHDARIRKLTFTGSTAVGQKLAAMAAEHSAAVSLELGGNAPYIVLDDADIDTAAQAVAVAKMRGAGQVCIAANRFLVHSSIAEEFTQRVVNIMRGFTQGPATAPGVDFGALSGDDQVSTVTTLVDDALSRGATKLLGDLPKGLPEHGSYYPATVLVDVPEDADIHCEEIFGPVVVISTFDDDDEAVARANDTKFGLAAYVFGSDLQRVLNVAERVDAGMIAVNKGALSDPAAPFGGVKESGLGREGGFEGIGEFLETKLISLPL

SEQ ID NO: 17531 - protein, 877 aa, Phaeosphaeria nodorum
MSAAIDNEDLEELSISMPHPRRGGPSTTKAVDFTTPPVAPPTVMQASKSRDSKASQRLGQYTIVKTLGEGSFGKVKLATHQVSGQKVALKIINRKRLVTRDMAGRIEREIQYLQLLRHPHIIKLYTVITTPTEIIMVLEYAGGELFDYIVNNGRLQEDKARKFFQQIVCAVEYCHRHKIVHRDLKPENLLLDDQYNVKIADFGLSNIMTDGNFLKTSCGSPNYAAPEVISGKLYAGPEVDVWSCGVILYVLLVGRLPFDDEYIPTLFKKIAAGNYSIPSYLSPGAVSLIKKMLMVNPVHRITIGEIRMDPWFTKDIAPYLEPPVQEFFDSGVDPHKAIDPTAIAPAIPAPVVQKLHDTVVTKLGKTMGYAEHDVQEALARDEPSAIKDAYLIVRENQMMKVNPLMTQESQLAPFLAQSPPTHHESYLGSSIPQILNSSSPPKGIPSQAQDQHERARHGSNASSQLASVRSPVSTVAILPSSLTEYHKAYMKGHPRPPFKPEHDGLPPTPDQTEEQRQISARRLKPNFRALPDTTRNRPEPMTSLPAKKPRPTKWQFGIRSRNQPAEAMLAIFKALKAMGADWEVPKIRKAGGKGGSRSPTGSHASQERSRSRSRSRSRSPGSSVSSHDSGDEKKTGSDSPTHEPLTVRNADSGEQRGRQRKHYNHTNDWGYHIPEDPWVINARFRKDGMFPPGVAHPSSTHSSRVDLANDPSGLRRRSSTNTSTTSLSHHIDSMTITDRPNSISGEDHPEADEAVYIYVSIQLYSIDREFFVVDFKCAGYERLVSNLVREVKAASSSSPQHQHEDGWDDEAGVWRRLDEGEPLPDDLAKELRDGGKGVLRERTEEVGAGRKEGEKVVTSPFPFLDVASTLILQLSGE

SEQ ID NO: 17532 - protein, 361 aa, Leifsonia xyli subsp. xyli str. CTCB07
MVLQRPRLAVLGSPIGHSKSPDLHRAAYDVLGLDWEYGREEVAEAELPAYLDGLGEEWRGLSLTMPLKKAVIPLLTDIDRVAAETGAANTVLFDGEEVRGFNTDVGGIVRALSAAGLERVRYVHILGGGATAASALVAAAELGAERVDLHVRDLEKSLSLEPPAHGLGLRIRIRSFLQADRSLDVPELVISTLPGDVSIPVLYTDSTRRKAVLLDVAYEPWPTTLAKAWQSVGGTVVSGLGMLVHQALLQVRVFVSGDPLEPLPDEEAVLRAMLAVAAVDAAGAPLDAAAAHTPGTPPDGAAVDAAGAPLDAAAAHTPGTPPDGAAVDAAGTSLDAAAAHTPGTPPDGAAGTSLDAAAAGA

SEQ ID NO: 17533 - protein, 70 aa, Glycine max
MAQQEVVEGFKFEQRHGKERVRVARVWKTRQGQHFVVEWRVGITLFSDCVNSYLRDDNSDIVATDTMKNT

SEQ ID NO: 17534 - protein, 303 aa, Aspergillus oryzae
MDQTMNSTLLSAPPETYWGQFEEISKYNTHLNVLERLWTAWYAWMQNDVLATGIMSFVMHEIVYFGRSLPWIFIDSLGLLKGYKIQSNKIPSLREQWDCAKFVLLSHFTVELPQIWLFHPMAQFFGLSTSVPFPTFWTMAYQIAIFFVLEDTWHYFSHRALHWGPLYKAIHKIHHQYSAPFGMAAEYASPIEVMILGFGTVGCPILWCAVTGDLHIFTMYVWIVLRLFQAIDAHSGYEFPWSLHHFLPFWAGADHHDLHHEKFVGNYSSSFRWWDYLLDTEYSPEAIKRRRENKAGGDARKDQ

SEQ ID NO: 17535 - protein, 70 aa, Glycine max
MAKQEVVEGFKFEQRHGKERVRVARVWKTRQGQHFIVEWRVGITLFSDCVNSYLRDDNSDIVATDTMKNT

SEQ ID NO: 17536 - protein, 484 aa, Listeria innocua Clip11262
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRQVIEDFTNYSALLFERFNGRVKYWVTLNEQNVFISHGYKLAYHPPGVSDDKRMFAANHNANLANASAIAKFRELGISGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 17537 - protein, 143 aa, Zea mays
MGDLLGSPRVAFPKSKHPSQKIPHFLRGEESVKDRAPAATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 17538 - protein, 550 aa, Vibrio fischeri ES114
MLKNINPTETQAWADLTAHFETAQDFNLSDLFAADAQRFDKFSATFGQDILVDFSKNLITEETMKKLFALAEQTELSSAITAMFSGEKINKTEGRSVLHTALRNRSNTPVMVDGEDVMPAVNAVLEKMKGFTERLISGEWKGYTGKEITDIVNIGIGGSDLGPYMVSEALAPYKTRLNMHFVSNVDGTHIVETLKPLNPETTLFLIASKTFTTQETMTNAHSARDWFLAEAGDQAHVAKHFAALSTNAQSVSEFGIDTDNMFEFWDWVGGRYSLWSAIGLSIALAVGFDNFIELLEGAHEVDKHFAETDLENNVPVILALIGLWYNNFHGAESESILPYDQYLHRFAAYFQQGNMESNGKCVDRNGNPVDYQTGPIIWGEPGTNGQHAFYQLIHQGTKLIPCDFIAPAISHNQVGDHHQKLMSNFFAQTEALAFGKTEETVKAEFAAAGKTEAEVAELVPFKVFEGNRPTNSILVKQVTPKTLGNLIAMYEHKIFVQGVIWNIFSFDQWGVELGKQLANQILPELADDKAVTSHDSSTNGLINAFKAFQA

SEQ ID NO: 17539 - protein, 242 aa, Bradyrhizobium japonicum USDA 110
MRAHQIMTRSVISVTPDTSIVEAANIMLKRHVSGLTVVDDTGKLVGVVSEGDFIRRSEIGTGRKRGRWLRFILGPGKSASDFVHEHGRKVSEVMTASPVTITEDTALAEIVDLMERNNVKRLPVVRGDMVVGIVSRANLLQAVAGLAREVPDPTADDDHIRNRIIDTMERNDWCPFGLNVIVRDGIVHLSGVITEERARQAAVVAAENVEGVKKVHDHLCWVDTMSGVYLNSPEDDDLAKAS

SEQ ID NO: 17540 - protein, 220 aa, Brassica napus
PNYFRLTGLVEEGGGKSFLELVDWNPDFAKSVIEIRAQEETVRTGVRVRPNFDVKLPSGLFLRKEMREWTRDWLEQEYISPYEDVSRLDQASKEMEKRTVGVFHELLSLSLLKRVPVPILGKFCDEFRFSNAFSSVFTRHSGVFYLSLKGGIKTAVLRQAYKDEELVDRDPLLAIKDKFLRLLEEGWQERKDRLKMQREQVEKDREIAKKQQEPVERLCE

SEQ ID NO: 17541 - protein, 462 aa, Exiguobacterium sibiricum 255-15
MSLLRKKDVSVMMDQKSHSKLARHLSGFDLVLLGIGAIIGTGIFVLTGTGALYAGPALPVAFIISAIVCALAALCYAEFSSMIPVSGSVYTYTYATIGELVAWIIGWCLILEYGLASSAVATGWSGYFQSLLSGFGISLPTALTAAPGAVPGSETFFNLPAFLILMVITLLLSMGIKETKRVNNIMVLVKVAVVVLFIVVGIWYVEPGNYTPFAPFGISGVLQASAIAFFAYLGFDAVTSAAEEVKDPGRNLPIGILGSLAIVTVLYVVVSAIMVGIVPFKQFEGVDSPVSLALKVAGQDWVAGFVDLGAIVGMTTVILVMTFGLVRLLFAMSRDGLLPKIFSDVNEKSHTPVKATWILGTTAGLIAGFVPLGTLAELINIGTLAAFALISIAVVILRKTRPDLKRAFKVPWVPFLPILSVLACIMLMLNLQTFTWIAFFIWTAIGLLVYFGYGRSRSKLQQ

SEQ ID NO: 17542 - protein, 576 aa, Vibrio fischeri ES114
MSELIDVKTILSGTELGPLADNERLKRESKYLRGTIVEDLQDRITGGFTKDNFQLIRFHGMYQQDDRDIRAERAKQKLEPLHNVMLRARMPGGIITPKQWLAIDKFAEEHTSYGSLRLTTRQTFQFHGVLKPNIKLMHQTLNSIGIDSIATAGDVNRNVLCTTNPVESELHQEAYEWAKKISEHLLPKTRAYAEIWLDGEKLETTDEEPILGSNYLPRKFKTTVVIPPQNDVDVHANDLNFIAIADNGKLVGFNVLVGGGLAMTHGDTATYPRKADDFGFVPLDKTLDVAAAVVTTQRDWGNRSNRKNAKTKYTLDRVGSDVFKGEVEKRAGVQFEKSRPYELTERGDRIGWVEGIDGKHHLALFIENGRLLDYPGKPLKTGVAEIAKVHQGDFRMTANQNLIVAGVPSEQKDHIEQIARAHGLIDDTHSEQRKNSMACVAFPTCPLAMAEAERFLPEFVTEIEGVLKKHNLPEEDNIIFRVTGCPNGCGRAMLAEIGLVGKAPGRYNFHLGGNRSGTRVPKMYKENITDRQILTEIDQLVGRWATERNENEGFGDFTIRAGIVDEVKVSKRDFHA

SEQ ID NO: 17543 - protein, 451 aa, Pseudomonas aeruginosa UCBPP-PA14
MSFDFDLFVIGAGSGGVRAARFAAGFGARVAVAESRYLGGTCVNVGCVPKKLLVYGAHFSEDFEQARAYGWSAGEAQFDWATLIGNKNREIQRLNGIYRNLLVNSGVTLLEGHARLLDAHSVEVDGQRFSAKHILIATGGWPQVPDIPGKEHAITSNEAFFLERLPRRVLVVGGGYIAVEFASIFNGLGAETTLLYRRDLFLRGFDRSVREHLRDELGKKGLDLQFNSDIARIDKQADGSLAATLKDGRVLEADCVFYATGRRPMLDDLGLENTGVKLTDKGFIAVDEHYQTSEPSILALGDVIGRVQLTPVALAEGMAVARRLFKPEEYRPVDYKLIPTAVFSLPNIGTVGLTEEEALSAGHKVKIFESRFRPMKLTLTDDQEKTLMKLVVDAHDDRVLGCHMVGAEAGEILQGIAVAMKAGATKQAFDETIGIHPTAAEEFVTLRTPTR

SEQ ID NO: 17544 - protein, 538 aa, Oryza sativa (japonica cultivar-group)
MADDFLSSQPQPWPPLLQLSAAVLFFLLPLLYLLFLRGSNGEVRGRQGNSASAPSLPGPCRQLPVLGNLLQIGSRPHRYFQAVSRRYGPVVQVQLGGVRTVVVHSPEAAEDVLRTNDVHCCSRPPSPGPRMLSYNYLDVAFAPYSDYWREMRKLFVVELTSVSRVRSFAYARAAEVARLVDTLAASPPGVPVDLSCALYQLLDGIIGTVAFGKGYGAAQWSTERAVFQDVLSELLLVLGSFSFEDFFPSSALARWADALAGVERRRRRIFRQVDGFLDSVIDKHLEPERLSAGVQEDMVDALVKMWREQQDRPSGVLTREHIKAILMNTFAGGIDTTAITAIWIMSEIMRNPRVMQKARAEVRNTVKNKPLVDEEDSQNLKYLEMIIKENFRLHPPGNLLVPRQTMQPCLIGGYNVPSGTRVFINIWAMGRGPMIWDNPEEFYPERFEDRNMDFRGSNFELVPFGSGRRICPGVAMAVTSLELVVANLLYCFDWKLPKGMKEEDIDMEEIGQISFRRKVELFIVPVKHEQYQLMGHIN

SEQ ID NO: 17545 - protein, 169 aa, Brassica napus
STTRPLFPLCKSGTCSLREAVIIGSILEKCSIPMLHSCVALLNLAEMEYCGTTSYFIKTLLEKKYCMPYRVLDALVAHFMRFVDEIRVMPVIWHQSLLTFVQRYKYELLKEDKEHFQTLLKRQRHHLVTPEILRELQGSRNRGEKEDDPMLTNYILFYISSFNSLWNYF

SEQ ID NO: 17546 - protein, 431 aa, Arabidopsis thaliana
MITSLTSNNRLRYEIISGGDQQPTELKATDSHIQSLKPLVRDAVAKLVDSTLPDAPRLAGFVVDMYCTSMIDVANEFGVPSYLFYTSNAGFLGLLLHIQFMYDAEDIYDMSELEDSDVELVVPSLTSPYPLKCLPYIFKSKEWLTFFVTQARRFRETKGILVNTVPDLEPQALTFLSNGNIPRAYPVGPLLHLKNVNCDYVDKKQSEILRWLDEQPPRSVVFLCFGSMGGFSEEQVRETALALDRSGHRFLWSLRRASPNILREPPGEFTNLEEILPEGFFDRTANRGKVIGWAEQVAILAKPAIGGFVSHGGWNSTLESLWFGVPMAIWPLYAEQKFNAFEMVEELGLAVEIKKHWRGDLLLGRSEIVTAEEIEKGIICLMEQDSDVRKRVNEISEKCHVALMDGGSSETALKRFIQDVTENIAWSETES

SEQ ID NO: 17547 - protein, 495 aa, Arabidopsis thaliana
MKFELVFIPYPGIGHLRSTVEMAKLLVDRETRLSISVIILPFISEGEVGASDYIAALSASSNNRLRYEVISAVDQPTIEMTTIEIHMKNQEPKVRSTVAKLLEDYSSKPDSPKIAGFVLDMFCTSMVDVANEFGFPSYMFYTSSAGILSVTYHVQMLCDENKYDVSENDYADSEAVLNFPSLSRPYPVKCLPHALAANMWLPVFVNQARKFREMKGILVNTVAELEPYVLKFLSSSDTPPVYPVGPLLHLENQRDDSKDEKRLEIIRWLDQQPPSSVVFLCFGSMGGFGEEQVREIAIALERSGHRFLWSLRRASPNIFKELPGEFTNLEEVLPEGFFDRTKDIGKVIGWAPQVAVLANPAIGGFVTHCGWNSTLESLWFGVPTAAWPLYAEQKFNAFLMVEELGLAVEIRKYWRGEHLAGLPTATVTAEEIEKAIMCLMEQDSDVRKRVKDMSEKCHVALMDGGSSRTALQKFIEEVAKNIVSLDKEFEHVALK

SEQ ID NO: 17548 - protein, 365 aa, Yersinia pestis CO92
MNMTKTYHIAVLPGDGIGPEVMAQASKVLDAVRQRFGLKISTSVYDVGGAAIDRHGSPLPAATVAGCEQADAILFGSVGGPKWEHLPPAEQPERGALLPLRKHFKLFSNLRPARLYQGLEDFCPLRSDIAARGFDILCVRELTGGIYFGQPKGREGQGMHERAFDTEVYHRFEIERIARIAFESARKRRSKVTSIDKANVLQSSILWREVVNGIAADYPDVALSHMYIDNATMQLIKDPSQFDVLLCSNLFGDILSDECAMITGSMGMLPSASLNEQGFGLYEPAGGSAPDIAGKNIANPIAQILSLTLLLRFSLGKDDAADAIERAINQALEQGYRTADLAGDGHAIGTHEMGDIIAKFVVEGV

SEQ ID NO: 17549 - protein, 340 aa, Oryza sativa (japonica cultivar-group)
MGQQQQQENLTLLPMSSSSAAAAADAAAASSPAASAGRLFTAGLVASWYASNIGVLLLNKFLLSTYGFRYPVFLTACHMSACALLSYAAAAASAAAPRAARPRRSRGQLARVALLGAVFCASVVAGNVSLRYLPVSFNQAVGATTPFFTAVLAYAVAARREACATYAALIPVVAGVVIATGGEPSFHLFGFIMCIGATAARALKTVLQGILLSSEEEKLNPMELLGYMAPVAVVLLIPATFIMERNVLTMVTALAREDPSFIWILLCNSSLAYFVNLTNFLVTKHTSPLTLQVLGNAKGAVAVVVSILIFRNPVTFMGMLGYGITVAGVVLYGEAKKRSK

SEQ ID NO: 17550 - protein, 501 aa, Burkholderia mallei ATCC 23344
MNLAALSTQHQRQSGFLARRQFGNWIDGRAAEPRSGRYLPVVDPATEMTIAEVAASDARDVDAAVAAARRAFDSGDWPRMRPASREKLLHQLAERLERYADELAALETLETGKLIGVARAIDVLGGAEYVRYMAGWATKLEGSTLDTSIAAPAGAEYFAYTRREAVGVVGAIVPWNFPLAIALWKVATALACGCTVVLKPSEETPLTALRLGELAQEAGLPDGVLNIVTGAGAEAGAALAAHPGIDKITFTGSVGVGRAIGHAAVERMARFTLELGGKSPLIVLDDADPDFAAHGAAQGIFFNQGQVCTAGSRVYVQKRLFERVVAGIAAAAEAMKIGSGFDPNTQIGPLVSKRHFERVLGHVDAAKEEGATLVTGGTRALDGGYFVKPTVFVDAAPAMRIVREEVFGPVVTVTPFDTVDDAVRLANDTDFGLAASVWSQNLSHVHRVVPRLKAGIVWVNTHNMLDPNLPFGGFKQSGYGRELGRAALEQFTELKSVCIAH

SEQ ID NO: 17551 - protein, 309 aa, Glycine max
MAKQEVVEGFKFEQRHGKERVRVARVWKTRQGQHFIVEWRVGITLFSDCVNSYLRDDNSDIVATDTMKNTVYAKAKECSDILSAEEFAILLAKHFVSFYQKVTGAIVNIVEKPWERVTVDGQPHEHGFKLGSEKHTTEAIVQKSGSLQLTSGIEGLSVLKTTQSGFVNFIRDKYTALPDTRERMVATEVTALWRCSYESLYSLPQKPLYFTEKYQEVKKVLADTFFGPPKGGVYSPSVQNTLYLMAKATLNRFPDIAYVSLKLPNLHFIPVNISNQDGPIVKFEDDVYLPTDEPHGSIQASLSRLWSKL

SEQ ID NO: 17552 - protein, 150 aa, Allium cepa
MELFQDVVPQTAENFRALCTGEKGMGDRKPLHYKGSSFHRVIPGFMCQGGDFTAGNGTGGESIYGAKFKDENFIKKHTGPGVLSMANAGPGTNGSQFFICTEKTAWLDGKHVVFGQVVEGMDVVRAIEKVGSQSGQTKKPVKIADCGQLS

SEQ ID NO: 17553 - protein, 338 aa, Cryptococcus neoformans var. neoformans
MSVPCISLHDFDERRDEVIKELMDASMNVGFFTLCNHGISPEDVQAAFDLSRRFFALPDEIKIKTPLNGRNAGWEKNTQVRPSTGTADQKESMQLQFARMEGLWPSDEDVPGFRTRAEKFMNQIQALSIKVMECFADGLGLPHDIFTENTVERGENDCQNVLRLLHYHSIEDKQFGPNFWRAGAHADFDILTMLFQRDGEGGLEVCPGRKVVGDFGMGQTWIPVEARQDRIVCNIGDQLMRWSDDQLKSTYHRVRLPEGNESKGPRYSIAFFNQSRINTVIQGPQKKYPPITGGKFIAEAMAKNRMQSAEIARRVALETGEKVATEVHFVPKHLQVVA

SEQ ID NO: 17554 - protein, 243 aa, Zea mays
MLQGSEVMGECEDGKEYRCWEELLPDALGLIFRNLPLQEVLTVLPRVCKSWGRVVAGPYCWQEIDIEEWSQQQSKPEQIARMVELLVGRSAGSCRRISVSGLPCDPRFSFIGDNARALRTLEIPRSEISDSMVESVAPRLPNVTFLDISSCTKIGARGLEAFGKHCKSLAGLRRVMHPIDLADRACQHDEAHAIACSMPRLRHLEMGYMLVATEAVAEILGRCRELKFLDLRGCWAVDDKLLL

SEQ ID NO: 17555 - protein, 163 aa, Triticum aestivum
GDTIGTSLYKKAGWYRSRIPGISSTHASVWKTLKSGKVVPGYGHGVLRNTDPRYSCRREFALKYLPEDPLFQLFSKLYEVVPPILTELGKVKNPWPNVDAHSGVLLNHFGLTEARYYTVLFGVSRSIGIGSQLIWDRALGLPLERPKSVTMEWLENHCKKVAA

SEQ ID NO: 17556 - protein, 1093 aa, Leifsonia xyli subsp. xyli str. CTCB07
MPKRTDIRSVLVIGSGPIVIGQACEFDYSGTQACRVLREEGVRVILVNSNPATIMTDPDFADATYVEPITWEVIETIIAKEKPEAILPTLGGQTALNEAMQLHEHGVLEKYGVELIGAKFEAIQKGEDRQIFKDLVIAAGADVARSHIAHTVEEALAFADDLGYPLVVRPSFTMGGLGSGFAYTSEELRRIVGDGIHQSPTSEVLLEESILGWKEYELELMRDTADNTVVVCSIENVDPVGVHTGDSITVAPALTLTDREYQKLRDIGIDIIRAVGVDTGGCNIQFAVDPADGRVIVIEMNPRVSRSSALASKATGFPIAKIAAKLAIGYRLDEIPNDITRVTPASFEPTLDYVVVKVPRFAFEKFPAADPTLTTTMKSVGEAMAIGRTYTSALQKAFRSLEKRGSSFHWGAENRTAEELLASIATSTDGRIVDVQQALRLGATPEQVFEATKIDPWFIDQIVLINEVAEQIRAAETLDTDTLRFAKDHGFSDAQIGELRGFGEADVREVRHILGVRPVYKTVDTCAGEFPALTPYHYSSYDEETEVAPSDTRKVVILGSGPNRIGQGVEFDYSCVHASFALHDAGYETIMVNCNPETVSTDYDTSDRLYFEPLTLEDVLEVIHAESQSGELVGVVVQLGGQTALGLAKGLEEAGVRVLGTTPSAIDLAEERGLFADILENAGLVAPRNGTAVDYASALHAAEQIGYPVLVRPSFVLGGRGMEIVYDSDSLASYFQRVAGQGIVGPAHPLLVDRFLDDAIEIDVDALFDGERLYIGGVMEHIEEAGVHSGDSSCTLPPITLGRREIDRVREATRKIAEGIGVRGLLNVQFAIGAGVLYVLEANPRASRTVPFVSKALGIPLAKAASRIMVGDTVDGLVAEGLLPDQDGSIIPMDSPVAVKEAVLPFKRFRTREGKIVDSVLGPEMRSTGEVMGIDKDFPTAFAKSQAAAYGEMPLTGTVFVSVADGDKRAIVLPVLRLQQLGYAILATEGTAEVLNRNGIAARVIRKHSETTDGDSIVDLITRNEVDVVINTPSGRSARADGYEIRAAAVAGDKPLFTTLAELSAAVASLDAVRHGFAVTSLQEYAAQRAARR

SEQ ID NO: 17557 - protein, 238 aa, Solanum lycopersicum
MADPDTTRTVVGIIGNVISFFLFLSPGPTFVQILKAKSVMEFKPDPYIATVLNCAVWVFYGMPFVHPDSLLVITINGFGLAIELLYVSIFFIYSDWSKRQKIIIALVIEAIFMAILIFVTLTFLHGTKDRSMLIGIVAIVFNIIMYTSPLTVMKKVITTKSVKYMPFYLSLANFANGIVWACYALLKFDPYILIPNGLGSLSGLVQLILFAAFYRTTNWDEDEKEVELSTSKSNKSDV

SEQ ID NO: 17558 - protein, 275 aa, Blastopirellula marina DSM 3645
MSPPGLEREMSPSPQFEAQQYRAAGKLENCVALITGGDSGIGRAVAYLFAREGADVAILYLPEEQNDAAETKQAIEALGRRVLLLAGDICDVDFCKQAVEWTHQEFGRIDILVNNAAYQKHRDGLEEISSDQIDRTFRTNAIAMFHICKTAVPYMPPGSAIINTGSIVGLEGSGSLLDYAATKGAIHAFTKSLAQNLLDRGIRVNCVAPGPVWTPLNPAERPDEETVNFGGKTPMGRPAQPEEIAPAYVFLASAADSSYLTGHVLPLTGGSPTAS

SEQ ID NO: 17559 - protein, 110 aa, Kluyveromyces lactis NRRL Y-1140
MATDLGPIEAQSGTEGATESKPNFEITKWTAVAFWSWDIDVDNCAICRNHIMEPCVNCQQEATFNSEHECVAAWGECNHAFHLHCITQWIKSRNVCPLDNKPWKLARCGK

SEQ ID NO: 17560 - protein, 252 aa, Arabidopsis thaliana
MSMSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPS

SEQ ID NO: 17561 - protein, 186 aa, Escherichia coli
METYAVFGNPIAHSKSPFIHQQFAQQLNIEHPYGRVLAPINDFINTLNAFFSAGGKGANVTVPFKEEAFARADELTERAALAGAVNTLMRLEDGRLLGDNTDGVGLLSDLERLSFIRPGLRILLIGAGGASRGVLLPLLSLDCAVTITNRTVSRAEELAKLFAHTGSIQALSMDELEGHEFDLIIN

SEQ ID NO: 17562 - protein, 250 aa, Oryza sativa (indica cultivar-group)
MENGLSDEVLKAVFPLLDGKDLVFCMLVCRQWREIAKDDYFWKCICARKWPSICKQPPSDANYQKLYLTFSKPRTPQHLPVPKLTFEDLVFYIDMWLDGSLIFSQAVSGCILRGGLQNTPCGIPDVLVAHLTAPDCILMMEVEPKLEITMGPSITVSVLAHRKDTKKMACVINKSTFDYIDSNAARALAYEYLQFSPRYPFISDIRAWMSLLFLYKGTNVIEVFGIELDFCDAARSETEILWLLDMLDWK

SEQ ID NO: 17563 - protein, 139 aa, Synechococcus sp. RS9917
MESTQESLFEQAMARYQNGAPAEELLDDFITITEAAPRQSAGWTCLAWLQLLCDQPEAALRSARTAVKLNPQDPQARINLSVAMLETKAKGVRDQIEMVQQVLAMAPDVGQELQASIADGFQRRPGWPALTKVKNWLEL

SEQ ID NO: 17564 - protein, 642 aa, Clostridium acetobutylicum ATCC 824
MQMKKDFGYIRVGVASCELKVANPNYNVKSIISIMKKAYRRHHIKVLVFPELCVTGYTCGDLFNQNLLIKRAENELNNLLVSTSNINMITAVGMPVKADNQLFNCAVIINNGNILGVVPKTFIPTYNEFYEKRNFAGAISRISDEIILCGKKVPFGENLLFKDIYSELCIGIDICEDLWVNIPPSSYHTLNGANLILNLSASDEIVAKSDYRRDLVRLQSAKCITSYAYASSGQTESTSDLVFSGHSIIADNGSILKDIKFEEASYVKYADVDIEKLISDRIKFNTYMGRIEDKEYRTINFHLGYNENMHLERYVEASPFVPSNKSKRNIRCREILDLQASGLYQRLNKTGINKAVVGISGGLDSTLALLVIVEAFKKLKAPMKNIIGITMPGFGTTRRTYNNAVELMKKLGITIKEISIKKACIQHFNDIGQDLNTHDTIYENSQARERTQILMDIANKEGAIVVGTGDLSELALGWCTYNGDQMSMYGVNSSIPKTLVKYLIMWYAEASKDNDIRNILLDIYNTPVSPELLPPDKEGNIKQKTEDLIGSYELNDFFLYNMLRSGYEPLKILYLANIAFKDKYSEDVIHSALKNFYKRFFTQQFKRNCMPDGVKIGSVSLSPRGDLRMPSDASYGLWMDEL

SEQ ID NO: 17565 - protein, 570 aa, Escherichia coli CFT073
MSEKHPGPLVVEGKLTDAERMKLESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPGRPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRMGTRIPRMYKENITEPEILASLDELIGRWAKEREAGEGFGDFTVRAGIIRPVLDPARDLWD

SEQ ID NO: 17566 - protein, 172 aa, Glomus intraradices
TSTTGSAHGHGHDHGVGEHGHTHEQLDNPGKYTEREPPKYEKRNWKERAFTVGIGGPVGSGKTALMLALCKALRDQYSIAAVTNDIFTKEDTEFLVRNNALPAERIRAIETGGCLHAAIREDISANLGALEELHAKFNSQILLVESGGDNLAANYSRELADYIIYGKTIPFH

SEQ ID NO: 17567 - protein, 119 aa, Glycine max
MGEEANCDAVMEAGNGNGKAKENGHATAVLAMPDVKADDAVVAPADPRLQGISDAIRVVPHFPKQGIMFNDITTLLLRPGVFKDAVDMFVERYRGMGIAAVAGIEARGFIFGPAIALAI

SEQ ID NO: 17568 - protein, 345 aa, delta proteobacterium MLMS-1
MNNPKTDLKNLTLPELTAWVETLNLKPFRARQIFSWLYRPDFSDFAQMTDIAKHVRALLAEKATFSRLAAAKEEHSTDGTVKFAFRLSDGHLIESVLIPEEDRHTLCVSSQVGCAMGCNFCLTGTMGFIRNLTVAEMVGQVDQAAHWLWQRGARSGRLNNLVFMGMGEPLLNFDNLIKAINILMEQRGHDLSGRRITVSTCGIVPRMKELGEKVPVNLAVSLHAADHATREQLMPVNRTYPLAELLQACRQYPLPPRRRIMIEYALLAGINDSPAAARLLVKQLHGIRCKINILPFNETPAFPYRCPDPATIEAFRQILRRAGHTTLLRTSRGADIAAACGQLAA

SEQ ID NO: 17569 - protein, 424 aa, Azoarcus sp. BH72
MTSRNEALFSRAQRSIPGGVNSPVRAFRSVGGTPRFIERAEGARVWDADGKAYIDYVGSWGPAIAGHSHPAIVEAVREAALRGLSFGAPTESEVEMAELLCALLPSIEMLRLVSSGTEATMSAIRLARGFTGRDDIIKFEGCYHGHADSLLVKAGSGLLTFGNPSSGGVPADFAHHTVVLDYNDLDQVETVFKARGDQIAAVIVEPVAGNMNLIKPRPGFLEGLRRLCTEYGAVLIFDEVMTGFRVGPQGVQGLYGITPDLTTLGKVIGGGMPVGAFGGRRDIMNCIAPLGPVYQAGTLSGSPVAVAAGLASLRLTQAPGFYDALAARARSLVDGLSGVAREAGVPFSADSIGGMFGIYFSPSVPASFAEVMASDREAFNRFFHAMLDAGHYFAPSAFEAGFVSAAHGEADIQATVAAARACLR

SEQ ID NO: 17570 - protein, 338 aa, Sinorhizobium meliloti
MGVVIPLEDNKNQQASVKPLVDLTLSDMERVNQPILSKAGSDVQMIPEVANHLISSGGKRLRPMLTLAAASMFGYEGDGHIKLATSVEFMHTATLLHDDVVDESDLRRGKSTARTFWGNQASVLVGDFLLGQAFRMMVDVGSIDALDVLSTAASVIAEGEVLQLSVAKNMETTEDDYLRVNRAKTAALFAAASEVGPIVAGGSKADRNALKSYGTNLGLAFQLVDDVLDYGGTSSDLGKNVGDDFRESKITLPVILSYRRGTPQDRAFWREAIEGGASDAANLEKALGLIRRYGGLTDTIARAKHYGTIARDALAPLPASPWKSALVEVIDFCIDRVS

SEQ ID NO: 17571 - protein, 74 aa, Brassica napus
AKRMPESALTAPKEKKLTGRQGFESGEARGTGVTADQESEEEDDEDIDFEDEDFEDDEEDMLEHYWAEKSDARA

SEQ ID NO: 17572 - protein, 263 aa, Triticum aestivum
MLWRTIRSMEVMAHSSSFLLPKLHQPAKTPANNYTLVVLNQQLPRFMPRLWAQAKMRICADGGANRIFDEMSQMTNDLDRNRYIPEIVEGDMDSIRPEVKRFYSSQGSKISDKSHNQETTDLHKCISSIRHRTPDHEKANLCVLVTGALGGRFDHEAANINVLYVFSDMRIVLLSDDCLIQLLPKTHHHEIYIESSVEGPHCGIFPIGAPSTSTTTTGLKWNLSDAEMRFGSMISTSNIVDSDKVTVQSDADLLWTISLRNLT

SEQ ID NO: 17573 - protein, 1075 aa, Desulfitobacterium hafniense DCB-2
MPKREDIKKIMIIGSGPIVIGQAAEFDYSGTQACKALKNLGYEVVLVNSNPATIMTDAGTADATYIEPLNVQRITEIIEKERPDALLPNLGGQSGLNLSSELAKAGILDHYGVKVIGVQLDAIERGEDRIAFKETMERLGIDMPKSSPAYTVEEAEKIAQELGYPVVIRPAYTLGGTGGGLVYNVEELKTIVNRGISASMIGQVLVEESVLGWEELELEVVRDSKNQMITVCFIENIDAIGVHTGDSFCSAPMLTISQELQERLQKYAYSIVEAIEVIGGTNVQFAHDPKTDRVVIIEINPRTSRSSALASKATGFPIALISSLLAAGLTLDEIPYWREGTLDKYTPWGDYVVIKFARWAFEKFKGVEDKLGTQMRAVGEVMSIGKNYKEAFQKAIRSLEIGRYGLGFAKDFNTKTLPELLELLKTPTSERHFMMYEALRQGADPAELAAITYVKTWFIEQMKELVDLEEKILEYQGRELPAELLIQAKKDGFADRYLAQLLGISETQVRRQRLGLGLTQAWDAVPVSGVNNASYYYSTYNAPDKVTTSQREKVLILGGGPNRIGQGIEFDYCCVHAAFALKNLGYETIMINCNPETVSTDYDTSDKLYFEPLTVEDVLSIYEKERPIGAIVQFGGQTPLNIAAQLQEAGVRILGTVPEVIDQAEDRDQFRKMMEKLAIPMPQAGMASTLEEALAAAEMIGYPVMVRPSYVLGGRGMEIVFDEEQLREYVAAAVDITPERPILIDKFLENAIEAEADAVSDGTHAFVPAVMEHIELAGIHSGDSACVIPPLTIADRHLRTIIDYTQRIAQELHVVGLMNIQYAIAEDKVYVLEANPRASRTVPLVSKICNTPMARLATELILADYTGQKNDIATNFKPAQISHYGVKEAVFPFDKFPEVDPVLGPEMRSTGEVLGMANSFGLAYFKAQEATHSSLPFSGTVLMSIAEQDRSSGVIEIAQEFLKLGFKIKATQGTRKFLQDHSIDAEFIHKIEEGRPNITDGIMNGEIQLVINTPIGKRSLKDDSYIRKTAIKYKIPYITTTPAALASAKGIAASQEAAANKTVVKSLQEYHGEIM

SEQ ID NO: 17574 - protein, 109 aa, Oryza sativa
  misc_feature (61)..(61): Xaa can be any naturally occurring amino acid
  misc_feature (87)..(87): Xaa can be any naturally occurring amino acid
  unsure (1)..(109): unsure at all Xaa locations
MSAMETDINAPPPPVLNPFCAFEGFFYAVGPLFPKPNKRFVINKWNACTLWAWDIIIDNCXAISSNHIMDLCIECQSNHAISTSEEXCTVDWGCCNHAIHFHLYRTGGS

SEQ ID NO: 17575 - protein, 217 aa, Brassica napus
MYADSGLMISYMHNCPPDFQQIEDLFKSYKLSDDEMNNAFAKSTNITDYDLGEEGDLFKAPDPILEDPIVAVDPLSAALTMISCGEDSSQGLCELPDLGSLQSGQELLDKAFYECEQDLIMKSAMEPPFSDVLHVKNISLITSESQDLQKSVSSENLSSMGWSQNQEALVVQNFPDYSQLDFGYVNGMRRAFSEGEIQKLGTGHFQSPLDMIIVSCT

SEQ ID NO: 17576 - protein, 456 aa, Pseudomonas aeruginosa UCBPP-PA14
MSNPPPTAERTQLRKSLKLWQIVMIGLAYLTPMTVFDTFGIVSGISQGHVPTAYLLALAGVLFTAISYGKLVRQFPTAGSAYTYAQRAINPHVGFMVGWSSLLDYLFLPMINALLAKIYLTALFPEVAPWVWVVMFVLIMTLINIKSVNLVANFNTVFVLVQLAIIVVFIGLVIHGLNNGEGTATVLSTQPFFSEHAHLSAMVAGATILCFSFLGFDAVTTLSEETRDAAKVIPRAIFLTALYGGVIFITVSYFLQSYFPTNVRFKEPDAALPEIALYVGGKLFQSIFLCATFINTLASGLASQASVSRLLYVMGRDNVLPERIFGFVHPKWRTPSINVLIVGMVALSAISFDLVTATALINFGALVAFTFVNLSVIVHFYVRGGRNRSLKEHFHYLVLPLLGAAIVAVLWLNLESTSLVMGLIWAGLGFGYLFYLTRSFSRPPPRFQESELSPTQ

SEQ ID NO: 17577 - protein, 257 aa, Brevundimonas sp. SD212
MLRDLLITTLALSLIIGLRYLLVGAAAHGLLWAGAGRGRALNLRPPAMKRIRAEIVASLIACPIYALPAALVLELWKRGGTAIYSDPDAWPLWWLPVSLIVYLLAHDAFYYWVHRALHHPRVFGWAHAEHHRSRDPSAFASFAFDPAEAAATAWFLPALALIVPIHWGVALTLLTLMSLTAALNHAGREVWPAAWLERAPLRWLITATHHDAHHKRFNGNYGLYFQFWDRWAGTEVSAAPSPPSPVIPPERPSAPLR

SEQ ID NO: 17578 - protein, 402 aa, Arabidopsis thaliana
MTMMSDLSQDLLEEILSRVPRTSLGAVRSTCKRWNTLFKDRILCKAEETRDQFRFIMKKYKLCSMRFDLNGTLNEDGGTEFVDPSIKELGHFFNQVKISKVFQCDGLLLCVTKEDNIRLVVWNPYLGQIRWIESGNTNYRLFDRYAIGYDNNRKHKILRFLEYYNFNMKHRFLEYEIYDFSSNSWRVLDIAPRWEIESYQRGASLKGNTYFIAKEKIEYEEDGEFPEPADNLLCFDFTTESFGQFLPLPFQHYLYDVGALSSLGDEKLAALFQCGDTDLSEVEIWVTTLTETNTVSWNPFLKVDMEPHYGRSFMFDYYGGSFFIDEEKKLAVVFQFDESGMTRYEDATYIIGENGYVKKVRLGEAPANQGGYCFPSVCFSSYVPSLVQINQIVGFKKEREEE

SEQ ID NO: 17579 - protein, 183 aa, Brassica napus
MVKAYKQEHVYKHPWERVSAASWRKFADPENKRILSHILEVDTLNRKLDTDTGKLHTTRALTIHAPGPWFLHRIIGQDICHCVESTVVDGKSRSMQLTTKNITLKKFIEVEERIRYDPHPENPSAWTVCSQETSIRIKPLSALASMAEKVEQKCAEKFMQNSVKGREVMERICRYMEAESAPV

SEQ ID NO: 17580 - protein, 132 aa, Zea mays
  misc_feature (51)..(51): Xaa can be any naturally occurring amino acid
  misc_feature (91)..(91): Xaa can be any naturally occurring amino acid
  unsure (1)..(132): unsure at all Xaa locations
MVRVSVLNDALKSMYNVEKRGKRQVMIRPSSKVIIKFLLAMQKHGYISEFXYVDDHRAGRIVVELNGRLNKCGLISPRFDIGGKEIEGGRXTARLLPSRQFGFIVLTTSAGIMDHKEATRKNVGGNVLGFFY

SEQ ID NO: 17581 - protein, 129 aa, Rhizobium leguminosarum bv. viciae 3841
MPIKRYGTVQTGAGGKALPFARAVEADGWLYVSGQVAMEDGEIIDGNIIAQTHKTIANVLSILDEAGYGVEDVVRVGVWLDDPRDFWTFNKIYQEYFGEHPPARACVQSSMMVDCKVEIDCVAYKKKDR

SEQ ID NO: 17582 - protein, 412 aa, Thermus thermophilus
  misc_feature (202)..(202): Xaa can be any naturally occurring amino acid
  unsure (1)..(412): unsure at all Xaa locations
MEYTTLAVLAGLPEDPHGAVGLPIYAVAAYGFKTLEEGQERFATGEGYVYARQKDPTAKALEERLKALEGALEAVVLASGQAATFAALLALLRPGDEVVAAKGLFGQTIGLFGQVLSLMGVTVRYVDPEPEAVREALSAKTRAVFVETVANPALLVPDLEALATLAEEAGVALVVDNTFGAAGALCRPLAWGAHVVVESLTXWASGHGSVLGGAVLSRETELWRNYPQFLQPDLKGQIPWEALRARCFPERVRTLGLSLCGMALSPFNAYLLFQGLETVALRVARMSETARFLAERLQGHPKVKALRYPGLPEDPAHRNARKYLASGGPILTLDLGDLERASRFLEAIRLLKAANLGDARTLLVHPWTTTHSRLKEEARLQAGVTPGLVRVSVGLEDPLDLLALFEEALEAV

SEQ ID NO: 17583 - protein, 512 aa, Oryza sativa (japonica cultivar-group)
MATAAACISFASPSPARVVIRRQTRASASASATDRQEVVSPKRRLPLRKVPGDYGPPVVGAIRDRYEYFYGPGGRDGFFAARVRAHRSTVVRLNMPPGPFVARDPRVVALLDAASFPVLFDTSLVDKTDLFTGTFMPSTDLTGGYRVLSYLDPSEPNHAPLKTLLFYLLSHRRQQVIPKFREVYGDLFGLMENDLARVGKADFGVHNDAAAFGFLCQGLLGRDPAKSALGRDGPKLITKWVLFQLSPLLSLGLPTLVEDTLLHSLRLPPALVKKDYDRLADFFRDAAKAVVDEGERLGIAREEAVHNILFALCFNSFGGMKILFPTLVKWLGRAGARVHGRLATEVRGAVRDNGGEVTMKALAEMPLVKSAVYEALRIEPPVAMQYGRAKRDMVVESHDYGYEVREGEMLFGYQPMATKDPRVFARPEEYVPDRFLGEDGARLLRHVVWSNGPETAAPTLHDKQCAGKDFVVLVARLLLVELFLRYDSFDVEVGTSTLGSSVTVTSLKKATF

SEQ ID NO: 17584 - protein, 224 aa, Arabidopsis thaliana
MAGGGGYGGASGKVDYVFKVVLIGDSAVGKSQLLARFARDEFSMDSKATIGVEFQTRTLSIEQKSIKAQIWDTAGQERYRAVTSAYYRGAVGAMLVYDMTKRETFEHIPRWLEELRAHADKNIVIILIGNKSDLEDQRAVPTEDAKEFAEKEGLFFLETSALNATNVENSFNTLMTQIYNTVNKKNLASEGDSNNPGSLAGKKILIPASGQEIPAKTSTCCTSS

SEQ ID NO: 17585 - protein, 284 aa, Bordetella parapertussis 12822
MDTSSLPAIERQHLPALFAARPTDAHKGSCGTLGVIGGGPGMVGAALLAARAGLKVGAGKVLVGLVAETPPLPCDPMQPELMLRDFRGLLEAGLGIDAWTAGCGCGMDALAANALSELFQLRGDAALVLDADGLNLLAAGAVQPRWGDAPVVLTPHPAEAGRLLGLSTEAVQADRPAAARTLAARYGAWVVLKGAGSIVCDPAGACRINRTGNPGLATAGTGDVLAGILGALLAQRIAPEQAVPGAVWLHGAAADALVTHGIGPIGLTAGELADSARRLRNSRA

SEQ ID NO: 17586 - protein, 125 aa, Leifsonia xyli subsp. xyli str. CTCB07
MTGLDEALTRIRFTDTGLVPAIVQQWYTRDVLMMGWMDAEAFRRTMTEGRVTFWSRSRQEYWRKGDSSGNIQFVRGVALDCDGDTLLVTVDQVGAACHTGTYTCFDADPLAPVLGERPESAADGW

SEQ ID NO: 17587 - protein, 499 aa, Corynebacterium glutamicum
MTTTEAIYKRTVIVGSGFAGLGMGAQLKRRGDHDFVIIERADDVGGTWRDNTYPGAACDVPSHLYSFSFHPNPNWSQVFSPGPEIQTYLQNFAQDEGLLPHLHFNRNMNNARWDEKEGRWHITTPGQVYIAQFLITGTGHLADESYPTIPGLESFTGEKFHSARWDHNVSLKGKRIGVVGTGASAIQIVPEMAKIASELVVFQRTPSYIIPRMERKYTDGEKRLFQRNPHVIENLRSELFWGGENTFAQRRAIPRFLAEGKKLALDHLAAQVSDEELRAKLTPSYEPGCKRVLISNTYYPALQSPITTLEASALSSINGSTVRAASGEEYELDILIFATGFEATEPPYAQLIDGCDGLNLSEHWERGMQAYQSVAVAGFPNLLSINGPNTSLGHNSIVYIIESQIEYILGAMDYMSAIGASIIEPTAEAEEAYVEHIQRNAVGTVWLDGGCNSWYVDQRTGRLTLIWPDFGYAFRDANGTFDAEGYEFRDVPATAPATL

SEQ ID NO: 17588 - protein, 114 aa, Lithospermum erythrorhizon
MASRNSIAILLALNLIFFNLVTAQNITTCPVDTLQLGVCANVLGLIDLNLGRVPTQPCCSLLGNLVALEVGACLCTALDLNLLNLIHLTIPISLSLLVNTCNINGTIPSGWSCP

SEQ ID NO: 17589 - protein, 205 aa, Schizosaccharomyces pombe
MAMFSLEIPAISAETSKKLVVVGDGGCGKTCLLIVFSSGTFPERYVPTVFENYITDITYGPNSKVIELALWDTAGQEEYDRLRPLSYPNSNVILLCFSIDCPASLNNVTEKWYPEVQHFCPRTPIVLVGLKADLRKDRNATEVLRTQGLTPVTYQQAQSVALSMNAPYVECSAKENTGVNEVFQLAVGLTIKKSFSFSKKSCVIL

SEQ ID NO: 17590 - protein, 86 aa, Triticum aestivum
  misc_feature (11)..(11): Xaa can be any naturally occurring amino acid
  unsure (1)..(86): unsure at all Xaa locations
VVVLFSLTIAXAAPLIGAQSVIPPHLYPAPLRDFKRWYAAEFDDYLMAQPPAFLRGIFWLEIAFLWPLSVATIYGVLARRRWAATT

SEQ ID NO: 17591 - protein, 250 aa, Antirrhinum majus
MVKIAFGSIGDSFSVASIKAYVAEFIATLLFVFAGVGSAIAYNKLTSDAALDPAGLVAVAVAHAFALFVGVSMAANVSGGHLNPAVTLGLAVGGNITILTGLFYWIAQCLGSTVACLLLKFVTNGLSVPTHGVAAGMDAIQGVVMEIIITFALVYTVYATAADPKKGSLGVIAPIAIGFIVGANILAAGPFSGGSMNPARSFGPAVASGDFSQNWIYWAGPLIGGALAGFIYGDVFITAHAPLPTSEDYA

SEQ ID NO: 17592 - protein, 69 aa, Glycine max
  misc_feature (7)..(7): Xaa can be any naturally occurring amino acid
  misc_feature (13)..(13): Xaa can be any naturally occurring amino acid
  misc_feature (17)..(17): Xaa can be any naturally occurring amino acid
  misc_feature (23)..(23): Xaa can be any naturally occurring amino acid
  unsure (1)..(69): unsure at all Xaa locations
MSGRGKXGKGLGXGGAXHHRKVXRDNIQGITKPAIRRLARRGGVKRISGLIYEETRGVLKIFLENVIRD

SEQ ID NO: 17593 - protein, 668 aa, Prochlorococcus marinus subsp. pastoris str. CCMP1986
MVAASVSLESLCVNSIRMLAVDAVNKSNSGHPGLPMGCAPMGYALWHNILNHNPNNPKWFNRDRFVLSAGHGCMLLYSLLHLTGYKSVSIEDIKEFRQWGSKTPGHPETFETEGVEVTAGPLGAGISNAVGLAIAEAHLAAKFNKKDCEIVDHYTYVIMGDGCNQEGIASEACSLAGHLKLGKLIALYDDNQITIDGRTDVSFTEDVLKRYEAYGWHVQHVEDGNHDVKGITKAIESAKSVKDKPSLIKISTIIGYGSPNKSDTAGIHGAAVGEEEASLTREFLNWEYPPFEIPEDVYSQFRQAITKGEESEKKWNLKFQEYQNTYPSEGAEFKRMIQGELPENWDSDLPSYTTDDKGLATRKHSQICLGALGPNLPELIGGSADLTHSNYTDIKGETGSFQAHSPEKRYLHFGVREHAMAAILNGIAYHDSGLIPYGGTFLVFADYMRGSMRLSALSELGVIYVLTHDSIGVGEDGPTHQPVETIPSLRAMPNMLVFRPGDGNETSGAYKLAIKNRKRPSALCLSRQAMPNQENTSIEKVALGGYIVSDCEGTPDVIFIGTGSELNLCIEASKEISKLGKKTRVISMPCVELFEEQDASYKESVLPSSIKKRVVVEAAHSFGWHKYTGLDGICITMDRFGASAPGGKCMTSFGFTVENVVKKTKDIL

SEQ ID NO: 17594 - protein, 356 aa, Glycine max
VDMGDLFCEPFPHVSWLLPPNFPLNSQFPNFGQKSDQCYGQMLKNKSTTNSMVPSFVYLHLAHDYDDQDKLFFCDEDQAFLQKVPWLVVRTDNYFVPSLFLMPSFEKQLSDLFPNKETVFHFLGRYLFHPTNKVWGLVSRYYQAYLAKVDERVSIQIRVFDTGTGPFQHVLDQILACSLKENLLPDVNRKGDIVNSLAKPKSKAVLMTSLSSGYFDMVRDMFLEHPTVTGEVVGIYQPSHEGHQQTEKKMHNQKAWAEMYLLSLTDMLVTSSWSTFGYVAQGLGGLKPWILYKPENGTAPDPPCQRAMSMEPCFHAPPFYDCKAKRGTDTGALVPHVRHCEDMSWGLKLVDSNSWQ

SEQ ID NO: 17595 - protein, 456 aa, Prochlorococcus marinus subsp. pastoris str. CCMP1986
MRNSWIQPRIGQKNITQMNFAKNGHITEEMNYVAKKENLPPSLIMEEVARGRLIIPANVNHVNLEPMAIGIASKCKVNANIGASPNASDINEEVEKLKLAVKYGADTVMDLSTGGVNLDEVRQAIIKESSVPIGTVPVYQALESAHGSIERLTEDDFLHIIEKHCQQGVDYQTIHAGLLIEHLPKVKGRITGIVSRGGGILAQWMLHHFKQNPLYTRFDDICEIFKKYDCTFSLGDSLRPGCLHDASDDAQLAELKTLGELTRRAWTHNVQVMVEGPGHVPMDQIEFNVRKQMEECSEAPFYVLGPLVTDISPGYDHISSAIGAAMAGWYGTAMLCYVTPKEHLGLPNAEDVREGLIAYKIAAHAADIARHRAGARDRDDELSHARYNFDWNKQFELSLDPERAKQYHDETLPEEIFKKAEFCSMCGPNHCPMNSKISDETLDELNNKLTKCDTSV

SEQ ID NO: 17596 - protein, 511 aa, Idiomarina loihiensis L2TR
MTPTIKPLVLLILDGWGYREDAPDNAIAKANTPVMDRLWEKYPHCLVDGSGGAVGLPDGQMGNSEVGHVNLGAGRIVYQDFTRISKAISDRSFFSNTILCDALKKAKAAKGAVHIMGLLSAGGVHSHEDHLVAMIEMAVEQGAEDVYLHAFLDGRDTPPKSALPSIERFEALFARLGKGRFATLSGRFFAMDRDKRWERIEQSYKAVYHGLSGVTSANATDAVENAYERGETDEFVTPVVIGQPAPIANGDSVFFMNFRADRAREMTQAFVDKDFDGFDRGSRADISEFVMLTQYADTLEAPSAFPPEPLNNVLGEWLAKHDKTQLRISETEKYAHVTFFFSGGREQEFEGEKRVLIPSPKVKTYDLQPEMSSEQLTDELVAAIESQAFDVVICNYPNGDMVGHTGNFDAAVKACEAVDHSVGRVVSALEAVGGECLITADHGNAEQMSDATTGQAHTAHTNELVPFIYVGRPAKARNGRLSDVAPTILHLIGMEQPDEMTGTSLMTLEQD

SEQ ID NO: 17597 - protein, 387 aa, Bradyrhizobium sp. BTAi1
MISQNKVFADLPVTIFEQMSQLARDNNAINLGQGFPDDPGPEDIRRAAADAVLNGYNQYPSMMGLPELRQAIAAHYKHWHKLDLDPMSEVMVTSGGTEALTSAILSVVEPGDEVICFQPVYDSYLPIIRQAGGIPRLVRLEPPHWRLSEEMLRQAFSPKTKAVLFNNPLNPAAVVYPREDLELLARFCQEFDAVAICDEVWEHVVFDGREHIPLITIPGMRDRTIKVGSAGKIFSLTGWKIGFVCAAPQLLRVAAKVHQFLTFTTAPNLQMAVAYGLGKSDDYFLDMRAELARSRDRLTAGLERLGFPVLKAQGTYFLTVDLSPLGLNETDEQFCRRIVHDYKVAAIPVSAFYEKDAVTSVVRFCFAKKDATLDTALERLSDAIHRR

SEQ ID NO: 17598 - protein, 176 aa, Roseovarius nubinhibens ISM
MKTVKDYIRTIPNFPHEGIMFRDVTTLFGDGAGFSLAVDQMVEAAQGRDIDKVAGLEARGFILGGAIAHRLGCGFVPIRKAGKLPGSKISEAYLLEYGEAVVEIHEDAIEPGERVLLVDDLLATGGTAEAGIRLIERLGGQVVGCSFAVDLPELGGAARLRAMGMDVDMLCAFDGA

SEQ ID NO: 17599 - protein, 221 aa, Zea mays
  misc_feature (96)..(96): Xaa can be any naturally occurring amino acid
  misc_feature (125)..(125): Xaa can be any naturally occurring amino acid
  misc_feature (149)..(149): Xaa can be any naturally occurring amino acid
  unsure (1)..(221): unsure at all Xaa locations
MALANKLGGLLKKATSSNPSVYQAIRCMSSSKLFVGGISYQTDDHSLRDEFAKYGQVIEARIIIDRESGRSRGFGFVTYTSSEEASAAITALDGKXVDGRSIRVNHANEKTGGFRGGGGYGGGGXYGGGGGYGGAGGGGGYGGGHYGGXGGSGGYGGGDYGGNYSNRGGGGDYGVAGGGGGGGTFTAGGSDSFANSNFGSDSSFGGNGAGGFDATGRFHRR

SEQ ID NO: 17600 - protein, 251 aa, Glycine max
MKSGLKNGWPSVVRLRLRDKSVTPFCIFSKVKSAGNIPGNTPVYLNVYDLTTVNGYMYWAGIGIFHSGVEVYGVEYAFGAHDYPTSGVFEVEPRQCPGFKFRKSIFMGTTNLDPFQIREFMERQSANYNGDTYHLIVKNCNHFCEDICYKLTGNSIPKWVNRLARIGSLCNCILPDALKTSTVQHDDPNFQGCDSEKRRLRTAFSCLSSISMPQKEVSMSSLFMHSHYKGCLPPWELKKSKKGTLKQKLED

SEQ ID NO: 17601 - protein, 793 aa, Aspergillus nidulans FGSC A4
MDSGPDFEVQQPSSEPSTNNPRLPRLRDNSLSQYTREPLSDGLREPISFKRKHKHRSGFSLSNLSNIFTTDSDGHSGPSRTASRNGLTTDIDPQPAGESSQRNGNYNIQKEGGLLDWYVEGPGRRVGYDDFTAIDWIFEYTKERQRKRLLSASGKGMLGYARKVFDASNVWFVLIATGISVGIIAASIDIVSDWLGDIKAGYCKNGPGGGKFYLNRSFCCWGHEEVLGGFIIRHFMGPWTLAIKSLGLPKQQRRFSPVHAEETERELTFIARKREVLSAAAAAGISVAFGAPIGGVLFSLEQLSYYFPDKAMWQSFVCAMVATVTLQALDPFRTGNIALYEVKYTRGWHRFEMIPFVILGIVGGLYGAFLIRLNMRIAKWRKTRSFSHPIIEVVVVSILSALVNYPNIFMRAQNSELVHSLFAECSAGTPDHFGLCKTGAASAGTVALLLVAAVLGFFLTTITFGLDIPAGIILPSFAIGALYGRALGTAFKIWQDSYPGFFLFGNCEPDIPCVTPGLYAIVGAASALGGATRMTVSIVVIMFELTGALTYVIPIMIAVMLSKWCGDIFGKRGIYESWIQLNEYPFLDHREDTAPPDVPAHAVMTKTDDLTVLTAVGHTVGSLRNLLQTTSYRGFPVVMEASNPVLLGYVSRNELSYALKNPTSPSGEELSSATPVFFAHQPFADPMDTLDLRPWMDQTPITLNSGTTFLIVLRMFQRLGLRYVLFVNKGFLHGLLTKKDVWSVVNDPASREGEWTSGPLGGNDTAEEIGLLQSDDALSIAPPLTPLDRRPSF

SEQ ID NO: 17602 - protein, 229 aa, Malus x domestica
MSNYGNTTAEKTTDEYGNPTYNGSAGADRTDEFGNAVQHGRTNTGYGTADPKTRDEGIVGHHGGPAVLQRSGSSSSSSEDDGLGGRRKKGLKEKIKEKLPGGGNKDDQYSGGTQTTTPYGGGTTYKVGEQRQEKLPGGGNKDDQYSGGTQTTTPYGCGTTYKVGEQHQEKGTTDKIKEKLPGGNRDDQYSHDTSTTAAAYGGTGRTGEPQEKKNMMDKIKEKLPGGHAE

SEQ ID NO: 17603 - protein, 228 aa, Brassica napus
MFFDGYHYHGTSFEQTYRCYPASFIDKPQIESGDKIIMPPSALDRLASLHIDYPMLFELRNAGIERVSHCGVLEFIAEEGMIYMPYWMMQNLLLQEGDIVKVRNVTLPKGTYVKLQPHTTDFLDISNPKAILETALRNYSCLTTGDSIMVPYNNKKYFIDIVETKPANGISIIETDCEVDFAPPLDYKEPERPKTAPAAAKGPAKRSCAELSQVNLSRDLETVMELFV

SEQ ID NO: 17604 - protein, 291 aa, Oryza sativa (indica cultivar-group)
MAHVNEPPVPPPLPRTDWLSREEEDDLGATGERSQAKPLIMSGTGYTVEVTNLSSRASESDLHEFFSFSGAIEHIELIRSGEYGSTAYVTFKEPYSLETAVLLSGATIVDQPVCIARWGQPNEPYNFWDTPNWYTEEEIEYRTYQTCQFNSTPQEALTIAQDVVKTMLARGYVLSKDALARARAFDESHQVTATAAAKAAELSKRIGLTDRVSGLTDRVSAGVGAIRSVDETYHVSETTKTVATATGRTAVKVVNGIMTSSYFSAGAMMLSDALHRAAQAAADLAAHGRHN

SEQ ID NO: 17605 - protein, 475 aa, Haloferax volcanii
MVVGDIATGTELLVIGAGPGGYVAAIRAAQNGIDTTLVEKDAYGGTCLNYGCIPSKALITGANLAHEAGNAEEMGIHADPVVDMSQLRDWKSGVVDQLTGGVEKLCKANGVNLVEGTARFKDENAVRIAHGGEGQGSETIEFEHCIIATGSRVIQIPGFDFGDEPVWSSRDALEADTVPERLVVVGGGYIGMELSTTFAKLGADVTVVEMLDDILPGYESDVARVVRKRAEELGIDMHLGEGATGWREEDDGIMVTTETEDGEENEYRADKVLVAVGRSPVTDTMDIENAGLEADDRGFLSVDDRRRTDVEHIYAVGDVVEDTPMLAHVASKEGIVAAEHVAGEPVAFDSQAVPAAVFTDPEIGTVGMTEADAEEAGFTPVVGQMPFRASGRALTTNHADGFVRVVADEESGFVLGAQIVGPEASELIAELAFAIEMGATLEDVASTIHTHPTLAEAVMEAAENALGQAIHTLNR

SEQ ID NO: 17606 - protein, 981 aa, Aspergillus oryzae
MDKQQKLSARPSGIPRLASRLPLPTSTASKSIKPSPSREKLRTDTGVDTARLRRPSEEPLFKKPLPKYSVPKKTQNGLPQRRDVSQTRMSDGGKSETDSVLFRHGTDVSVDDADTRGRARPSLSERTIETLSQIPPSPSSSRHSSFFNGTSPMRSPSRPPSALSSCSRSPSRSSSSRQQIGGDFFRPSSAMRLPSRSRQSLYVGGTSAELNSVTSSDSASKLKLPTSRTSTFRDTKHTLSTLRGSSGTAVIQIPDTNITQEGLHVKKTRKTPTKTHQNSRAPTKMPKSPSTKATTLDLTLEQQSEMETRRTSRSSSALRESIAKAKAARKAAMQSVDNSQSSSLDELSVEDPFNQRPKDSNKGLLRKRLEAGRTSGHLNIAAMSLTALPEEVMTMYDFDPDSVTEWYESVDIVKFIAADNEFVELPDSAFPDTDPEDQDADERGNQFGGLEVLDLHGNLLRSLPIGFRRLQRLHTLNLSNNKLNLEDIQIIMEMESVKDLKLAKNHLQGSFPADIKNLSNLEVLDLHSNSLTELPNEVAYLTSLRVLNVGDNHLSTLPFEGLSKLSLKELSAPNNRLKDTLLPASVQALMTLQYLNVTGNSLTKLSNHDTLELPNLHTLAISMNRIQCLPDVSSWQALLSLSAENNSIADLPRGFTDLKAVRNVDLTGNNISKLDERIGLMESLVIFRIANNPLRERKYLNMSPEDLKRELRNRCEPEPQDTDDEEGSVATQFTLAPEAPAQSGVWQVKPGGVLDRSYADLQDLDMDHLERINPHEVRCLYLQHNELRCIPAPTLSMLALNLTDLDLSHNPLDSTSLSPTSLDLPSLQILNLSATGLTSLEPLLASLQAPSLTFLDVSNNRICGSLPPVRQTYPSLMTFLAADNQFDSLEFDAIQGLQVLDIGNNNISFLPPKLGLLRAEGCSKNWGNGSALKRFEVAGNSFRVPRWQIVAKGTDAILEWLKDRIPAEDLCQWEPDDESSI

SEQ ID NO: 17607 - protein, 365 aa, Kluyveromyces lactis NRRL Y-1140
MSMQRLDEYVAHDVISNKSNVKREMLVKEYKRIGQGAFGTVVQAYLTPDNQKWLGPFAIKKVPAQTEYKSRELEILRIADHPNVVKLEYFYTHISPTDHKLYQHLAMECLPEMLQNEILRYKKNNLELPLKHVKLYAYQIARGMLYLHALGICHRDIKPSNVLVDPQTGILKICDFGSAKKLESNQPSISYICSRYYRAPELIVGCTQYTTKIDIWGLGCVLGEMLLGKAVFQGHQPLLQLHEITKLLGPPDKRFIFFSNPSYNGPLFSKPLFEGAPKARFEKYFGYAGPDGVDLLMSVLVYEPERRASPRRILAHPFFDDLRNERYFFPSGSSQPKHLPPLYDFSDFELQVIGDLFPKIQPKQD

SEQ ID NO: 17608 - protein, 948 aa, Zea mays
  misc_feature (57)..(57): Xaa can be any naturally occurring amino acid
  unsure (1)..(948): unsure at all Xaa locations
MAASVSRAICVQKPGSKCTRDREATSFARRSVAAPRPPHAKARRRHPLRLRRGTGPXHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARWWGKCCVSGCSGIRVNDAEKLVTIGSHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 17609 - protein, 560 aa, Oryza sativa (japonica cultivar-group)
MASHIILPKEEEAALGVAVEEDHDSPAAPGYQHQQGPPVAKALPFSATCVRISRDSYPNLRALRNASAMSLPDDDAAYAKLEEGDYGYLLDDVPHFTDYLSDLPTFPNPLQDHPAYSTVKQYFVNADDTVPEKVVVQKDSPRGVHFRRAGPRQRVYFESEDVKACIVTCGGLCPGLNTVIRELVCGLSHMYNVNDIFGIQNGYKGFYSSNYLPMTPKSVNDIHKRGGTVLGTSRGGHDTKKIVDNIQDRGINQVYIIGGDGTQKGAYEIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMVIVVAEGAGQDLIAKSIAAADQIDASGNKLLLDVGLWLTHKIKDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENVKKPANGEK

SEQ ID NO: 17610 - protein, 332 aa, Exiguobacterium sibiricum 255-15
MATPINRQTEMTLVQAVTDALRTKLTDDETTLVLGEDVGKNGGVFRATDGLQEEFGEDRIIDTPLSEAGIVGTSIGLAVNGFKPIVEIQFLGFIYPAYEQIMTHVSRIRMRTMGRYGVPMVIRAPYGAGIRAPEIHSDSTEALFTSMPGLKVVCPSTPYDAKGLLIAAIEDPDPVLFLESMRSYRAFKEPVPSEAYTIEIGKANCITEGQDVTLIAWGAMVQVAQKAATEAATRGISCEVIDLRTLYPLDRETISASVQKTGRAVIIHEAQATGGLGNDLLALINDTSFLYLRAPVARVTGFDVPVPLFALEDHYIPTPTRVLEAIQRTVDF

SEQ ID NO: 17611 - protein, 577 aa, Ralstonia solanacearum GMI1000
MYIYDAIDQQLVDERVVQFSDQTRRFLSGQLTEDEFRVLRLQNGLYLQRHAPMLRVAIPYGMLASRQLRKLAGIARRWDRGYGHFSTRQNLQFNWPRLEDAPAILAELATVQMHAIQTSGNCIRNTTTDHFAGIAPDEIVNPLVWCEIIRQWSMLHPEFAFLPRKFKIAVSGALTDRAAVGIHDIGLQAVGQDGRIGFRVWVGGGMGRTPMVGKLIHPFVPWQDLLTYLQATLRVYNLHGRRDNKYKARIKILVKDLTPEVFRRQVDEQWRPIRGGPDTVTEAFVDSVAARFTVSPYDAQAANDPDDTAALAEANPSFRRWLRGNVHPHRVPGYVAVTASLKAPGRAPGDITAEQMETMADLADRYGFGELRVSHEQNLILADVRRSGLFALWQDLGAAGLATPNIGKITNIIACPGGDFCALANAVSIPLAQAIHARFDDLDHVHDIGELDLNISGCINACGHHHIGHIGILGVDKAGEAWYQITLGGRQNGAGGPEGSDSPAAIGRIIGPSFAQAQVPDVIERLIDTYLAHRDSDAERFVDVVGRIGIEPFQAAVYPDAAIAARRSHAEVAHGGA

SEQ ID NO: 17612 - protein, 380 aa, Exiguobacterium sibiricum 255-15
MNMLNPSTNPSLSIMEKISGHEQVVFCNDPVSGLQAIIAIHDTTLGPALGGCRMAPYSTVDEALDDVLRLSRGMTYKCAAADVDFGGGKAVIIGNPATDKTPELFRAFGRFVDSLGGRFYTGTDMGTTMDDFVHASRETSRIVGIPEAFGGSGDSSIPTAEGVIYGLRATVETLYGSDDLSRASYAVQGLGKVGYKVAEQLLSAGANLYVSDLSEAVLAALVEQAEKTPGTVRVIAAHEIHLTDADIFVPCAYGGVIQAANIGQLQCKAICGSANNQLADDALALELQQRGILYAPDYIVNGGGLIQVADELYGANHERVLLKTKHIYDAVLEVFNESHAESITTLEAANRMCNKRIQIRSRHNNIFTNTIKPKWNIRND

SEQ ID NO: 17613 - protein, 180 aa, Platanus occidentalis
MLPMVTGFMNYGQQTVRAARYIGQSFMITLSHANRLPVTIQYPYEKLITSERFRGRIHFEFDKCIACEVCVRVCPIDLPVVNWRLETDIRKKRLLNYSIDFGICIFCGNCVEYCPTNCLSMTEEYELSTYDRHELNYNQIALGRLPISVIGDYTIRTIMNSTQIKIATGKPLDSKTITNY

SEQ ID NO: 17614 - protein, 393 aa, Platanus occidentalis
MTVPATRKDLMIVNMGPHHPSMHGVLRLIVTLDGEDVIDCEPVLGYLHRGMEKIAENRTIIQYLPYVTRWDYLATMFTEAITVNAPEQLGNIQVPKRASYIRAIMLELSRIASHLLWLGPFMADIGAQTPFFYIFRERELIYDLFEAATGMRMMHNYFRIGGVAADLPHGWIDKCLDFCDYFLTGIAEYQKLITRNPIFLERVEGVGIIGGEEAINWGLSGPMLRASGIQWDLRKVDHYGCYDEFDWEVQWQKEGDSLARYLVRISEMTESVKIIQQALEGIPGGPYENLEVRRFDRARDSEWNDFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 17615 - protein, 525 aa, Hordeum vulgare subsp. vulgare
MDMDQLCLMAVATILLTLILRQVLGGKGTGAKLPPGPWNLPVIGSLHHLVATKLPPHRALLSLSRRYGPVMLLRLGEVPNVIVSTPEAAMLVLKTNDLTFATRTSGPTLDVVGSASEGIIFAPYGEHWRQMRKVCVVELLSAMQVRRIQSIMQAEIAHLLESVAAASSASPSGSAVVDVGKGLARLTNNVIARAVFGGKSRQQEAYLRELDVMAILGGGFSLVDLFPSSRLVRWLSSSGRAMRRLHSRMQRILGDIIQDRKETRAPNGASDAATARDNEDLLDVLLRLGKQDALSFPLTSEIISAVIFDIFSAATDTTAATLEWAMAELVRNPRAMARAKLEVRQMLRHRRSSTITSADLAGLHYLRMVIKETLRLHPSAPLIHRASQENCRVMGYDIPKGTAVMINAFAVGRDPAHWGADAAEFRPERFQGTSVEYSSQGPHMEFVPFGAGRRQCPGALFATTMLELVLANLLYHFDWAIPGGESPETMDMGEVFGIIVHTRSSLHLQASEACHLQDQTTGVVS

SEQ ID NO: 17616 - protein, 311 aa, Zea mays
MAQGANFPGFIGAVGGHDGGVNFGGNFCDMAFYQKLGEGSNMSVDSLNSMQTSMHGGSITMSVDNNSSVGSNSDSRTGMLGHPGLKGPVIVGSYSVGHSIFRPGRVSHALSEDALAHALMDNKFPTETLKDYEEWTIDLGKLHLGMPFAQGAFGKLYRGTYNGMDVAIKLLERPEADPEKAQLLEQQFVQEVMMLATLRHPNIVKFIGACRKPLVWCIVTEYAKGGSLKNFLSRRQNRSVPLKLAVKQALDVARGMAYVHGLGFIHRDLKSDNLLISGDKSIKIADFGVARIEVKTEGMTPETGTYRWMAP

SEQ ID NO: 17617 - protein, 370 aa, Brucella abortus
MNTHSVPVTTMDAQLRERAERVIPNGMWGHQRASSLPQGYPQYFASGKDACVTDVDGNSYIDFMCAWGPIILGHRNPLVDAAALSQIELGDSLNGPTAHAVELAELLVATIPHADWALFQKNGTDATTSCVTIARGTTKRRKVLVAKGAYHGAAPWCTPSLVGVTAEDRVHLIHYVYNDVESLTAAAREAGDDLAAILVSAFKHDLAIPQESPTKEFAQAARALCDAAGAALILDDVRGGFRIDLGGSWRGTGIEPDMAAYSKAIANGYALAAVTGSDRFREAARQAYMTGSFWYGGASMAAAVATIKELRRIDGPALMKMRANAFAAALTRRPPDTGSTCFKPARRSCRWCSSPATAMPRLARVFARRR

SEQ ID NO: 17618 - protein, 256 aa, Selaginella remotifolia
ETWLVTTTSSSNPEVGLATGLAATGGAQDLLNPPLNKQKEPPVGRGKIEIKRIENATSRQVTFSKRRGGLLKKAHELSVLCDAQVALIIFSSTGKLFEYASTSMKEILDRYGKYPESVQGGNMASHHEASDFISHEIRRLKQQLQRSQQSRRHLLGDDLSHLPIKDLQNLEQQLEVGLSRVRSRKDQVLMDQVDELRRRELTLHKDNEMLRRRLSDVQGMAESGRSTLIVNPWRQGNLLQTWQMYPCHFLDTKAAA

SEQ ID NO: 17619 - protein, 211 aa, Pseudomonas syringae pv. phaseolicola 1448A
MQLKNPILGLCQQATFMLSAAKVDQCPDDEGFEVAFAGRSNAGKSSALNTLTHASLARTSKTPGRTQLLNFFGLDEDRRLVDLPGYGYAKVPIPLKLHWQRHLEAYLGSRESLKGLILMMDIRHPMTDFDLLMLDWAIASNMPMHILLTKADKLTYGAAKNTLLKVQTEIRKGWGDAVSIQLFSAPKRMGLEEAYTVLADWMELEDKAPAE

SEQ ID NO: 17620 - protein, 375 aa, Brucella ovis
MKIDYYEALGVTRTADDKTLKAAFRKLAMQYHPDRNPDDPEAERKFKEIGEAYETLKDPQKRAAYDRFGHAAFENGGMGGGFGNGFAGAGGFADIFEDIFGEMMGGRRRRNGAERGADLRYNMEVTLEEAYAGKTAQIRVPTSITCDECSGSGAKPGSQPTTCTMCSGSGRCRAAQGFFSVERTCPGCNGRGQIIKDPCKKCHGQGRVDRGRSLSVNIPAVSRTEPRIRLAGEGEAGLRGGPAGDLYILLSVKPHEFFQRDGADLYCKVPISMTTAALGGQFEVSTLDGTQTRVKVPEGTQNGKQFRLKGKGMPGLRQSVTGDLYIQIDIETPQNLSKRQRELLEEFEKLSWQENSPKSAGLFSRMKEFFEGIGE

SEQ ID NO: 17621 - protein, 332 aa, Prochlorococcus marinus subsp. pastoris str. CCMP1986
MKKTKVICIGEALIDRIKNKSNQEFTDFLGGAPANVACALRKLQIDSVFIGRIGSDEFGKKFINQFKELEVNINFLQLDDCLPTRIVKVNRDNSGDRYFSGFDTSLNTFFADEAFDKNEIKKDLKSLENLFSKTKYLVCGTIILSSSISADTINFLLSLANKFDVKIIIDLNWREVFWDFATSSSETNKKERVDLIRNLLNKAHILKLAKEEAILFFENKNPLEISERLLNRPDVIITDGANPICWLINGVQGTTEVSKSLKIIDTTGAGDAFLAGLISQLLSFDYPSNESEIQNCVKFASICGLLTCLGEGAIEQQPDYSKVNKFFGSQIL

SEQ ID NO: 17622 - protein, 426 aa, Actinobacillus pleuropneumoniae serovar 1 str. 4074
MSKSEQLFEKAQKVIPGGVNSPVRAFKGVGGTPVFIQKAEGAYITDSDGKKYIDYVGSWGPMVLGHNHPAIIDAVLKAVPNGLSFGAPTESEITLAELVTKLVPSIELVRMVSSGTEATMSAIRLARGYTGRDKIIKFEGCYHGHSDSLLVKAGSGALTLGQPSGPGVPADFAKHTLTCTYNDLDSVKTAFEQYPNEIACLIVEPVAGNMNCIPPKNDFLKGLRALCDQYGAVFIIDEVMTGFRVALGGAQAYYDVKPDLTTLGKIIGGGMPVGAFGGKKEIMEYIAPTGPVYQAGTLSGNPIAMAAGLACLTELSKAGNEEKLAAQTKTLAEGFKALADKHNVLFTAQYVGGMFGLFFTEQAEITNFQEVMKCDAAKFNRFFHLMLEQGVYLAPSAFEAGFMSLAHSDEDIQATLAAADKAFAQL

SEQ ID NO: 17623 - protein, 346 aa, Triticum aestivum
  misc_feature (14)..(14): Xaa can be any naturally occurring amino acid
  misc_feature (37)..(37): Xaa can be any naturally occurring amino acid
  misc_feature (49)..(49): Xaa can be any naturally occurring amino acid
  misc_feature (67)..(67): Xaa can be any naturally occurring amino acid
  misc_feature (100)..(100): Xaa can be any naturally occurring amino acid
  misc_feature (112)..(112): Xaa can be any naturally occurring amino acid
  misc_feature (125)..(125): Xaa can be any naturally occurring amino acid
  misc_feature (212)..(212): Xaa can be any naturally occurring amino acid
  unsure (1)..(346): unsure at all Xaa locations
AAANWCYATVAPRXRSSTIVASLGTPAPSNSSSFRPXLIRNTPVQAAPXFAPALMDAAVERLKTGFXKFKTEVYDKKPDFFEPLKARPGRPKYMVFACAXDSRVCPSVTLGXWSPGEAFTIRQHXANMVPSYCKNKYAGVGSAIEYAVCALKVEVIVVIGHSRCGGIKALLSLKDGADDSFHFVEDWVRIGFPAKKKVQTECASMPFDDQCXLLEKEAVNVSLQNLLTYPFVKEGVSNGTLKLVGGHYDFVSGKFETWEAVNLPHRVNSYIYMRIQNAYIYQDIVPTVRPNGCESNAMGVAYSVIFQYWDAGMARCEFAISNRTFFLLPFSDEELYYHVMHNLIVL

SEQ ID NO: 17624 - protein, 1113 aa, Roseovarius nubinhibens ISM
MPKRTDISSIMIIGAGPIVIGQACEFDYSGAQACKALREEGYRVILVNSNPATIMTDPELADATYIEPITPEIVAKIIEKERPDALLPTMGGQTGLNTALAVADMGVLEKFGVELIGANREAIEMAEDRKLFREAMDRLGIENPRATIVTAPKKENGNADLDAGVQIALEALEDIGLPAIIRPAFTLGGTGGGVAYNRDDYIHYCRTGMDASPVNQILVDESLLGWKEFEMEVVRDKADNAIIVCSIENVDPMGVHTGDSITVAPALTLTDKEYQIMRTHSINVLREIGVETGGSNVQWAVNPADGRMVVIEMNPRVSRSSALASKATGFPIAKIAAKLAVGYTLDELDNDITKVTPASFEPTIDYVVTKIPRFAFEKFPGSEPLLTTAMKSVGEAMAIGRTIHESLQKALASMETGLTGFDEVEIEGAGPTEAGKAAVIKAISRQTPDRMRTIAQAMREGLSNDEIQAVTSFDPWFLERIREIVEAEAEIRANGLPSDEHGLRAVKMLGFTDARLAILTGKTETEVRAARRAAGVTAVFKRIDTCAAEFEAQTPYMYSTYESPVMGEVECEARPSDRKKVVILGGGPNRIGQGIEFDYCCCHACFALSDTGYETIMVNCNPETVSTDYDTSDRLYFEPLTFEHVMEILSTEQQNGTLHGVIVQFGGQTPLKLANALEAEGIPILGTTPDAIDLAEDRERFQDLVNRLGLKQPHNGIAHSDAEALAIADEIGFPLVIRPSYVLGGRAMEIVRDMAQLERYIAEAVVVSGDSPVLLDGYLSGAIECDVDAICDGKDVHVAGIMQHIEEAGVHSGDSACSLPPYSLSQDIITRIEEQTRALALALNVVGLMNVQFAVKGDDIYLIEVNPRASRTVPFVAKATDSAIASIAARVMAGEPLSNFAHRGSYAKDAKPGTVPMADPLTLADPAMPWFSVKEAVMPFARFPGVDTILGPEMRSTGEVMGWDRSFARAFLKAQLGAGTILPTEGRVFLSIKDADKTPAMADTARTLIDLGFEIVATRGSAAFLTENGIACEVVNKVYEGRPNIVDMLKDGGIHLVINTTEGTQSVEDSREIRSVALYDKLPYFTTAAGAHAAAQAMQARLEGDLDVLPLQG

SEQ ID NO: 17625 - protein, 81 aa, Oryza sativa (japonica cultivar-group)
MPATPTIIGALLGLGTQMYSNALRKLPYMRHPWEHVVGMGLGAVFVNQLVKWDEKLKEDLDKMLERAKQANERRYFDDDDD

SEQ ID NO: 17626 - protein, 502 aa, Exiguobacterium sibiricum 255-15
MSTVHEKTIEMKRSVYHLVINGEQVEGTSGETFKTYNPATGEVIAEVAKASKADADRAVQAARDAFDHGKWKMWPVGRRSQVLNKIAGIMRSRFNELVELEILDTGKSLAAAQGQITQAIEDFEFYAGAIVGHRGSVNNVPGQFHNYTEKEPVGVCAQIIPWNYPLMMAAWKVAPAIAVGCSVVVKPATLTPLTAIILGEICLEAGVPAGVVNVIPGSGREIGNHLVEHPNVNKVAFTGSTPVGKDIMGRASESLKRVTLELGGKSPNLVFEDADITAAVDGSLFGIFYNSGQSCEARSRLYIHEDIYDTFMEQFVAKTKQLVLGNPFDKGTHVGAIIDQQQLDVIDGYVQSAKADGATILTGGQVEKVAGFEEGFWYAPTIIADVTHDMKAVQEEIFGPVVVVMKFKDEKEAVRLANDTEFGLGSAIWTKDGARATRIANQIKAGIVMINCPFSAFPGTPFGGYKQSGFGRELCIETLDLYTETKSILSYYGSRPLNPFGL

SEQ ID NO: 17627 - protein, 172 aa, Pyrus pyrifolia
MKKASEPPVVGRVIGDVLDSFTATTKMSVTYNTKLVCNGLELFPSVVTAKPRVEIQGGDMRSFFTLVMTDPDFPGPSDPYLREHLHWIVTDIPGTTDATFGREVVSYEMPKPNIGIHRFVFVLFKQNRRQSINTPSSRDHFSTRSFAAENDLGLPVAAVYFNAQRETAARRR

SEQ ID NO: 17628 - protein, 401 aa, Oryza sativa
MAAKSLREIRRAAAAGIGSRRCFSGDAAAAAAAAAGVAEGKVGGGAGKEVNLFTAINQALHIALDTDPRSYVFGEDVGFGGVFRCTTGLADRFGRNRVFNTPLCEQGIAGFAVGLAAMGNRAIAEIQFADYIFPAFDQACLRLDQCFVPTYLYIQLLVQIVNEAAKFRYRSGNEFNCGGLTIRSPYGAVGHGGHYHSQSPEAFFCHVPGLKCSPLLDLISGPTSLFGLGSSNGLHRNLWLFSCKLMKDKFQWLYRLAVEEVPEEDYMLPLSEAEVIRKGSDITLIGWGAQLAVLEEACEDAAKDGISCELIDLRTLIPWDKETVEASVSKTGKLLVSHEAPITGGFGAEIAASITERCFQRLEAPVARVCGLDTPFPLVYETFYMPTKNKVLDAIKATVNY

SEQ ID NO: 17629 - protein, 492 aa, Streptomyces coelicolor A3(2)
MTHELFDSKGLLGSAPAAFVAGEYELDSSHGTLPVINPANGQLVAEVPSSSSSTVDRAVTAAVAAQREWGRRSHVARAAVLEAVRDAIAVHADELARIVSVEQGKPLSDARGETEGACAFFDFAISQKYRAVGSMMASEPGRSLGVREEPIGVVAAILPWNFPVAIFARKVAPALMAGNAVVLKPSELTPLSALALARLCRLAGVPDGLLSVVCGEGKDTGRALVTHPGVGMVTMTGSTRGGREILAQVADQIIPVSLELGGKAPFIVFEDADLDAAVEAAADARLWNTGQVCTCNEVTYVHADLHDEFVRRVVDRFASVTPLDPFAAGSRLGPLVAERERTRVQGMVDAAVAAGARVRTGGGRPDGEQYQSGAWFAPTVLTNVRPEMDIARREVFGPVLPIIPFDAEAEVVSAANSTAYGLTAYVYTRDLSRAMRMIDALEFGEVYVNQAGPEQVQGFHTGWKSSGLGGDDGPHGYEKYLRRKTVYVRHAV

SEQ ID NO: 17630 - protein, 647 aa, Zea mays
MAAVWKWKHAVFLVLVTMMRPQAAEAGGAANATAACPLDLGYVATLPWDRAPCEPPVTNGTACCMTLLSVFAVGLASRLRATGRFRLPSARASAACLRAFSAALAAPPLSLPASLVPGCFPVQSQFAISPDYCAGVTTAAEYVAVAGNASAAGLNASCGADVTSMSLCNRCLAAGVDASARLTAAAGNESKSLNCFYLTVLYAAGISSSAGPESPVTARCALGLALSTPPPTSSPTSSSATHTTNIAVAATVPIASLLLVSLVALLVWRYRHELSKDRRSIQISEERRSRPRPNTGSVMFDICELAKATGGFAERNLIGRGGFGVVYRGVLVDGTVVAVKKMLEPDVEGGDEEFTNEVEIISHLRHRNLVPLRGCCIVDADADPDPDEGKQMFLVYDYMPKGSLDQYIFDDAQGRRRPALSWAQRRTVLLDVARGLEYLHYGVKPGIYHRDIKATNILLDADMRARVADFGLARRSREGQSHLTTRVAGTHGYLSPEYALYGQLTEKSDVYSFGVLVLEVMSGRRALDLSDPSGVVLITDWAWAHAKAGRPGDVLAQALRKEPSTSVAAMERYVLVGILCAHVTVAFRPTMPEALRMLEGDMDVPDLPDRPQPFGQRIAFDEGETNFSASSILSGGGPFVDFGDMLR

SEQ ID NO: 17631 - protein, 320 aa, Enterobacter cloacae
MIKKIGVLTSGGDAPGMNAAIRGVVRAALTEGLEVFGVYDGYLGLYEDRMVQLDRYSVSDMINRGGTFLGSARFPEFRDEHVREVAIENMKKRGLDALVVIGGDGSYMGAKRLTEMGFPCIGLPGTIDNDIKGTDYTIGFFTALGTVVEAIDRLRDTSSSHQRISIVEVMGRYCGDLTLAAAIAGGCEFIVVPEVEFSREDLVAEIKAGIAKGKKHAIVAITEHICDVDELAKYIEAETKRETRATVLGHIQRGGSPGPYDRILASRMGAYAIDLLLQGHGGRCVGIQNEKLVHHDIIDAIENMKRPFKGDWLDCAKKLY

SEQ ID NO: 17632 - protein, 967 aa, Azoarcus sp. BH72
MLTKKSSTAAGSGRRLRSSAARSLGQTMDRRTFLKRSGLGVGAGAIAAQLPYNLIGSAEAAASADNRLAGGEEVKRTVCTHCSVGCAVDAVVKNGVWVRQEAVFDSPINLGSHCAKGASVREHGHGEHRLKYPMKLVDGKYQKISWEQAINEVGDRLLKIREESGPDAVYWIGSSKHNNEQAYLLRKFVSFWGTNNCDHQARICHSTTVAGVANTWGYGAMTNSYNDMQNAKAMLFIGSNAAEAHPVSLLHILHAKENGAKMVVVDPRFTRTAAKADYYVRIRSGTDIPFIWGVLYHIFKNGWEDKQYIHDRVFGLEKVKEEVMKWTPDKVTEVTGIAEEQVFKVAETMAKNRPSTVVWCMGQTQHTVGNANVRAMCILQLVLGNVGVSGGGTNIFRGHDNVQGATDVGPNPDSLPGYYGLAAGSWKHWAAVWGVDYEWIKGRYASQAMMEKSGITVSRWIDGVLEQNELIDQDSNLRAVVYWGHAPNSQTRGIEMVEAMKKLDTLVVIDPYPSATAAMAAMVRKDGVYLLPAATQFETYGSCTASNRSIQWREKVIEPLFESKPDHTIMYAFAKKFGWAEQLVKNIKVAKDKQGWEEPDIEDTLREINRGTWTIGYSGQSPERLQAHMKNMHTFDVKTLKAVGGPCDGDYFGLPWPCFGNPEMKHPGTPNLYDTSKHVMDGGGNFRANFGVEKDGVSLLAEDGSASKGADLQMGYPEFDHVLMKKLGWWDELTEDEKKAAEGKNWKTDLSGGIIRVVMKNHGCHPFGNAKARAVVWNFPDPVPLHREPIYSPRPDLVEKYPTHADKMAFWRLPTLYKSLQDKVKDISRDYPLVMTSGRLVEYEGGGEETRSNPWLAELQQEMFAEVNPKDANNAGFRNGDYIWVETPSKAKLKVRAQVTERVGAGTVFLPFHFSGWWQGKDMLEHYPEGAAPIVRGEAVNTATTYGYDSVTMMQETKTTLCRVSKA

SEQ ID NO: 17633 - protein, 398 aa, Clostridium acetobutylicum ATCC 824
MNFSKKAGQIAASITLEITAKADEMKANGINVIGFGAGQPDFNTPKNIRDAAIYAIENGYTKYTPVSGIKELKMAICDKFKRDNNLNYSLSNIIVSTGAKQCLSDTFSALLNPGDEVILSAPYWVTYPELIKLNDGISVIINTTEENHFKLSVDDLENAYTSKTKAILINSPSNPTGTVYTETELKAIAEFAKEKDLFIISDEIYEKLIYDGERHVSIASLSQDAFNRTVVINGMSKSYAMTGWRLGYAASGSSEFIKLMSHIQAHTTSNANSITQYASVEALNGRQEELHSMVTEFEKRRTYMSKRVNNITGIHCLLPKGAFYVMMNISNLFGKEINGVKINNSVDFSKELLSENKVAVVPGTGFGNDNYVRLSYATSMDNIVKGLDEIENFIGKLR

SEQ ID NO: 17634 - protein, 204 aa, Oryza sativa
MQLEISPRQRSQQQKEEEGEHQQRAGEEAVGAVFSIEPWVDAAAVLVPPLNFAEVNDGIFRSGFPAADNFAFLLSLKLRSIVYLCPEPYPEENTRFLEQNGIKLHQFGIDGSKELLVNIPEEKIREALKVILDVRNQPVLIHCKRGKHRTGCVVGCLRKLQKWCLTSVFDEYQHFAAAKARSTDQRFMELFDTSSLMHLTASQC

SEQ ID NO: 17635 - protein, 326 aa, Streptomyces coelicolor A3(2)
MTDSRAGLGPQAAGGLLTFGETMGLVTATTIGTLEYARDFTFGIGGAESNVAIGAARLGAPVTWIGRVGSDAAGDLVGRRMRAEGIQTVAVRDTSFTGLMVRHHRAATVVHVDYHRAGSAGSRLTAHDIPVGEIRRAAILHLTGITPALSASARQATWDAVAAAKANGVRVSLDVNHRSKLWDRDTARRELRRLVAEADIVFAGIEEAQLVLDSEADAPESLADALAATGPGETVVKTGARGCTAHIDGAIHEEPALSVPVVDTVGAGDAFVAGYLAEHLRGAGPVQRLRTACAMGAYAVSVPGDCELLPTRSELETFLTTGDVLR

SEQ ID NO: 17636 - protein, 370 aa, Aspergillus awamori
MSNLPHEPEFEQAYKELASTLENSTLFQKNPEYRKALAVVSVPERVIQFRVVWEDDAGNVQVNRGFRVQFNSALGPYKGGLRFHPSVNLSILQVPWFRADLQECSHWPEHGWWYVEHMIAHATNGQESFKGKRVAISGSGNVAQYAALKVIELGGSVVSLSDTQGSLIINGEGSFTPEEIELIAQTKVERNELASIVGAAPFSDANKFKYIAGARPWVHVGKVDVALPSATQNEVSGEEAQVLINAGCKFIAEGSNMGCTQEAIDTFEAHRTANAGAAAIWYAPGKAANAGGVAVSGLEMAQNSARLSWTSEEVDARLKDIMRDCFKNGLETAQEYATPAEGVLPSLVTGSNIAGFTKVAAAMKDQGDWW

SEQ ID NO: 17637 - protein, 604 aa, Corynebacterium diphtheriae NCTC 13129
MTTTNSYTGQLGAFLTPHGDTCFRVWSPDAATADLLIENHTVSMHPIGDGVWEAKLDGDRHGQRYSYRLSLRGETIESVDPYARAVTANGTHGVVVTQSTPVPRMPAFTAPTDAIIYEAHVRDLSIAPNSGIHNKGRFLGLTERDTHTTAGNPSGLDYILSLGVTHIQLLPIFDFGSVDETGDLSYNAQYNWGYDPMNYNAPEGSYSSNPNDPFTRIDELKHTIRTLHDAGLRVIMDVVYNHVYDTTTSPLERTAPGHYFRMTDDGTFHDGTFCGNETASENPMMRKFIIDSVTHWATEYGLDGFRFDLMGIHDVDTMNAIRTALDAIDPSIIILGEGWNLGNHPPHILPANQHNAAHMPRIAHFNDSLRDTLKGSTFHSNSRGLLTGDHNPKHMWTLFNNIKGAQHLPGLNFTSANHTVNYIEAHDNHTLYDRLHLLLPDAPHDELIRRCQLATTIQYLACGITFIHAGQEFARTKNNTENSYNSPDHINAIDYDRAAQHPHSVQLLRDLNNFRKTHTELFPTEYDDINELYEATLVSGDFLTYSVGKQTTVAINFSTQPRSIPTEGYFAVLLDDHVFPTDKQIETNSWTVAPLSVSILQQVS

SEQ ID NO: 17638 - protein, 422 aa, Arabidopsis thaliana
MADLLPIYLIILAFLCTVGAIALALFHIYKHLLNYTEPIYQRYIVRIVFMVPVYALMSFLALVLPKSSIYFNSIREVYEAWVIYNFLSLCLAWVGGPGSVVISLTGRSLKPSWHLMTCCIPPLPLDGRFIRRCKQGCLQFVILKPILVAVTLVLYAKGKYKDGNFSPDQSYLYLTIIYTISYTVALYALVLFYVACKDLLQPFNPVPKFVIIKSVVFLTYWQGVLVFLFAKSGFIRDEEEAALFQNFIICVEMLIAAAAHFYAFPYKEYAEANVGGARSFSGSLAHALMLNDFYHDTVHQFAPTYHDYVLYNHNDGGEEGTRKYRARTFVPTGQEMDAVRKNKHMFGNKIDGVSVSSQSSETSTPKTSGVTYDPARPESMKSSLLVDASDSVSTMYDMSLIDIDISSYPSKVPSANISGGPK

SEQ ID NO: 17639 - protein, 461 aa, Bradyrhizobium sp. BTAi1
MAEFDVDLFVIGGGSGGVRAARIAAGYGARVMVAEEYRMGGTCVIRGCVPKKLFVIGSHVRQEIADAAGFGWTIPTATFDWKTLIANKDKEIARLEAAYTANVEKSGARIVKTRAVLEDAHTVRLATGETIRAKYILIATGGAPNHGTPIPGIEHVISSNEAFHLEELPRRIVIQGGGYIALEFACIFANFGSDVTVVYRGDNILRGFDEDVRKHVRAEMEKEGITILTGCTVASVDKHGKDYTTHLSNGSSIASDKVMFAIGRHPAVANLGLEKAGVAINPRNGGIAVDAFSQSSVPSIYAIGDVTHRFNLTPVAIREGHAFADTVFGGKTVRVDHADIPTAVFSQPEVGTVGLTETQARELYDRVDIYKTSFRPIKATMSGRDTRVLMKLVVDGASDRVLGCHIVGDMAAEITQAVAIAIKMKATKADFDATVALHPSAAEELVTMRTVTERHVRQAAE

SEQ ID NO: 17640 - protein, 197 aa, Xanthobacter autotrophicus Py2
MRKADIVRETKETRVALTVDLDGTGRSAISTGIGFLDHMLDLLARHARFDLEIKADGDLHVDFHHTTEDVGIVLGQALKKALGDMRGITRYADVLLPMDETLTRVALDISGRPFLVFRTEFAVPKIGEFDTELVREFFQAFASSAGVTLHVETLYGVNAHHIAESCFKGLARVLRAAVAVDPAAAGEIPSTKGALGT

SEQ ID NO: 17641 - protein, 230 aa, Bradyrhizobium sp. BTAi1
MDALKRQAAAHALREVESGMKLGLGTGSTAKHFVDLLGEKVRAGLKVVGVPTSEATRAQAEACGVPLTTLDEIDHLDLTVDGADEINPALDLIKGGGGALLREKIVASASDRMIVIADESKWVARLGRFPLPIEVIPFGLAATRHAIAAAFAKAGVSGQMDLRKSADGHVFVTDGGHWIVDVRLGEIEDPPRLAGLLSAIPGVVEHGLFIGLGSTAILAGAQGIRVIQRP

SEQ ID NO: 17642 - protein, 172 aa, Chaenomeles sinensis
MKRASEPLVVGRVIGDVLDSFTATTKMSVTYNTKLVCNGLELFPSVVTAKPKVEIQGGDMRSFFTLVMTDPDFPGPSDPYLREHLHWIVADIPGTTDATFGREVVSYEMPRPNIGIHRFVFVLFKQNRRQSINTPSSRDHFSTRSFAAENDLGLPVAAVYFNAQRETAARRR

SEQ ID NO: 17643 - protein, 662 aa, Chlamydophila caviae GPIC
MDKISFYPGSPLPLGATQLSSHRYRFALFSSQATQVVLALSDKNSHIQEIVLSHEKNRTGAVWHIEVEGISDQWSYAFRVDGPTNTTAKFDFKKYLADPYAKNLHSPQIFGSIKTSGDYAFSYLKNEEFSWEGDHCLNLPKEESIIYEMHVRSFTWNNSSKVCYPGTFLGIIEKIDYLKKLGINAIELLPIFEFDETHHPFRTADSSHLCNYWGYASVNFFSPCRRYAYGSDPCAPIREFKTLVKALHKAGIELILDVVFNHTGLDNTTCPLPWIDLSSYYMVNSQGEFANYSGCGNTVNTNYTPTTQWILDSLRYWVQEMHVDGFRFDLASVFSRDPLGNPVPFSPILQAISYDPVLSETKIIAEPWDAAGLYQVGYFPTLSPRWSEWNGQYRDTIKSFLNGDGHLIGTFASRISGSQDLYPQGSPCNSINYICSHDGFTLHDTVSYNSKHNEENGEENRDGSNANYSYNFGEEGETNNPTILALRERQMRNFLLTLFLSQGIPMLQSGDEYGHSAKGNNNRWALDTDTNHFLWDELSKNNALFDFVCNAIRFRKQHKEIFNQGFLTEENISWLDAQGNPMQWNPSKFLAYELKSPKYSLFTAFYTGEEKIEIHLPKLRENFLPYQKVADSFGFASESLSKQVSLDAHMMLVAISYANQAS

SEQ ID NO: 17644 - protein, 453 aa, Roseovarius nubinhibens ISM
MQHVEGEDNRSEARAAWARAQGAGPGAALIARDAEAFLHQSLSSPCVSTIARAEGIWIEDLEGRRYMDFHGNSVHHLGYGHPKVIAAIKDQLDALPFAPRRFTNEPAVALAEKLGAVAPGDLSKVLFTTGGSDANEVALKIARAATGRFKTLSFWDAFHGAGFGAASVGGEATFRSHIAGPLLPGAEHVAPFHCYHCAYGHPGPEACGLACAKMVEYVLAREGDVAAVIAEPMRAVPVVPPPGYWQAVQAACHRHGALLIMDEIPTGLGKTGEMFAFEHDGITPDIVTLGKALGGGVLPIAAVLARRDLDVCGEFAIGHYTHEKNPVTARAALATLEVIEEEDLVARAARLGEAAQARLRERLSGLASVGDIRGRGLMFGVEIVRDREGRVPAPGLAEQIYYRSLAAGVSFKISAGNVLTLSPPLVIAEEDLWTALDHVAAAVEAVTEAAGLC

SEQ ID NO: 17645 - protein, 453 aa, Xanthobacter autotrophicus Py2
MALDDLVTEGAGVGADAIPNDLDAFWMPFTSNRSFKKRPRLVSRAKDMHYYTPEGRAILDGCAGLWCVNPGHNREPIVEAIRQAATEVDFAPTFQYGHPQAFRLASRIADLAPGDLDHVFFCNSGSEAVDTALKIALAYHQTTGAGTRTRLIGRERGYHGVGFGGISVGGIVSNRRTFGTMLTGVDHLRSTYDREHQAFTKGEPDYGAHFADELERIVALHDASTIASVIVEPMGGSTGVLPTPKGYLKRLREICDKYGILLIFDEVITGFGRLGHAFAAERYGVVPDMITFAKGITAGAVPMGGVLVRKGIHDAFMKGPEHVVELFHGYTYSAHPLACAAGLATLDLYAREHTFTHARALEPFFADAMMSLKDKPGVLDIRTVGITGAVDLAPKEGAPGLKGYEALERAFHEEGLMMRIAGDTLVVTPPLIISKDQVGELVEKLGRVIEKVA

SEQ ID NO: 17646 - protein, 486 aa, Roseovarius nubinhibens ISM
MDGQMSKDELRHEGMRIGGEVVFTDEVIEVRYPYTNEVVGTVPAGRAEHAARAFEIAANYKPSFTRYERQQILFRAAELIRERRDWLAKWLTLELGICHQHALYETGRAYDVFTLAGQMAILDDGEVFSCDLTPQGKDRKIYTMREPVRAISAITPFNHPLNMVSHKIAPAIATNNCVVCKPTELTPLTAIALADILYEAGLPHEMFQIVTGWPKDIGDEMVTNENIDIITFTGGVPVGKMIAEKAGYKRTALELGGNDPLIVCNDLSDADLEKAATLAVAGSCGNSGQRCTAVKRILVQESVADRFVPMVVEKAKAIRFGDPQDPETQLGCVIHAEAAELFEKRVYMAQEQGAEILYHPGREGALLPPIVVDRVPHESELVMEETFGPIVPIVRVPDDDAEVMKISNGTPFGLSSGVCTNDLNRAIAYINGLNVGTCNIWEQPGYRIEMSPFGGIKDSGNGVKEGVLEAMKFFTNVKTYSLPWPR

SEQ ID NO: 17647 - protein, 735 aa, Arabidopsis thaliana
  misc_feature (552)..(552): Xaa can be any naturally occurring amino acid
  unsure (1)..(735): unsure at all Xaa locations
MVSRFRLALEAVLGSRRRKKMASTSSGGGGGGDKKKKKGFSVNPKDYKLMEEVGYGASAVVHRAIYLPTNEVVAIKSLDLDRCNSNLDDIRREAQTMTLIDHPNVIKSFCSFAVDHHLWVVMPFMAQGSCLHLMKAAYPDGFEEAAICSMLKETLKALDYLHRQGHIHRDVKAGNILLDDTGEIKLGDFGVSACLFDNGDRQRARNTFVGTPCWMAPEVLQPGSGYNSKADIWSFGITALELAHGHAPFSKYPPMKVLLMTIQNAPPGLDYDRDKKFSKKMSSCAQSFKELVALCLVKDQTKRPTAEKLLKHSFFKNVKPPEICVKKLFVDLPPLWTRVKALQAKDAAQLALKGMASADQDAISQSEYQRGVSAWNFNIEDLKEQASLLDDDDILTESREEEESFGEQLHNKVNDRGQVSGSQLLSENMNGKEKASDTEVVEPICEEKSTLNSTTSSVEQPASSSEQDVPQAKGKPVRLQTHSGPLSSGVVLINSDSEKVHGYERSESERQLKSSVRRAPSFSGPLNLPNRASANSLSAPIKSSGGFRDSIXDKSKANVVQIKGRFSVTSENLDLARASPLRKSASVGNWILDSKMPTGQAIKESSSHLSFIIPQLQNLFQQNSMQQDLIMNLVNTLQQAAETTDGSQNGKLPPLPRGSDSNGTVVELTAAERERLLLTKITELRARLFLFFNQSHLSYRRSMWMKELTEELEVEKSKQTQLQQKLKSVTGREQL

SEQ ID NO: 17648 - protein, 438 aa, Oryza sativa (japonica cultivar-group)
MHSRHQRLASLTKLLTSHVNVGRHRDALAFFSRMVSDPSLPPLSDPSFAYAFPLALKSSSALRLPSAAAAADSLHALAAKCGFLSSPFFASALVASYGACASPALARRLFDELPHRNAIVCSAMISVHIRSGDLAGALRELDLMDVAPTASCFNSVIAAVAESGEHPARAIDLYRRMQRMGVLPSLITLLALVPSCTALGALSSIKEVHGFATRHGMFASCHLGSSLIEAYGRCGSLAGARNVFDQVQERDVVVWSSIVSAYAFHGHADVAMSLFRHMELDNVRPDGIMFLGVLKACGHAGHADDALKYFDVLTKIFGVEACGDHYSCLVDVLGRAGRLRQAYDVIQTMPVKVTAKAWGALLAACRKYGEVGLAEVAGRALFEIEPENAGNFVSLANIYSGMGMHDKAEQVRREMEQRGVRRLPGSSWMIHCKSSELF

SEQ ID NO: 17649 - protein, 338 aa, Acinetobacter calcoaceticus
MHPIVIIGSGMAGYTLDREFRKLNPEHELDMICADDAVNYAKPTLSNALSGNKAPEQIPLGDAEKMSTQLKLQILSETWVKAINPETHELKLEKNGQETIQPYSKLVLAVGANPTRLAIAGDGSDDIHVVNSLIDYRAFRENLAKRQDKRVVILGAGLIGCEFANDLQHTGHQVTVIDLSPRPLGRLLPAHIADAFQKIWRKRIHFVLSTTVEKVSKINDGQDYAVTLANGQTLVADIVLSAIGLQPNIDLAKHAGVHTSRGILTNSLLETNLEDTYAIGDCAEVNGTLLPYEMPIMQQARALAKTLSGETTHVHYPAMPVAVKTPAAPLTVASCTCG

SEQ ID NO: 17650 - protein, 598 aa, Oryza sativa (japonica cultivar-group)
MTTYRVCCFLRRFRAASNEPSEELGDVFQAYADGGGGVMGEEALRRFLREVQGEAAGGGDDELEATAREVMAFAAEQRLLRKGGAAAAGGGLTVEGFHRWLCSDANAALDPQKRVYQDMGLPLSHYFIYTGHNSYLTGNQLSSGCSEVPIVKALHDGVRVIELDLWPNAAKDAVEVLHGRTLTSPVGLMKCLEAIREYAFVASPYPVILTLEDHLTPDLQSKVAKMIKETFGDMLYVSETENMAEFPSPDELKGKIIVSTKPPKEYLQTKNDADADEAGVWGEEITDDKVAATAMTTEEKCAAAEEAVAAAAVDEEMQEAETDKKTQHGVDNEYRRLIAIPLTRRKHDMDQDLKVDPDMVTRLSLGEKAYEKAIVTHGAHIIRFTQRKLLRIFPRSTRITSSNYNPLMGWRYGVQMVAANMQGHGRKLWLTQGMFRANGGCGYVKKPDILMNNDPDKLFDPTSKLPVKTRLKVTVYMGDGWRFDFRKTHFDKCSPPDFYARVGIAGVEADTRMEQTKVKMDTWIPAWDHEFEFPLSVPELALLRVEVHESDNHQKDDFGGQTCLPVWELRRGIRSVRLCDHRGEPLRSVKLLMRFDFT

SEQ ID NO: 17651 - protein, 97 aa, Glycine max
  misc_feature (64)..(64): Xaa can be any naturally occurring amino acid
  misc_feature (76)..(76): Xaa can be any naturally occurring amino acid
  misc_feature (83)..(83): Xaa can be any naturally occurring amino acid
  unsure (1)..(97): unsure at all Xaa locations
IYTLYILTHFDSGFLNRHVGLTYNYGNGDTYGDGYLQVLATTQTSWQASKKSFQGTADAKKQFXWLFYDPRSYDIXDDLILSXDHLSRMDYMDFVQN

SEQ ID NO: 17652 - protein, 651 aa, Brucella abortus
MSVLKTDDQINGTHRAHHQVLTKLINAQTPSDFDILQSDFTDGMHDAVYRLMAEIMGLNTGYCGGRGGSMHMRDAASGIAGTSAIVGGNIPHAAGYALADKILNRKGISVAFFGDGASLQGATYEAMNIAALYRLPVIFYVENNLYAVSTHIQDATRETRIASRGPMLGFTGIECDGMDILSVHQAMREACRIIEEEGGPVVIEAQCYRYLHQSGSKSGSDFGYRTREEEEEWKSRDPIALAERRLKELGIAGDAEFLKIDERVTAAVQAAGERLTETAAGSNVLRIPDALWPSASSVDDGILGDGSEFSGAEFREIEDYQPDELEKMRFAAAASDVLGRAMEKDPTIIVMGEDVHRFAGGVSGFTRNALELFPDRVLAMPIAENGFTGVALGAALRGLRPVVEIMFGDFCFVAADQIANGISKVRHMFGDGFPVPIVMRVRVSPHTGYGSQHSGDPSALFGMFPGWRVVSPTNAFDYIGLMNSALKSDDPVAVIEHVEFYQRESLVPRNDRDYCIPLGKAKIVRPGSACTVLATSVMVQASIKAAEEAGIDAEIIDMRSLDMFGIDWALIGASIGKTNRVVIAEQVASGLSLGRHWIAEIQKRFFNDLDHEVLHVTGSMASPVVSLVLNKAALGSADKVRSALEQITHSA

SEQ ID NO: 17653 - protein, 445 aa, Rhizobium leguminosarum bv. viciae 3841
MTRVAVIGAGPSGLAQLRAFQSAAQKGAEIPEIVCFEKQSDWGGLWNYTWRTGLDEYGEPVHGSMYRYLWSNGPKECLEFADYSFEEHFGKPIASYPPRAVLWDYIKGRVEKANVRHWVRFSTPVRMVRFDDQTKKFTVTAHNRIEDRMYDEEFDYVVVASGHFSTPNVPYFEGVKTFNGRVLHAHDFRDALEFKGKDILLVGRSYSAEDIGSQCWKYGAKSVTTSYRSKPMGFKWPENFEERPLLTKLENRTAHFLDGSTKEVDAVILCTGYQHHFPFLPDDLRLKTANRLWADSLYKGVIFDKNPQLFYIGMQDQFYTFNMFDVQAWWARDVMMGRITLPPEEELKANFDMWRAREETLEDAEQMIWYQGDYVKELLAETDYPSFDIEGTNQTFMEWEHHKAHNIMGFRDHAYRSLMTGNMSPTHHTPWVEALDDSMEEYLRN

SEQ ID NO: 17654 - protein, 713 aa, Mesorhizobium loti MAFF303099
MTILYAVIACGLLSVLYAIWATRSVLASDQGNARMQEISAAIREGAQAYLARQYTTIALVGVVVLLLAWWLLSITAAIGFLIGAVLSGAAGFIGMHVSVRANVRTAQAASNSLAAGLDIAFKSGAITGMLVAGLALLGVSIYYLILTGPMGLQPNDRIVIDSLVALGFGASLISIFARLGGGIFTKGADVGGDLVGKVEAGIPEDDPRNPATIADNVGDNVGDCAGMAADLFETYAVTVVATMVLGAIFFGGTAVLGAAMLYPLAICGACILTSIVGTFFVKLGANGSIMGALYKGLIVTGLLSIVGLAVATSVCFGWGEIGTVAGMVITGKNLFICGLIGLAVTGLIVVITEYYTGTNKRPVNSIAQASVTGHGTNVIQGLAVSLESTALPAIVIVGGIISTYQLAGLYGTAIAVTTMLGLAGMIVALDAFGPVTDNAGGIAEMAGLPKEVRHSTDALDAVGNTTKAVTKGYAIGSAGLGALVLFAAYSNDLKFFAANGDKYPYFQGMGEISFDLSNPYVVAGLIFGGLIPYLFGGIAMTAVGRAAGAIVEEVRKQFREDPGIMAGTSKPNYARAVDLLTKAAIREMIIPSLLPVLAPLVVYFGVLLISGSKASAFAALGASLLGVIVNGLFVAISMTSGGGAWDNAKKSFEDGFTDKDGVKHLKGSEAHKASVTGDTVGDPYKDTAGPAVNPAIKITNIVALLLLAVLAHG

SEQ ID NO: 17655 - protein, 550 aa, Idiomarina baltica OS145
MRSKRIYRIAKTFLNYGLDDLIPARWLPWYLRFGRHMMFWWPNKHKEKPAGERLRLALESLGPVWVKFGQMLSTRRDLLPPDIALELAYLQDRVAPFDGHAAQRIIEKSLDIEHIGELFQDFAVKPLASASIAQVHTAKLKQKDGELKDIVIKVIRPDIRETINADLELMESLAAVLARHLPDGRRLKPKEVVREYRKTLLDELDLLREAANAIQLKRNFEDSELLYIPTVYSDLSRKNVMVMERIDGIPVSEVDMLKARGVDMKKLAERGVEVFFTQVFRDSFFHADMHPGNIFVAKDDPTYPRYIGIDFGIVGTLNREDKRYLAENFLAFFNRDYRKVAELHVDSGWVPRETNIEEFESAIRTVCEPIFEKPLAEISFGHVLVNLFNTARRFQMEVQPQLVLLQKTLLYIEGLGRQLYPELDLWKTAKPFLERWMNEQLGWRAVVRSVKENAPYWAEKLPELPNLLYDGLRSQQRIQAQLERHRIEQLMTQQQAATSQFWTILTASGVVSSVWLISQGTAAWALGSGILTVMVGLKAWRARPQIKIKE

SEQ ID NO: 17656 - protein, 474 aa, Lactobacillus plantarum WCFS1
MDLSHTRLLRKKDINAMLATYHSPLKKELKTFDLTMLGIGAIIGTGIFVLTGTGALTAGPGLMISFVLAAIACLFASLCYAEFAAMVPESGSAYTYAYTTLGEIVAFIIGWDLMLEYLFAVSTVSAGWSGYFQSFLAGFGLKLPAALSAAAGSVPGVTSYFNLPAFTIIILITTLLSLGVKETKRVNNVMVVIKLAVVLLFIFTAVRFIKPANWSPLLPFGFKGVFGAASSVFFAFIGFDAISSSVEETLEPSKTLPRSMLLSLGICTILYVAVSAIMTGVVPFETFAKYIDHPISAVLIYSGQNWMAGIIDLGAILGMTTVMLVCLYGQTRISFSMSRDGLLPHVFSDISAKTGAPLKSTVLFGSIAAIMGGFIPLADLAELVNIGTLTAFTLVSFSILRLRKTQPDLRRPFKTPWVPFVPIMSIICCVFLLINLKPVTWIRFVVWLAIGMVVYFGYSVKHSQLKTDTATDEK

SEQ ID NO: 17657 - protein, 309 aa, Coccidioides immitis RS
METTLAAARYGKENVKVCKVHRDTTTGWQTVTEMTVSVLLEGDIESSYTKADNSVVVATDSMKNTIYILAKQHPVTSPELFASIIGSHFIEAYKHIHAAHVHIVAHRWTRMAIDGKLHPHSFMRDGTDVRIADADVIEGKGIEIKSSISGLLLLKSTGSQFHGFIQDEFTTLPETWDRILSTEIDANWTWMPFENLDHVKSVVPKFDRAFSSARDISLRLFAQDDSASVQNTMYKMASEILGTEPLLKAVSYSLPNKHYLELGLSWHKGLKNVGKDAEVYVPTSAPNGLIQCTVARGTDRYIRATTSKL

SEQ ID NO: 17658 - protein, 341 aa, Idiomarina loihiensis L2TR
MKALSKLHAKPGIWMTDVEKPECGYNDLLIKIKKTAICGTDVHIYKWDDWSQKTIPVPMVVGHEYVGEVAAMGDGVRGFEIGDRVSGEGHITCGHCRNCRAGRRHLCRNTYGVGVNRPGAFAEYLALPAENAFKLPDDVTDEMAAVFDPFGNAVHTALAFDLVGEDVLITGAGPIGIMAAAVARHVGARHVVITDVNEYRLDLARKMGVTRAVDVSKEKLSDVMTELGMKEGFDVGLEMSGVPSAFSQMLETMNHGGKIAMLGIPPENIAIDWNQVIFKGLVIKGIYGREMFETWYKMASLLQSGLDISPILTHEMPIDDFEKGFETMISGQSGKVILNWD

SEQ ID NO: 17659 - protein, 161 aa, Synechococcus sp. CC9311
MYIGWDNEGVLMFFPSLTPVMTAWTAKLLSIVALLVCSGSVLPVSAQTAAGEDSLITIESDTQSADNITGVVTAVGNVRIVYPSRGMVATSRQAQYFSREALLVLSGDVDVVQDDGNSIRAERVTYNLDDERALANPIPGQQVQSTLLLKQSPDSQTPLTP

SEQ ID NO: 17660 - protein, 400 aa, Campylobacter jejuni subsp. jejuni NCTC 11168
MFDEIRFNTIERLPNYVFAEVNAIKMAARRAGEDIIDFSMGNPNGKTPQHIIDKLCESANKDKTSGYSTSMGIYKLRLAICNWYKRKYNVNLDPENEVVATMGSKEGFVNLARAIINPGDVAIVPTPAYPIHTQAFIIAGGNVAKMPLAYNEKFELDENQFFENLHKTLNESIPCPKYVVVNFPHNPTTVTCEKSFYERLIATAKKERFYIISDIAYADLTYDDYKTPSILEIEGAKDVAVETYTLSKSYNMAGWRVGFVVGNKRLVSALKKIKSWFDYGMYTPIQVAATIALDGDQTCVDEIRATYDKRMHILLEAFENAGWKLQKPRASMFVWAKLPESKRHLKSLEFSKQLLQRASVAVSPGVGFGEAGDEYVRIALIENENRIRQAARNIKKYLKE

SEQ ID NO: 17661 - protein, 379 aa, Idiomarina loihiensis L2TR
MQKISEKPPIIWLNTLVFSITFIVAIVGVPLYAYSVGIGAAFWWVMLGTACFAGLSITAGYHRLWAHRTYDANPVIRFIFAIGGAVALQNSALHWSSDHREHHKHVDDNDKDPYSAKRGFWYSHIGWMIREYQASRYTDYDNVKDLQKDPIVMWQHKYYLPLTLFVNFGWPIAAGFMLGDVWAGLLVIGVLRLVLNHHTTFFINSLAHIWGKQPYTDKNTARDNGVLAFLTFGEGYHNYHHIFAADYRNGIRWWQFDPTKWLIVASKWLGLAKNLKRSSPYQVERAKLQMQLKRAQLKAQAAPESLFERAQEHYDQMGQQLKAYYQARKKLLDTKAKALKEHVHHDIDALKRQVDEMKASLEMQKRSWKALLNQIQQHA

SEQ ID NO: 17662 - protein, 176 aa, Triticum aestivum
  misc_feature (22)..(22): Xaa can be any naturally occurring amino acid
  misc_feature (45)..(45): Xaa can be any naturally occurring amino acid
  unsure (1)..(176): unsure at all Xaa locations
MAPPVMASSATSVGPFQGVKSXTAALPVSRRSNGASLGSVSNGGXIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 17663 - protein, 552 aa, Synechococcus sp. RS9917
MTTSAPAEPTQRQVRLDAPFTDQKPGTSGLRKSSQQFEQPHYLESFVEAVFRTLPGVQGGTLVVGGDGRYGNRRAIDVILRMGAAHGLSQVILTTGGILSTPAASNLIRQRQAIGGIILSASHNPGGPNGDFGVKVNGANGGPTPAAFTDAVFACTTTLEQYSIVDAAPIPLEAPGRHTIGTMTVEVIDGVEDFVALMQQLFDFDRIRDLIRSDFPLAFDAMHAVTGPYATRLFEELLGAPAGSVRNGVPLEDFGGGHPDPNLTYAHELADLLLNGEAYRFGAACDGDGDRNMILGQHCFVNPSDSLAVLTANATVAPAYAAGLAGVARSMPTSAAVDVVAKDLGIDCYETPTGWKFFGNLLDAGRITLCGEESFGTGSNHVREKDGLWAVLFWLQILAERRCSVAEIMAAHWARFGRHYYSRHDYEAVPSDAAHGLYERLEAMLPALRGQDFAGRRIQAADNFSYTDPVDGSVTTGQGLRILLDDGSRVVVRLSGTGTKGATIRVYLESYVPSSGDLHQDPQVALADMIEAINQLAEIQVRTGMDRPTVIT

SEQ ID NO: 17664 - protein, 143 aa, Solanum lycopersicum
MDFIILLIAILALSSTPITIISGSVTNHTYSTTNSYTNVALSARKVVFPPPRQLGKDNSDDDDLICKTCKRLSEHRTCCFNYFCVDLFTNRFNCGSCGLVCIVGTRCCGGICVDIKKDNGNCGKCNNVCSPGQNCSFGLCVSA

SEQ ID NO: 17665 - protein, 1115 aa, Mycobacterium tuberculosis CDC1551
MPRRTDLHHVLVIGSGPIVIGQACEFDYSGTQACRVLRAEGLQVSLVNSNPATIMTDPEFADHTYVEPITPAFVERVIAQQAERGNKIDALLATLGGQTALNTAVALYESGVLEKYGVELIGADFDAIQRGEDRQRFKDIVAKAGGESARSRVCFTMAEVRETVAELGLPVVVRPSFTMGGLGSGIAYSTDEVDRMAGAGLAASPSANVLIEESIYGWKEFELELMRDGHDNVVVVCSIENVDPMGVHTGDSVTVAPAMTLTDREYQRMRDLGIAILREVGVDTGGCNIQFAVNPRDGRLIVIEMNPRVSRSSALASKATGFPIAKIAAKLAIGYTLDEIVNDITGETPACFEPTLDYVVVKAPRFAFEKFPGADPTLTTTMKSVGEAMSLGRNFVEALGKVMRSLETTRAGFWTAPDPDGGIEEALTRLRTPAEGRLYDIELALRLGATVERVAEASGVDPWFIAQINELVNLRNELVAAPVLNAELLRRAKHSGLSDHQIASLRPELAGEAGVRSLRVRLGIHPVYKTVDTCAAEFEAQTPYHYSSYELDPAAETEVAPQTERPKVLILGSGPNRIGQGIEFDYSCVHAATTLSQAGFETVMVNCNPETVSTDYDTADRLYFEPLTFEDVLEVYHAEMESGSGGPGVAGVIVQLGGQTPLGLAHRLADAGVPIVGTPPEAIDLAEDRGAFGDLLSAAGLPAPKYGTATTFAQARRIAEEIGYPVLVRPSYVLGGRGMEIVYDEETLQGYITRATQLSPEHPVLVDRFLEDAVEIDVDALCDGAEVYIGGIMEHIEEAGIHSGDSACALPPVTLGRSDIAKVRKATEAIAHGIGVVGLLNVQYALKDDVLYVLEANPRASRTVPFVSKATAVPLAKACARIMLGATIAQLRAEGLLAVTGDGAHAARNAPIAVKEAVLPFHRFRRADGAAIDSLLGPEMKSTGEVMGIDRDFGSAFAKSQTAAYGSLPAQGTVFVSVANRDKRSLVFPVKRLADLGFRVLATEGTAEMLRRNGIPCDDVRKHFEPAQPGRPTMSAVDAIRAGEVNMVINTPYGNSGPRIDGYEIRSAAVAGNIPCITTVQGASAAVQGIEAGIRGDIGVRSLQELHRVIGGVER

SEQ ID NO: 17666 - protein, 491 aa, Burkholderia xenovorans LB400
MKRYQLFIDNEWVDPHSGAWFETDDPFTGEPWAEIPRADPTDADRAVRAAEKALEGPWSTLSASERGMLMYKLGALIERDAEHLATIESRDNGKLFRDVLGQMKYMAKYYYYFGGLADKIQGAVVPIDKPGIFNFIRYEPMGVVLSITPWNSSLPLTTWKMAPALCAGNTIVCKPSEFTSASLFELAKLFVEAGFPRGVFNVVTGFGPEIGASLVSHPGVARIAFTGGDEAGRKIYAAAAQHLKRVSLELGGKSPNIVFDDADLDQAVNGVISGIFSATGQTCVAGSRVLLQESIHDAFVERVAKLTRAAKVGNPLDPASEIGPITTKPQFEKILGYIDIATREGARCVAGGRALSGPGYGAGRFVEPTVFVDVTNDMRIAQEEVFGPVLSIIRFKDEEDAIRIGNDIKFGLAAGVWTNSLHRAMLMSQRLKAGTVWINNYRSSSFTTPFGGFKQSGIGREGGIESVKEFMEAKSVWMSSDLKMPALFAGK

SEQ ID NO: 17667 - protein, 290 aa, Oryza sativa (japonica cultivar-group)
MQMSTNPNHYPVFPHSFRNQHVVSFQTSTIANGSGAIPVCPASSGGMNSDMTLLNTTPSTIVSTSSPNMLADSNQSLKYAAPMAVDWSYPELQLLNDGLLKYANEPGIMKYIKIAAMLPEKTVRDVAMRCQWMAAKKENTRRRKTDEHYLGKKTRDRKDKMVESSWATNRQVQTTDIRSPSTLACNTVRDNQFQSGASEIDRAMLNILEENARVLKQIGENIMTSQVQNNIDLFHHARRNISDLLQSMSQMPGIMSKMPPLPVSIDDRLASYILPGVNLAQVFGSSHLRS

SEQ ID NO: 17668 - protein, 435 aa, Rhizobium leguminosarum bv. viciae 3841
MTLDLAAFARDKGIKYFMISYTDLFGGQRAKLVPAEAIADMQKDGAGFAGFATWLDLTPAHPDLFALPDASSVIQLPWKKDVAWVAADCVMDDQPVEQAPRVVLKRLVAEAAKEGLRVKTGVEPEFFLISTDGSVISDQFDTAEKPCYDQQAVMRRYDVIAEICDYMLELGWKPYQNDHEDANGQFEMNWEYDDALQTADKHSFFKFMVKSVAEKHGLRATFMPKPFKGLTGNGCHAHISVWDIDGKVNAFADKEMPFGLSAQGKTFLGGIMKHASALAAITNPTVNSYKRINAPRTTSGATWAPNTVTWTGNNRTHMVRVPGPGRFELRLPDGAVNPYLLQAIIIAAGLDGIRSQADPGRHYDIDMYAEGYLVKDAPRLPLNLLDALRAYDADEGLKQAIGAEFSAAYLKLKHQEWNAYCSHFTQWERDSTLDI

SEQ ID NO: 17669 - protein, 207 aa, Azoarcus sp. BH72
MTQSQALRVGIGGPVGSGKTALTLALCRALRDKYNIAVVTNDIYTAEDAQFLVRNEALAPDRIIGVETGGCPHTAIREDASINLEAVDRLNQRFPGLEIIFVESGGDNLAATFSPELSDLTLYVIDVSAGDKIPRKGGPGITKSDLLVINKIDLAPMVGASLEVMDRDARKMRGERPFIFSNLKTGQGLAEIIAFIETQGLLRPHAG

SEQ ID NO: 17670 - protein, 329 aa, Oryza sativa (indica cultivar-group)
MPSEFVAARKKPPPELLFAACRKKQQPPPPGMAFVPSEFAAAGVGRKRQPAPPVEIRRVWAHNVEEEFRIIRNAIDHFPYVSMDTEFPGVIHRPTKHPALLTAGDRYDLLRRNVDALHLIQVGITLAASPTAAPALAFEINLSDFDQRVHRHAAESVQLLAEHGVDLAAHRRHGVRASALAPLLMSSGLVCSHGAVKWVTFHSAYDFAYLVKLLMGRKLPRSMAEFLNLVRVFFGDEVYDVKHMMRHCGGELYGGLERVAAALQVKRAAGRCHQAASDSLLTWDVFRRMRELYFLKHGVEAYQGVLFGLELDMDMPSNKTPSLPLVAAR

SEQ ID NO: 17671 - protein, 130 aa, Idiomarina baltica OS145
MSKVIIATDKAPAAIGTYSQAVKIGTTVYLSGQIPLDPETMELVSEDFQQQAEQVFKNLAAVCEAAGGELQDMVKVQIYLTDLGEFAIVNEVMARHFSKPYPARAAIGVKQLPKGAQIEIDGILELPSTN

SEQ ID NO: 17672 - protein, 486 aa, Bordetella parapertussis 12822
MEDLRNHEFKNYIGGQWVACAAGKTYPNVNPADTDDIVGRFQASQAEDAAAAVAAAQAAFDGWRNLAVSKRAALMQRAADYLEAHAEQFGRELTREEGKALNLAKDEVLRSAQTIRFYAAEGQSFSGETFVNDDPDMVVYSQREPLGVVTVISPWNFPVSIPARKIAPALITGNTVVFKPSSDAPLSGLRLVEAFEQAGLPPGVLNLVTGSASAIGAAITQAPQVRAVSFTGSTAAGEQIHRSVDMTTRTQMELGGKNPLIVMADADLDRAVDLVVKGGFSLSGQACTGTSRVLVDAPVKAAFTEKLLAKVKALKVGNSLEGSFDLGPLATARQLESVMRYIEVGKQEARLLYGGERLDGPGYERGYYLTPAVFADVTQQMRIAREEIFGPVIALIEVNGYEDAIAKANDTEYGLAAAIATTNAQYAHRFARDIQAGTVKINRTTTGNLINAPFGGLKRSSTSTFRESGRIGLEFYTQIKTVYRAG

SEQ ID NO: 17673 - protein, 244 aa, Oryza sativa (indica cultivar-group)
MVRKLVASLFLGGGGGGGNDACSLSSSSSTASSWQWPSCTQARTLSFARHDAPASADDDDSKRRRQQEEEEDDYCVYKTSVMNPAFFLDDHSTCRSYSSAASAVNDVVDDDDEVIIRGLRSSNRRLFFEPESTSSIVVKGRAVDADAAAFDGATAMSIDSADPYGDFRRSMEEMVMSHMSGGGHDWGWLEEMLGWYLKANGKKTHGFIVGAFVDLVVALASSPSSATASSSAFQLPLQKGSQIN

SEQ ID NO: 17674 - protein, 190 aa, Oryza sativa
MAAAAATPRHHHRLLLLLFILFLAAGAAVPVSGAWDAKGKTLCSGRLLGLTDCGDEEPSAYEMLERFGFPRGILPEGVTGYTLRPSDGEFAVYLGTGECEFEVDGGYRLTYQGRITGRVAGGSITGLRGVTVRVFMMNWGIDRVVVADADHLVFYVGPLSQAFPVDGFEESPQCRCRHGGGAAVSGVAAM

SEQ ID NO: 17675 - protein, 97 aa, Glycine max
FGYSRDNVGKFIPIYLAQGILQHDPFEVLDQRGVGELVKLATERGRKARPNLKVGICGEHGGEPSSVAFFAKTGLDYVSCSPFRVPIARLAAAQVLV

SEQ ID NO: 17676 - protein, 298 aa, Candida glabrata CBS 138
MSSELANYKRLEKVGEGTYGVVYKALDLRPGKGQRVVALKKIRLESEDEGVPSTAIREISLLKELKDDNIVRLYDIVHSDAHKLYLVLEFLDLDLKRYMESIPKDQPLGVNIIKKFMVQLCKGIAYCHAHRILHRDLKPQNLLIDKEGNLKLGDFGLARAFGVPLRAYTHEIVTLWYRAPEVLLGGKQYSTGVDTWSIGCIFAEMCNRKPIFSGDSEIDQIFKIFRILGTPSEAVWPDIVYLPDFKPSFPQWRRKDLAEVVPSLDPHGIDLLDKLLAYDPINRISARRAANHPYFHEQ

SEQ ID NO: 17677 - protein, 433 aa, Azospirillum brasilense
  misc_feature (380)..(380): Xaa can be any naturally occurring amino acid
  misc_feature (431)..(433): Xaa can be any naturally occurring amino acid
  unsure (1)..(433): unsure at all Xaa locations
MSDISNVFDLIKEHDVKYVDFRFTDPRGKLHHTVQHVSTIDEDVFEDGIMFDGSSIAGWKAINESDMILQLDPTTAVMDPFSAQPTLNILCDVYEPSTGQPHARCPRGIAKAAEKHMASAGIGDTAYFGPEAEFFVFDDVKFKVEMNKVSYEFDSEEGPYTSDKDYEDGNLGHRPGVKGGYFPVAPVDSGSDLRAEMLSVLAEMGVPVEKHHHEVAASQHELGIKFDTLVRTGDNMQYYKYVVHNVAHAYGKTATFMPKPVFGDNGSGMHMHQSIWKEGQPLFAGNQYADLSELALYYIGGIIKHAKALNAFTNPTTNSYKRLVPGYEAPVLLAYSARNRSASCRIPYVASPKGKRVEVRFPDPSANPYLAFAALLMAGXDGIQNKIHPGEAMDKNLYDLPAEELAKVPTVCGSLREALDSLKADSAFLQXXX

SEQ ID NO: 17678 - protein, 429 aa, Zea mays
MASLFGNGGYIYSSGSEGEDEDEGTEGYRKGGYHAARPGDRFAGGRFVAQRKIGWGNFSTVWLAYDTLHSRFVALKIQKSARDYAHAALHEIELLSAVAKGDPTNSKCVLRLLDHFKHAGPNGQHVCLVTEFLGDSLLRLIRYNRNKGIGLSRVKEICRSVMVGLDYLHSELGIIHTDLKPENVLLESTINPAKDPVRSGFTPILDRPVGNQYGGTVISFSEKMLKMRARRAVAKISQRRVSLGGVGAELEKERCLDGISLKCKIVDFGNACWADQQHAGEIQTRQYRAPEVIIGSGYSYSADIWSFACIAFELATGDLLFAPMNRQGCSEDETARYLDHLALMMETLGKMPRKIASSGTRSKDYFDRYGDLKRVRRLKFWPLDRVLVERYSFSEPDAKGFADFLRPMLDFAPEDRPSAAQCLKHSWLN

SEQ ID NO: 17679 - protein, 495 aa, Thermus thermophilus
MPLITTETGKKMHVLEDGRKLITVIPGDGIGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGPKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 17680 - protein, 324 aa, Vibrio fischeri ES114
MATQFDFCKAGKNVLQIEIDALTQLSNYINDDFTKACQLMLECKQKVVVMGMGKSGHIGNKIAATLASTGTPSFFVHPGEASHGDLGMIEKGDIVIAISNSGEASEILALLPVIKRLGITLITMTGKPESSMAKVADVNLQITVPQEACPLGLAPTSSTTATLAMGDAFAVALLQARGFTADDFALSHPGGALGRKLLLLLSDIMHTGDELPMVTADALIKTALLEVSEKGLGMTAIVDNEQKVIGIFTDGDLRRLLDNKIDIHTQTIGEVMTHSPAVANPNLLAVEGLNLMQDKKINGLLLCDETHRLVGALNMHDLLKAGVM

SEQ ID NO: 17681 - protein, 497 aa, Gossypium hirsutum
MTQQAILLSLRFRPRRKLNFPPGPKPWPVIGNLDLIGSLPHRSIHALSQKYGPLMQLKFGSFPVVVASSVEMAKAFLKTHDVIFAGRPKIAAGEYTTYNYSDITWSPYGPYWRQARKMCMTELFSAKRLESYEYIRREEMKLLLKGLYESSGVPIVLKDRLSDLSLNVISRMVFGKKYTEGTGENEIVTPKEFKEMLDELFLLNGVLDIGDSIPWLRFLDLQGNIKRMKALSKKFDKFLEHVLDEHNARRRDVKDYAAKDMVDVLLQLADDPNLDVKLERHGVKAFSQDLIAGGTESSAVTVEWAISEMLKKPEIFAKATGELDRVIGRERWVEERDTVNLPYIDSIAKETMRLHPVAPMLVPRMTREDCQVDGYDILKGTRALVNVWTIGRDPTVWDNPNEFCPERFIDKTIDVKGHDFQLLPFGAGRRMCPGYPLGIKVIQASLANLLHGFTWKLPGNMTKENLDMEEIFGLSTPKKCPLQAVAVPKLPLHLYSH

SEQ ID NO: 17682 - protein, 449 aa, Francisella tularensis subsp. holarctica
MNAQKYIDSVIAQVEKRDGHEKEFIQAVKEVFSTLKPALEHNPKYIEENILARMVEPERGISFRVPWVDKDGNIQVNRGYRYQFNGAIGPFKGGIRFHPSVYSGIIKFLGFEQVFKNSLTTLPMGGGKGGADFDPKGKTDAEIMNFCQSFMMELQRHIGPDIDVPAGDIGVGGKEIGYMYGQYRRIRACFENGVLTGKSLESGGSLIRPEATGYGAVFFLDEMLKHDGETLQGKTVVTSGYGNVAWGVCKKVAQLGGKVVTISGSKGFVHDPEGITTDEKIEFLLKIRNGEKTMQDYAKEFNASWHAGQKPWGIKADIAIPAATQNEIDFEDAQKLIDSGVKYVVEASNMPTTNEAIEFLMKKGIILAPGKAANAGGVAVSGLEMSQNSARLSWSAEEVESKLQQIMANIFHACKFASSKYNLGYNLVAGANLAGFEKVAEAMIQQGRY

SEQ ID NO: 17683 - protein, 147 aa, Oryza sativa (japonica cultivar-group)
MSSIGAGAGGAVVGAAVAAVAVGGGAPPHVLAVDDSSVDRAVIAGILRSSRFRVTAVDSGKRALELLGSEPNVSMIITDYWMPEMTGYELLKKVKESSKLKKIPVVIMSSENVPTRISRCLEEGAEDFLVKPVRPSDVSRLFSRVLP

SEQ ID NO: 17684 - protein, 389 aa, Francisella tularensis subsp. holarctica
MNKYIIFDNTKLLEYIGKNSLITPCYIYDLELLEDTFLNAKKSLDKNFKNAEIHYAIKANHNPKIVGIAKKYGMGIDCVSGGEIKRALEQKVDSQHIVFARFEIELAIDNDIFAFNSESLEEIQVINQIAQRKNKQVNICLRVNPNIDAQTHHYISTGQFDDKFGIAFVDILNWLKDEYRNFANINIIGLHYHVGSQILNYQVFQSLAITTNEHIKLLRQNDINIKHINFGGGLGIDYQNPQQNPIVDFDGYFARFREFFKYSDELVLHFELGRSLVGQSGVLVSQVLFNKVTQGTHFVIIDAGMTELIRPALYQAQHKIAALIDENINQKQHYHIVGPICESSDVFAKYYQLPKLKRGDLLAIYSAGAYGKVLASEYNLRPSVQEYFI

SEQ ID NO: 17685 - protein, 205 aa, Cryptococcus neoformans var. neoformans JEC21
MTISSRSSLSVTLASVNLLSRFTRNEFNLESKSTIGVEFATRSINVDGKTVKAQIWDTAGQERYRAITSAYYRGAVGALLVYDIAKHQTYENVTRWLKELRDHADANIVIMLVGNKSDLKHLRAVSTDEAKQFATENGLSFIETSALDASNVESAFQNILTDIYRIVSSKSLESSGDVIKPSGGETILVAPTADDGGAKSGSKCC

SEQ ID NO: 17686 - protein, 239 aa, Francisella tularensis subsp. holarctica
MITQTMFNSKFYRFLPVVFLIIGIIEFFSFGGQSYLSLNALKDNYQSIIVFANNHFLLSILVFSCAYIIVVALSIPGATIMTLLGGLLFGLLLGSFVVVVAATVGASVVFFAVKTALGDSLKTKAKGGIEKMRRGFERDVFNYLLLLRLIPIFPFFIINIAAGMFGVKFRDFFWATLLGIIPGSVVYVWVGTSFAYAIQQGDEINLGIILEPQFIVPIVALAILSVVPVFIKKFNKKAY

SEQ ID NO: 17687 - protein, 320 aa, Mycobacterium tuberculosis CDC1551
  misc_feature (61)..(61): Xaa can be any naturally occurring amino acid
  unsure (1)..(320): unsure at all Xaa locations
MPSLDNTADEKPAIDPILLKVLDAVPFRLSIDDGIEAVRQRLRDLPRQPVHPELRVVDLAXDGPAGPIGTRIYWPPTCPDQAEAPVVLYFHGGGFVMGDLDTHDGTCRQHAVGADAIVVSVDYRLAPEHPYPAAIEDAWAATRWVAEHGRQVGADLGRIAVAGDSAGGTIAAVIAQRARDMGGPPIVFQLLWYPSTLWDQSLPSLAENADAPILDVKAIAAFSRWYAGEIDLHNPPAPMAPGRAENLADLPPAYIAVAGYDPLRDDGIRYGELLAAAGVPVEVHNAQTLVHGYVGYAGVVPAATEATNRGLVALRVVLHG

SEQ ID NO: 17688 - protein, 465 aa, Oryza sativa (japonica cultivar-group)
MNSLQSFLALNPPAAAAALGGARLRPSRVTACLATPTPTPPPPTSAPLAPAAAAARRELSAASRAVVEDEARYIVGTYNRSRVVLVAGRGCKLYDADGREYLDMAAGIAVNALGHADPDWVAAVSAQAATLVHASNVQYTVPQVALAKRLVEASFADRVFFANTGTEANEAAIKFARKFQRVARPDGDAPTEFMSFTNCFHGRTMGSLALTSKVQYREPFAPVMPGATFAEYGNLEEAKKVIQSGKIAAVFVEPVQGEGGIHSATKEFLQGLRDACDEAGALLVFDEVQCGLGRTGYLWAYEAYGVLPDIMTLAKPLAGGLPIGVVLVTEKVASAINFGDHGTTFGGGPLVCQAALTTLDKIQKPGFLAEVAKKGENFKQLLSTKLSGNAHVKEIRGIGLIVGIELDVPAGPLVDACLDRGVIVLTAGKGNVVRLVPPLIISEKELEQAAEVIRDCLPALDASTS

SEQ ID NO: 17689 - protein, 312 aa, Arabidopsis thaliana
MATERHHFELAKGINGLDKIVLRESRGRSAEVYLYGSHVTSWKNENGEELLHLSSKAIFKPPKPIRGGIPLCFPQFSNFGTLESHGFARNRIWEVEANPPPLPLNSCSSAFVDLILRPTEDDLKIWPNNFEFRLRIALGTEGELTLTSRIRNTNSDGKPFTFTFAYHTYFSVSDISEVRVEGLETLDYLDNLKDRERFTEQGDAITFESEVDKIYLSTPTKIAILDHEKKRTFVIRKDGLADAVVWNPWDKKSKTISDLGDEDYKHMLCVEAAAIERPITLKPGEEWKGRLELSAVPSSYSSGQLDPKKVLE

SEQ ID NO: 17690 - protein, 395 aa, Candida albicans SC5314
MSNPISQYLASVSLNSVQSTLKYETDAVTNLFNQYQQDEFAINNIIQSITIMYNTIVANNGKIVITGVGKSYKLGLKLVATLNSLSIQSSSLHPTEALHGDLGLIDQNRDCLIMVTSSGNTPELIQLLPHLSSNLPILLLTCSKNSKLSQYNQINSLILAELLSCHKEEIIHGIPAPTVSFTLSMMLADAVILALSELIETDSLKRKKLFGLKHPGGSIGANLAQEFNQNNTNRSGDNTITTTTTTTTNTNTNNNSSITVQAPIIPPSNLMSATTSTTTTRLSSNSSSMLSLKEMELESYSSVDDTDERGQAQKSFKEITYQDLLKLQELSLLQWIVRYDSIRLIETDNKGGSSNSSSSSSNNYVSCDFIQSLYKKHYDGLNWDKFKWELIKKFT

SEQ ID NO: 17691 - protein, 618 aa, Candida albicans SC5314
MSKKYSEENTSSIPLTDLTSPSTGETSSQQQRQRASQQQPPQQPESNTATGSRWSNFVDSFKPAIENEKLAMRYRDANADVEEDAGGYYNSTDQLTEIQRININSSKSNLKRKLKNRHLQMIAIASSIGSGLLIGTGGALATGGPGGILIAWILSGISILCTIQAMAELAVTFPVSGGFNVLFSRFIDPSVGFSVAWNYVLQYLVLLPLELVAASMTIQYWNTDINPDVWVIIFYVTVTSINFFGVRLYGEVEFILSSLKVIAVVGFIILSIVLAAGGAPNGVHHGTKYWHDPGAFANGFKGVSSTFITAAFSFAGTELTGLTSAEAENPRKALPKACKQVFWRILLFYVVSIILITFLVPYDNPRLLGASDVSASPFVIAIQDGGISGLASVMNSVILISVISVGSSSVYATSRTLVSLAEQNLAPKICGYVDRAGRPLVAILITNVFGLLSFIAASGKEDEVFTWLLSISGLSSIFTWLCICISHIRFRRALHVQGRNTDELTFVSQTGVIGSWFGILLNVLVLVAEFWLAIFPLGEKSNAKSFFETYLGFVILIIFYFGHKLWRNNWILFIRSRDIDIDSGRRETDLEALKRELQEEREVLRNKPFWYRAYHFWC

SEQ ID NO: 17692 - protein, 366 aa, Rhodospirillum rubrum ATCC 11170
MAEIRRIGVLTSGGDCAGLNAVIRAVTHRARRAYGWKVFGILDGTMGLMDRPLRYRELDSEMFSGFDILRAGGTVLGTVNKGDPFAFPMADGSKTDRSLDFVDGFHSLELDALVVVGGDGSMRILKKLCDKGSIGMVGVPKTIDNDVHGTEYAVGFSTATNVVTEALDRLQATAASHHRVMILEVMGRDAGHIAVSAGIAGGADVILIPEIPYTLEGVAKRIREVQQEGRSHALIVVAEGVLTPEGERATVAYAGGQTRYGGISQYLSDRIAQDTGTETRVTILGHVQRGGIPSMRDRLLASAFGVHAVDLVAARKFGRMVAWQDRGVVDVPLEEVCIGPRSLDPNGTLVHAARGLGIYVGEIGAA

SEQ ID NO: 17693 - protein, 283 aa, Thermus thermophilus HB8
MILPPIPTPFDREGRLDEEAFRELAQALEPLVDGLLVYGSNGEGVHLTPEERARGLRALRPRKPFLVGLMEETLPQAEGALLEAKAAGAMALLATPPRYYHGSLGAGLLRYYEALAEKMPLFLYHVPQNTKVDLPLEAVEALAPHPNVLGIKDSSGDLSRIAFYQARLQEFRVYTGHAPTFLGALALGAEGGILAAANLAPRAYRALLDHFREGRLAEAQELQKKLFPLGDLLAKGGVPLLKQALRHLGLPAGYPRPPYPAESPLWERFLPVLEGLKEEGWVL

SEQ ID NO: 17694 - protein, 157 aa, Medicago truncatula
MKSVATLLLVLNFCMYVIVIGIGAWAMNRAIDHGFIIGPELNLPAHFSPIFFPMGNASTGFFVTISLLAGVIGAASTISGVKHICSWTAESLPSAASIATLAWTLTLLAMGFAWKEIELQIRNARLKTMEAFIIILSVTQLLYIVAIHGAAAYNIYI

SEQ ID NO: 17695 - protein, 144 aa, Gossypium hirsutum
AVSYLVFVEFGIYWMLRELHDIKPLYKYLHATHHIYNKQNTLSPFAGLAFHPVDGILQAVPHVIALFIIPTHFTTHVGLLFLEAIWTANIHDCIHGKLWPVMGAGYHTIHHTTYRHNYGHYTIWMDWMLGTLRDPSDEEGKKVT

SEQ ID NO: 17696 - protein, 140 aa, Xanthobacter autotrophicus Py2
MAIERTFSIIKPDATRRNLTGAVNAVIETAGLRIVAQKRILMTKAQAETFYAVHSARPFFGDLVSFMTSGPVVVQVLEAENAVAKYREVMGATNPANAAEGTIRKLLAESIEANSAHGSDSVENAAVEIAQFFSGNEIVG

SEQ ID NO: 17697 - protein, 1058 aa, Escherichia coli
MPKRTDIKSILILGAGPIVIGQACEFDYSGAQACKALREEGYRVINVNSNPATIMTDPEMADATYIEPIHWEVVRKIIEKERPDAVLPTMGGQTALNCALELERQGVLEEFGVTMIGATADAIDKAEDRRRFDVAMKKIGLETARSGIAHTMEEALAVAADVGFPCIIRPSFTMGGSGGGIAYNREEFEEICARGLDLSPTKELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGADRIWYIADAFRAGLSVDGVFNLTNIDRWFLVQIEELVRLEEKVAEVGITGLNADFLRQLKRKGFADARLAKLAGVREAEIRKLRDQYDLHPVYKRVDTCAAEFATDTAYMYSTYEEECEANPSTDREKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVERLKLKQPANATVTAIEMAVEKAKEIGYPLVVRAAMEIVYDEADLRRYFQTAVLLDHFLDDAVEVDVDAICDGEMVLIGGIMEHIEQAGVHSGDSACSLPAYTLSQEIQDVMRQQVQKLAFELQVRGLMNVQFAVKNNEVYLIEVNPRAARTVPFVSKATGVPLAKVAARVMAGKSLAEQGVTKEVIPPYYSVKEVVLPFNKFPGVDPLLGPEMRSTGEVMGVGRTFAEAFAKAQLGSNSTMKKHGRALLSVREGDKERVVDLAAKLLKQGFELDATHGTAIVLGEAGINPRLVNKVHEGRPHIQDRIKNGEYTYIINTTSGRRAIEDSRVIRRSALQYKVHYDTTLNGGFATAMALNADATEKVISVQEMHAQIK

SEQ ID NO: 17698 - protein, 469 aa, Triticum aestivum
  misc_feature (117)..(117): Xaa can be any naturally occurring amino acid
  unsure (1)..(469): unsure at all Xaa locations
MASGKHFKYVVLGGGVSGGYAAREFAKQGVQPGELAIISKEAVAPYERPALSKAYLFPRNPARLPGFHVCVGSGGERLLPEWYSEKGGELILSTDTPSRARVSRPLVPAMASLSDLXNKHAPKSRLVRGVVKADLASKTLTSAAGATFTYEILLIATGSSVIKLSDFGTQGADSNNILYLREIDDADNLYAAIQAKKGGKAVVVGGGYIGLELSAVLKMNDLDVTMVFPEPWCMPRLFTAEIAAFYESYYTNKGVKILKGTIAVGFDADANGDVTAVKLKDGSVLEADIVVVGVGGRPLTTLFKGQVAEEKGGIKTDAFFETSVPGVYAVGDVATFPMKIYNDERRVEHVDHSRKSAEQAVKAIKGKEAGSAVEEYDYLPYFYSRSFDLSWQFYGDNVGDAILFGDADPSSAKPKFGSYWVKDGKCVGAFLEGGSPDENAAIAKLARAQPPAASPDELKAAGLQFASKI

SEQ ID NO: 17699 - protein, 412 aa, Bacillus cereus ATCC 10987
MSTLREEALHMHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYEGRPTGMNPVKDEVAKYTNKNRIEGSLADVVQGADVFIGVSAEGALTEEMVRTMNDDAIIFAMANPVPEIMPELAKAAGAAVVGTGRSDFANQVNNVLAFPGIFRGALDVHATQINEEMKMAAVQAIAELVAEDELNADYIIPAPFDARVAPQVAAYVAKAAMETGVARRQVDPNEVAEKTKQLALIGKE

SEQ ID NO: 17700 - protein, 491 aa, Aspergillus oryzae
MSTLEDLDDLDREEREKKPQDGDGNGRKPSGDGDADMKDADKKDDEEDLLDDDILQSSTADIVKRRRMLENEMRIMKSEYQRLTHEQSTMREKVKDNQEKIENNRYGVLGYAGSPIPFFRSWLGRITHGGEGVGQLPYLVGNVVELLDLDVEAEAAEEGANIDLDATRVGKSAVIKTSTRQTIYLPLIGLVDHEKLKPGDLIGVNKDSYLVLDTLPAEYDNRVKAMEVDEKPTEKYTDIGGLDKQIEEIVEAIVWPMKEAERFKKLGIKAPKGALMYGPPGTGKTLLARACAAETNATFLKLAGPQLVQMFIGDGAKLVRDCFALAKEKAPSIIFIDELDAVGTKRFDSEKSGDREVQRTMLELLNQLDGFASDDRIKVLAATNRVDVLDPALLRSGRLDRKIEFPLPNEEARANILQIHSRKMAVDDSVNWAELARSTDEFGGAQLKAVCVEAGMIALRKGMSKVGHENYVDAIAEVQAKKKDTNMGIYV

SEQ ID NO: 17701 - protein, 637 aa, Cryptococcus neoformans var. neoformans JEC21
MSPTAIIDNHKVDLADLKSKVVDGHVELEETPKPPVADNFMYDFKYNHALPTTDALGVSIPDDVDAQNAAEEIVAKLSKVLSEGDAKGFTGLFLEYGVWRDKLAFTWDYRTFNFTENIARAAADLLPSTHCTNFKLLKPAPAIQKPYPDLSFLQFVLSFDTPLVQASAVINAVFTQEGWRLWTVHSVAESLLKFPELDPADGHMTGPVSWEKQREMDDEEIVPDVLIVGGGQNGLALAARLKALGVPNLIVERNAQIGEIWRKRYEYLSLHFPHWADHFPYFPFPKYWPTYTPAQKLGIFMEWYASAMELPVWTKSTVVKAEQDADGKWTVEVNKNGETRVLNPKHVVMATSLCGVPMTPVIPGMDKWKGTARHSTSHDSSREWVGKKVLVVGTSSSGFDTAYDCARRNIDVTLLQRSPTYIMSLTHSVPRNIGSFEPKNGVAPNIEEQDRLFNSMPVGPGEELARRNRAVLEELDKEMLDGLRAKGLKTYKGQRGTGQATLGSTRNGGFYFEAGACEQIIKGKIKVEQGYVESFTEDKVILSGGREREFDLVVFATGFSNTIDSVRQTLGDKIADQCGPIWGVDEEGEMKSAWKECGVPNLWLVIGYLPLTRYHSKLVALRIKALLEGVSPAPYKA

SEQ ID NO: 17702 - protein, 522 aa, Streptococcus agalactiae 2603V/R
MNLQKNDKTNSFIHYANGPSLEEINGTIEVPKDLSFFKTLLAYSGPGALVAVGYMDPGNWSTSITGGQNFQYLLISIILMSSLIAMLLQYMSAKLGIVTQMDLAQAIRARTSKQLGIVLWILTELAIMATDIAEVIGGAIALYLLFHIPLAIAVFITVFDVLLLLLLTKIGFRKIEALVVALILVIFLVFAYQVALSHPIWTDIFKGLVPTSEAFSTSHTVNGQTPLSGALGIIGATVMPHNLYLHSSVVQSRKLDHNNKKDIARAIRFSTFDSNIQLTVAFFVNSLLLIMGVAVFKTGSVTDPSFFGLFKALSNSTIMSNSILAHIASSGILSLLFAIALLASGQNSTITGTLTGQIIMEGFIHMKVPIWFRRIITRLISVIPVMICVLVTSGRSTVEEHIAINNLMNNSQVFLAFALPFSMLPLLIFTNSKVEMDDDFKNTWIIKILGWLSVIGLIYLNMKGLPNQIEGFWGDNPTHQQIILAHQIAHIIIISVILTLIWTIVELYKGNKKYSTMQQSAT

SEQ ID NO: 17703 - protein, 192 aa, Oryza sativa (indica cultivar-group)
MATTSRRSLHALLGGGAVADLVLWRRRNVSAAAVAGATAVWFLFERAGYSFPSVMANALLLLVAILFFWAKSASLLNRPLPPLPKLEVSDVVVEKAADRALVWINKVLAVGHDIAIKRDRSVFIKVILILWVVSYIGMLFNFLTLIYIVPPLYEKYQDQVDEKIGMAHSVLSRHLDTIISKTGESTKQKKTE

SEQ ID NO: 17704 - protein, 498 aa, Glycine max
MATAGLYRRLLPCPPAVEFASSQGKQLFLESIQNGTMEGFYKLVSYFQTQSEPAFCGLASLSMVLNALAIDPGRKWKGPWRWFDESMLDCCEPLETVKARGITFGKLVCLAHCAGAKVEAFHATHSSIDDFRKYVKKCSMSDDCHVISSYHRAALKQTGIGHFSPIGGYHVGRDMALILDVARFKYPPHWIPLKLLWEGMNYIDEDTGQSRGFMLVSRPHREPGLLYTLSCKHESWINIAKFLMDDVPLLLKSEDVKDILQVVSIIAASLPSNFEEFIKWIAEIRRREDGGPSLSAEEKARLAIKEEVLKQVQETGLFKHVASFLSSSCSRQQVSGDGDTLPIIAASVCCQGAEILGGKPSSAGYCCRETCLKCLKAEDDKPITMVSGTVVNGNSEQGVDVLIPSSSEKLCCICSKSKYIRVHPASTDVLTVLLLSLPSTTWAGITDEQLLAEIHDLVSIENLPTLLQEEVLHLRRQLHLLKRCQEGKVDEDLGAPLS

SEQ ID NO: 17705 - protein, 257 aa, Idiomarina baltica OS145
MDPWLLAFFVSGASGLMTALGSSVVLIGWQPSQRHTNILLGFAAGVMLAAAFFSLIVPALEIASNLYGDGIIPPLMAVTGILAGALLIALIDKTVPHEHFIKGTEGPVNSRLSRLWLFIIAITIHNIPEGLAVGITAAGEDWDATIAIASGIGLQNVPEGLAVSLALLALNYSRFKAFLIGALTGLVEPIGGLLGGIFVGLTEWLLPWGLLLSAGAMIYVISHEIIPETHREGEHSKASGGLMVGLVIMLFLDVWLG

SEQ ID NO: 17706 - protein, 610 aa, Thermus thermophilus HB8
MVRMDLSRIRNFSIIAHVDHGKSTLADRILELTHAVSDREMREQFLDSLELERERGITIKASAVRVTYRAKDGEEYVFHLIDTPGHVDFTYEVSRALAAVEGVLLVVDASQGVEAETLAKFYMALEHGHVIIPVINKIDLPNARPLEVALEVEEVLGLPADEAIFASGKTGEGVEEILEAIVQRIPPPKGDPEAPLKALIFDSVYDAYQGVIPYLRLFEGRVRPGDRIRIYSTGKEFTVDKVGVFTPQGLVATEALEAGEVGWLVAAIRDIHDVQVGDTITLADRPTPSPYPGFRPAKPVVFAGLYPVDSGDYGKLRDALEKLKLNDAALTFEPESSTALGFGFRCGFLGLLHAEIVQERLEREFGLSLIATAPSVVYKVRLKSGEEVEVHNPADLPDPTRIEEILEPYVKLTIFTPEEYVGSLMQLLQEKRGRLVNMNYLPGAQKRVELVYEAPFAEILYDFHDRLKSVSRGYASMDYEQAGYRPGDLVKVNVLVHGEVVDALTFIAHREKAYTMARAIVDKLAEVIPRQLFEVPIQAAIGGKIIARATVKALRKDVLAKCYGGDVTRKKKLLEKQKEGKKRLKAIGKVEVPQEAFLAVLSAGRDEPKG

SEQ ID NO: 17707 - protein, 557 aa, Shewanella sp. ANA-3
MDQPWINHLPKDVPAEINADQYSSLVDMFETAVAKYADQPAFINMGATLTYRKLEERSRAFAAYLQNELKLQKGDRVALMMPNLLQYPIALFGILRAGMVVVNVNPLYTPRELKHQLVDSGAKAIVVVSNFARTLEEVVDQTPVKSVIITGLGDLLSAPKRTLVNFVVKYIKKLVPKYDLPHALSMRETLSRGRRMQYVKPVITGDDLAFLQYTGGTTGVSKGAMLTHKNVVANVLQANGAYSPALRDGNEFVVTALPLYHIFALTVNCLLFLHKGSQNLLITNPRDIPGFVAELKKYPFTALTGVNTLFNALVNSSDFAELDFSRLKLSIGGGMAVQKAVADKWQSITKTRLLEGYGLTEASPLLTCCPYNLDGYNGSIGFPAPSTLIQVRDDAGNVLPQGETGELFGKGPQIMKGYWQRPEETAKVIDKDGWLATGDIGYMDEQGFFYIVDRKKDMILVSGFNVFPNEVEEVVALHPKVIEVAAVGVPNDASGELVKVFVVAKDKSLTADDIIKHCRAHLTGYKVPKLVEFRDELPKTNVGKILRRELRDEVKRA

SEQ ID NO: 17708 - protein, 264 aa, Triticum aestivum
  misc_feature (106)..(106): Xaa can be any naturally occurring amino acid
  unsure (1)..(264): unsure at all Xaa locations
MGRRRAGGGGRGGGRGRGRGGEGRGGGEEEDLQLHKAARSGDAAAAESLCESNPLALNSRDRLSRTPLHLAAWAGHVDVVKCLCKHKADVGAAAMDDTAAIHFASXQKGHLEVVRELLASGASVKAKNRKGFTALHFAAQNSHLDLVKYLVRRGVDITTKTNAGQTALHVAENDDVRAFLKECEQSLKKGVELPSEKTDDSVAEKADDGKGSGEDRKDGVDAGQGEKRKSEEIGAGTRPPEVKKAKVSLSHLENDMEEEDEADE

SEQ ID NO: 17709 - protein, 377 aa, Medicago truncatula
MASSSTPQVITCKAAVAWGAGEALVMEEVEVSPPQPLEIRIKVVSTSLCRSDLSAWETHAIFPRIFGHEASGIVESVGLGVTEFKEGDQVLTVFIGECMSCKLCKSGKTNICQVLGLERKGLMHSDQKTRFTVKGKPVYHYCGVSSFSEYTVVHSGCAVKVSPHVPLEKICILSCGVSAGLGAAWNVADVSKGSTVVIFGLGTVGLSVAQGAKLRGASRIIGVDNNPQKCENAKSFGITEVVDPSLYKEPIAQVIKRITDGGADFCFECAGDTDMITTALQSCCDGWGLTVTLGVPKVKPEMSAHYGLFLTGRTLKGSLFGGWKPKTDLPSLVEKYVNKEIQIDDYITHNLSFDEINKAFNLMKEGKCLRCVIHMSR

SEQ ID NO: 17710 - protein, 354 aa, Gossypium hirsutum
MVTSVLPRVESLASSGIQSIPKEYIRPQEELTSIGNVFEEEKKEEGPQVPTIDLTEIESEDKEVRERCQQELKKAAMEWGVMHLVNHGISEELMDRVRKVGQKFFELPVEEKEKYANDQSSGNVQGYGSKLANNASGQLEWEDYFFHLIFPEDKRDLSIWPKIPSEYTEVTSEYARQLRGLASKILSALSICLGLEEGRLEKEVGGVEELLLQLKINYYPKCPQPELALGVEAHTDISALTFILHNMVPGLQLFYQGKWVTAKCVPNSIIMHIGDTIEILSNGKFKSILHRGLVNKEKVRISWAVFCEPPKDKIILKPLPETVSETEPPLFPPRTFAQHIEHKLFRKTQDNLSN

SEQ ID NO: 17711 - protein, 206 aa, Triticum aestivum
  misc_feature (108)..(108): Xaa can be any naturally occurring amino acid
  misc_feature (175)..(175): Xaa can be any naturally occurring amino acid
  unsure (1)..(206): unsure at all Xaa locations
MQRAIQAIGSHGSVLKSAVLQHISVVKPAMLPAVFPRFMSVSPAQIEESGFESSTVADILKSKGKSADGSWLWCTTDDSVYDAVKSMTQHNVGALVVVKPGEDKSIAXGIVTERDYLRKIIVQGRSSKSTKVGDIMTEENKLITVKPETRVLKAMQLMTDKRIRHIPVISGTEMXGMVSIGDVVRAVVSEHKEELNRLNAYIRGGY

SEQ ID NO: 17712 - protein, 588 aa, Zea mays
  misc_feature (560)..(560): Xaa can be any naturally occurring amino acid
  misc_feature (572)..(572): Xaa can be any naturally occurring amino acid
  unsure (1)..(588): unsure at all Xaa locations
MCGILAVLGCSDCSQARRARILACSRRLKHRGPDWSGLYQHEGNFLAQQRLAIVSPLSGDQPLFNEDRTVVVVANGEIYNHKNVRKQFTGAHSFSTGSDCEVIIPLYEKYGENFVDMLDGVFAFVLYDTRDRTYVAARDAIGVNPLYIGWGSDGSVWMSSEMKALNEDCVRFEIFPPGHLYSSAAGAGFRRWYTPHWFQEQVPRTPYQPLVLREAFEKAVIKRLMTDVPFGVLLSGGLDSSLVASVTKRHLVKTDAAEKFGTELHSFVVGLEGSPDLKAAREVADYLGTTHHEFHFTVQDGIDAIEEVIYHDETYDVTTIRASTPMFLMARKIKSLGVKMVLSGEGSDELLGGYLYFHFAPNREELHRETCRKVKALHQYDCLRANKATSAWGLEVRVPFLDKEFVDVAMGMDPEWKMYDKNLGRIEKWVLRKAFDDEEHPYLPEHILYRQKEQFSDGVGYNWIDGLKAFTEQQVTDEMMNSAAQMFPYNTPVNKEAYYYRMIFERLFPQDSARETVPWGPSIACSTPAAIEWVEQWKASNDPSGRFISSHDSAATDRTXTSWRWSTATGTXANGTVNGNDVAVAIAV

SEQ ID NO: 17713 - protein, 254 aa, Triticum aestivum
  misc_feature (202)..(202): Xaa can be any naturally occurring amino acid
  unsure (1)..(254): unsure at all Xaa locations
MHPTRWELSHMVDLQAAALVISVVAAEVVVSTQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASVGIYVISKHVMLQLLREQFPGANDFGSEVIPGATSTGMRVQAYLYDGYXEDIGTIEAFYNANLGITKKPIPDFSFYDRSAPIYTQTRHLPPSKGSGAVSLI

SEQ ID NO: 17714 - protein, 323 aa, Physcomitrella patens
RYDRCWHGRKDSPLDIVVINDTGGVKQASHLLKYDSMLGTFDAYVKVEGNDAISVDGKVIKVVSDRNPLNLPWGDMDIDLVIEGTGVFVDEAGAGKHIQAGAKKVLITAPGKGPIPTYVVGVNEQDYKHSDTIISNASCTTNCLAPFVKVLDEKFGIIKGTMTTTHSYTGDQRLLDASHRDLRRARAAALNIVPTSTGAAKAVALVLPNLKGKINGIALRVPTPNVSVVDLVVQVEKKTSAEEVNQAFRDACNTDQLKGVLAVCDEPLVSVDFRCTDVSSTVDSSLTMVMGEDMVKVVAWYDNEWGYSQRVVDLANLVAEKWQ

SEQ ID NO: 17715 - protein, 362 aa, Glycine max
MAAPASNAVLLGDVHFDDVAAKPCGVHFRGETRRGALRATVNLRKPKTLSGILNFGCSTSDASWRSWNPSSLHRNSSFACCSAETTPHVQHLATSTFSIDQTNFGGERLKLFSGSCYLPHPDKEDTGGEDAHFICTDEQAIGVADGVGGWADVGVNAGLFARELMSHSVRAIEEEPKNSINPARVLEKAHSCTKAKGSSTACIITLTDTGLHAINLGDSGFIVVRDGCTIFRSPVQQHGFNFTYQLESGNGGDLPSSGEVFTIPVAPGDVVVAGTDGLFDNLYNDEVTEVVLHSVRAGLEPQVTAQKIAVLARQRALDRNRPTPFSTAAQEAGFRYYGGKLDDITVVVSYITGSTCVSFSPS

SEQ ID NO: 17716 - protein, 794 aa, Streptomyces coelicolor A3(2)
MAELPTSHLAAAVLTDGNRALVAVIAVVALAALVLAGVLVRQVLAAGEGTDSMKKIAAAVQEGANAYLARQLRTLGVFAVVVFFLLMLLPADDWNQRAGRSIFFLIGAAFSAATGYIGMWLAVRSNVRVAAAAREATPAPGEPEKDLALVSHKATKIAFRTGGVVGMFTVGLGLLGACCVVLVYAADAPKVLEGFGLGAALIAMFMRVGGGIFTKAADVGADLVGKVEQGIPEDDPRNAATIADNVGDNVGDCAGMAADLFESYAVTLVAALILGKVAFGDFGLAFPLLVPAIGVLTAMIGIFAVAPRRSDRSGMSAINRGFFISAVISLVLVAVAVFVYLPGKYADLDGVTDAAIAGKSGDPRILALVAVAIGIVLAALIQQLTGYFTETTRRPVKDIGKSSLTGPATVVLAGISLGLESAVYTALLIGLGVYGAFLLGGTSIMLALFAVALAGTGLLTTVGVIVAMDTFGPVSDNAQGIAEMSGDVEGAGAQVLTDLDAVGNTTKAITKGIAIATAVLAAAALFGSYRDAITTGAADVGEKLSGEGAPMTLMMDISQPNNLVGLIAGAAVVFLFSGLAINAVSRSAGAVVYEVRRQFRERPGIMDYSEKPEYGKVVDICTRDALRELATPGLLAVMAPIFIGFTLGVGALGAFLAGAIGAGTLMAVFLANSGGSWDNAKKLVEDGHHGGKGSEAHAATVIGDTVGDPFKDTAGPAINPLLKVMNLVALLIAPAVIKFSYGADKSVVVRVLIAVVAFAVIAAAVYVSKRRGIAMGDEDDADPEPKSADPAVVS

SEQ ID NO: 17717 - protein, 208 aa, Synechococcus sp. CC9311
MESILKFAQTISGIYDNFAQSQENPKDFARINIIFRPLPWKIFNGPGFYSEQHYDYAPWSPYRQGIHRLINHRELSNTFIMENFGCANPMRIAGAGRTPELLDSLKKENLKKRCGCAMHFETKADRKYIGSVEPGKKCMIPRDGQLTYLVSEVEVTQDSWTSRDRGYDPDTNKQIWGSEHGQLIFKKVEDIGEIITNDWINKQFNHER

SEQ ID NO: 17718 - protein, 279 aa, Shewanella sp. ANA-3
MKLETIDYRAADSAKRFVESLRETGFGVLSNHPIDKELVESIYAEWQAFFNSDAKNEFMFNRETHDGFFPASISETAKGHTVKDIKEYYHVYTWGRIPDSLRANILAYYEKANALASELLEWIETYSPDEVKAKFSIPLPEMIADSHKTLLRILHYPPMTGDEEMGAIRAAAHEDINLITVLPAANEPGLQVKAKDGSWLDVPSDFGNIIINIGDMLQEASGGYFPSTSHRVINPEGTDKTKSRISLPLFLHPNPSVVLSERYTADSYLMERLRELGVL

SEQ ID NO: 17719 - protein, 130 aa, Daucus carota
MVRVSVLNDALKSMFNAEKRGKRQVMIRPSSKVVIKFLMVMQKHGYIGEFEYVDDHRSGKIVVELNGRLNKCGVISPRFDVGVKEIEPWTARLLPSRQFGYIVLTTSAGIMDHEEARRKNVGGKVLGFFY

SEQ ID NO: 17720 - protein, 456 aa, Campylobacter jejuni subsp. jejuni NCTC 11168
MKAIIDNIKILEQNAINKGLDELILMENAGLNLAKLIKKEAKKIRIQRKIRKVKILFLLGGGNNASDGLVALRNLKHAKAYKIGFKENTLFKKQEQILQNYAFKFCKKEPNFKKFHIIIDCILGTGSNRCLDEKTSLIIQKVNQSKALKIACDIPTNLGFYPCFKADITFCMGALKEILLEDFAKEFVGRIKIANLGIRSKKFYPNSQAFLLEKKDLKTIDRKINANKGNFGHIYIVANASAGTLAGLGALNFGAGLVSLVAQKSFSPLLMLKEKIENNASAIALGMGLENLDFLKDEILQNTPLILDANCFLSEALLWYLNRKDVVITPHPKEFIKLYKMCFDENLDIETLQKNRFFYARKFSQNYDCVLVLKGANPIIVQKEKLFVVNLGNQALAKGGSGDVLSGMIAAHLGFGFSALEAAKNATLAHGLVAKKYKFNKNSFDALKLIKGLKCL

SEQ ID NO: 17721 - protein, 281 aa, Synechococcus sp. CC9311
MIQTHGCEVLPVIGNPDAYAEGCRYLDRDLNRSFRPDLLQQVGAEQIPSSKLDREVQRAFDLVSRYGIGGIDACGVVIDLHSTTSSMGNSLVVYGRRPADLALAALVQGRLGLPIYLHEADQAQQGFLVESWPCGLVIEVGPVPQMVRHHKILTQTRLALEAVLEACSDALAGRARYPRQLVVHRHLGSLDLPRSQSGSPDAFLHPLRQGSDWQPLRDGDPLFLKADGSCIAYEGADGLVPLFINEAAYAEKSIALSLTLRECWPLSLEWTEAFQAQLSAG

SEQ ID NO: 17722 - protein, 421 aa, Thermus thermophilus HB8
MRFETLQLHAGYEPEPTTLSRQVPIYPTTSYVFKSPEHAANLFALKEFGNIYSRIMNPTVDVLEKRLAALEGGKAALATASGHAAQFLALTTLAQAGDNIVSTPNLYGGTFNQFKVTLKRLGIEVRFTSREERPEEFLALTDEKTRAWWVESIGNPALNIPDLEALAQAAREKGVALIVDNTFGMGGYLLRPLAWGAALVTHSLTKWVGGHGAVIAGAIVDGGNFPWEGGRYPLLTEPQPGYHGLRLTEAFGELAFIVKARVDGLRDQGQALGPFEAWVVLLGMETLSLRAERHVENTLHLAHWLLEQPQVAWVNYPGLPHHPHHDRAQKYFKGKPGAVLTFGLKGGYEAAKRFISRLKLISHLANVGDTRTLAIHPASTTHSQLSPEEQAQAGVSPEMVRLSVGLEHVEDLKAELKEALA

SEQ ID NO: 17723 - protein, 388 aa, Gossypium hirsutum
MVHCLPKVFVIQDKPILPSTAAVAKDEYWPPLAFDASILGSESNIPSQFIWPDDEKPCLDAPELVIPTIDLGAFLLRYSLAVSKAAEVVNEACKKHGFFLVVNHGVDSGLIDKAHQYMDRFFSLQLSEKQKAKRKVGESYGYASSFVGRFSSKLPWKETLSFRYCPRTQNIVQHYMVNLMGEDFRDFGRLYQEYCEAMNKVSQEIMGLLGISLGLDQAYFKDFFEQNDSILRLNHYPPCQKPELTLGTGPHTDPTSLTILHQDQVGGLQVFADEKWHSVAPYPGAFVVNVGDTFMALTKAFYKSCLHRAVVNTETVRKSLRFFLCPKLERPVTPAAGLVTAENPRKYPDFTWAALLKFTQNHYRADMKTLVAFSKWVQEQESNYKLIP

SEQ ID NO: 17724 - protein, 294 aa, Oryza sativa (japonica cultivar-group)
MATSLDMSLDDMIKNNRNSRGRGRGRSQGGGRGRGDGQRFSYGSGRGRGAGTFRGRGVGVPSRRPLGVSTRSSSYAIAKSFNKTKDIVWRQDLFEDSMVAAGLSVTESSTKLYISNLHYGVTKEDIQELFSEMGHLKHCAVHYDNNRRPTGSAEVIFTRRSEAVAALKRYNNVRLDGKPMKIEVIGADLGMAAPSAPRVSVVPGARGRGQREVVMMPGGSGFGRGAAGSSNFIPGWKRNNFAQRGGQGRGRGRGRNNFGRGRGRGYVRKGPVEKSAEQLDKELDSYHSGAMNVD

SEQ ID NO: 17725 - protein, 417 aa, Penicillium citrinum
MSLSNKLPVTDVDLKGKRVLIRVDFNVPLDENKNVTNPQRIVGALPTIKYAIDNGAKAVVLMSHLGRPDGKVNPKYSLKPVVPVLEKLLGKSVTFAEDCVGPQTEETVNKASDGQVILLENLRFHAEEEGSSKDAEGKKVKADKADVDAFRKGLTALGDVYVNDAFGTAHRAHSSMVGVDLPQKAAGFLVKKELEYFAKALESPARPFLAILGGAKVSDKIQLIDNLLPKVNSLIITGGMAFTFKKTLENVKIGNSLFDEAGSKIVGEIVEKAKKYNVEIVLPVDYVTADKFSADATVGAATDATGIPDGYMGLDVGPESVKLYQKTIAEAKTILWNGPPGVFELKPFASATEATLDAAVKAAESGSIVIIGGGDTATVAAKYKVEDKISHVSTGGGASLELLEGKELPGVAALSSK

SEQ ID NO: 17726 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQKGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKQSYYWYRNVVSNNWLETRR

SEQ ID NO: 17727 - protein, 622 aa, Pseudomonas fluorescens PfO-1
MSFASLGLSEALVRAIEDAGYTEPTPVQQRAIPAVLQGRDLMVAAQTGTGKTGGFALPILERLFPNGHPDKSQRHGPRQPRVLVLTPTRELAAQVHDSFKIYARDLKFVSACIFGGVGMNPQVQAMSRGVDVLVACPGRLLDLCGQGSVDLSHVEILVLDEADRMLDMGFVHDVKKVLARLPAKRQNLLFSATFSKDITDLAGKLLHNPERIEVTPPNTTVERIEQRVFRLPASHKRALLAHLITAGAWEQVLVFTRTKHGANRLAEYLDKHGLPAVAIHGNKSQNARTKALADFKAGEVRILVATDIAARGLDIDQLPHVVNFELPNVDEDYVHRIGRTGRAGRSGEAISLVAPDEEKLLKSIERMTKQKIADGDLMGFDASTIEAEKPEVRERPDMRNPRNARGPRGDGPNGGGGGGGRKDKGKDKGKEKPAGERGERPARQQKPREGTPAREQRQPSQPPRAAADRAPDEFLDDDIDNFGNRVDYVPKQAPTGGRNRRPGAPAQGAGSGAPRGGQSQGRQNGPRNSNGSSTGTPPGKRSGPRNGAPRDGQGRRDENSRNRRPARDDQQRAEPAVQNPRSSGPKIMHKESKADRFPTPEQLDQLPSRPRGEKPALLTRNR

SEQ ID NO: 17728 - protein, 226 aa, Aspergillus oryzae
MASSKSVARLVTYRRPAPSLLTSSFRPLGSTANFSSSVCRAATPAGPPPSGFRLAPPKKWDETTESSLDKASKYFLMSEIFRGMYVVLEQFFRPPYTIFYPFEKGPISPRFRGEHALRRYPTGEERCIACKLCEAICPAQAITIEAEEREDGSRRTTRYDIDMTKCIYCGYCQESCPVDAIVETANAEYATETREELLYNKEKLLANGDKWEPEIAAAARADAPYR

SEQ ID NO: 17729 - protein, 471 aa, Mycobacterium tuberculosis CDC1551
MRFRRMARPRPLTRAAVELLNAANGLRPLSGSGYSTVLAFWLGWPTSEVPGVYLGASVLDALRRGRRGDFGGLKGKAALALTAAAWVILAVIRYRGATTPGPVLEAGLTEQLGPDYAKELATLPTEPMRSRGRNLPLRTAMARRRYVETTNVVCYGPYGRANLADIWRRRDLPRDAKAPVLVQVPGGAWVLGWRRPQAYPLMSHLRARGWVCVSLNYRVSPRHTWPDHIVDVKRALAWVKENIAAYGGDPNFVAISGGSAGGHLCALGGVDPQRSAISARVRTGRHLGGGSGSGIRALRLVYDRCAGASGIRRVARNVRGETEIQHAPRHLRRCLTDPPCAGRRPTVLRSARPPRLPDPRGRSPCVRRGTAGGVEVARRLRGPAPRPTRLRRLRLPAGASHRRGRGPLPVLGVRDQPAGHVVSYRPAIAIPRHAPARPVPVRWHRPSRRCRWPPRVWSPGRNPDNPGRRSR

SEQ ID NO: 17730 - protein, 468 aa, Pseudomonas fluorescens PfO-1
MGLNNQWMQRDLAVLWHPCTQMKDHEQLPLIPIKRGEGVWLEDFEGKRYLDAVSSWWVNVFGHANPRINQRIKDQVDQLEHVILAGFSHQPVIELSERLVKMTPEGLNRVFYADNGSSCIEVALKMSFHYWLNRGQPNKKRFVTLTNSYHGETMAAMAVGDVPLFTETYKALLMDTIKVPSPDCYLRPQGMSWEEHSRNMFAAMEQTLAENHDSVAAVIVEPLIQGAGGMRMYHPVYLKLLREACDRYGVHLIHDEIAVGFGRTGTMFACEQAGIRPDFLCLSKALTGGYLPLAACLTTDEVYSAFYDDYPTLRAFLHSHSYTGNPLACAAALATLDIFEQDNVIENNRALAQRMASATAHLVDHANVSEVRQTGMVLAIEMVKDKATKEAYPWQERRGLKVFQHALERGALLRPLGSVVYFLPPYVITPEQIDFLAEVASEGIDIATRDSVSVAVPKDFHPGFRDPG

SEQ ID NO: 17731 - protein, 417 aa, Brassica napus
MAATAATTSSSHLLLSSSRHVAASSQPQILFQRSLFSGGKRSAAGKNHHASGGVRCMAVAADASAEAKPAAARKKSGYELQTLTGWLLRQEQKGEIDTELTIVMSSIAMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYSPNDECIVDDSDDISSLGSEEQRCIVNVCQPGNNLLAAGYCMYSSSVIFVLTLGKGVFSFTLDPMYGEFVLTQENIEIPKAGKIYSFNEGNYQMWDEKLKKYIDDLKDPGPSGKPYSARYIGSLVGDFHRTLLYGGIYGYPRDAKSKNGKLRLLYECAPMSFIVEQAGGKGSDGHQRVLDIQPTEIHQRVPLYIGSKEEVEKLEKYLA

SEQ ID NO: 17732 - protein, 314 aa, Arabidopsis thaliana
MYLLVFKLFLFLSLLQISVSARNLASQEPNQFQLLKYHKGALLSGKISVNLIWYGKFKPSQRAIISDFITSLTHTSPTSKTLHQPSVATWWKTTEKYYKLATPSKNSSPLSLTLGKQIIDESCSLGKSLTDKKIQTLASKGDQRNAINVVLTSADVTVTGFGMSRCGTHGHARGLGKRGSKFAYIWVGNSETQCPGQCAWPFHAPVYGPQSPPLVAPNNDVGLDGMVINLASLLAGTATNPFGNGYYQGPQNAPLEAASACPGVYGKGAYPGYAGDLLVDTTTGGSFNAYGANGRKFLLPALYDPTTSACSTMV

SEQ ID NO: 17733 - protein, 403 aa, Mycobacterium avium subsp. paratuberculosis K-10
MKRVSELLESIQSRAEQGAITDAEIFAAHVGGKLSVSLTSPLDTQRALSIAYTPGVAQVSRAIAADHRQAAHYTWANRLVAVVSDGSAVLGLGDIGPAASLPVMEGKCALFQAYGGLNAIPIVLDTKDPDEIVETLVRLRPTFGAVNLEDISAPRCFEIERRLIEALDCPVMHDDQHGTAIVVLAALMGASKLLGRDMSSLKVVVSGAGAAGVACTNLLMAMGVSDITVLDSRGILHAGRDDMNDVKAALSRRTNPAGLTGSLAEAIRGADVFLGLSGGVVPEEMIAAMAPNGIVFALSNPDPEIHPQIAAKYATVVATGRSDFPNQINNVLAFPGVFRGALEAGARRITEKMMVAAAEAIFSVVSDDLAPDRIVPSPLDTRVGDAVATAVALATEVSDAPAG

SEQ ID NO: 17734 - protein, 1315 aa, Magnaporthe grisea 70-15
MRFVTVAAATLPSVPLDFEGNRDRILESIKLAKEKGATLRTGPELEIPGYGCLDHHLEGDTELHSWEVLAEIISDPVCKDMLVDLGLGVKTRNVQYNCRVLCTYKKIYAIRAKQALAGDGLYREPRHFTAWVKERQVETHKLHKVVRDVTGQTTVPIGDFILETPDTSVTCETCEELFVPRNPSIFSGLNGAEIILNSSASHAELRKLGTRLNLISNSTRSNGGLYVYANASGIDGEARMLFDGSSMIIQNGEVLAQSSQFSLLPVEVTVATVDLERVRSYRTSASRNVQAARQPEYPRIDCDIELARPSEEIFRSNKVIAMEIPIRILDPMEEIHMATSVYLWQYLVRSSGAGFFLALSGGLDSSSVALFVYGMAKLVLLSIKNGEENTLNDLRKVTGINDYVPESPEEIVGKLLHTCFMGTVNSSDETRSRAKRLAERLGAYHTDINIDNAVQAHESIIESALGGFKPKYAVEGGTNSENLAKQNIQARNRLVVSYELAQLSTQARGLPRAGASLLVLGSGNVDENLRGYYTKYDASSADLAPLGSISKNDAKDFQRWARDNWDLSIMSEFIDAIPSAELLPLSAGVQADEVEMGLTYSELSDFGILRKVDKLGPWSAYLRLLSQWKERPGFGPREIAEKVFLFFRFYAINRHKATIITPSVHLSAYNPDDNRHDDNNREKKSIASIWQSQAFSATGDLPTLLLAGAKLPKINPSLRRKCDSRLDSNGKRRCPSGVTPNFQPQPAHLQVLTPSTSNRLEIDATSRAHFIGWLCGSLLATAVSATNFANCYHLAFEEFRNGTHPMRDSFFWKEKDPLIGLKNQSARPEIVLTRAGCEHFCSIYPQYNNVIDAFQILTTWVLPAIALMSQLPYESLSVRWRKNLAAFGNWVGAPAAAMTTTFWNIVLIHECSVKFGLFRLPETREEIRDALFILSCVNQYEYPRREQVGRDLRRDSALLKGILYPYFKDGISERQRRTLANFNQHLAFQLRLQRRKGVYPIFISIGWFGMAFAFSIVISFAALGDNTTAHSLALGLLLSWVPVMLFATVIDRNPTSATRCSELIQRWLFNIDRLLPATDLSSLPPKFWQAHHGGQKHADTTEEFDIGEYMGQGRTLRYCGVADTVLDMIKNPSEATLDVPDLSVGKKHAKFSDRSDEATVGMGGGVAHQPGHCDHQLRHGLHGVVQHANAGSGLSLAALPLLVAPGSALVADPGSLSGAQHQMQSFGGLNSCLCKTSVFGLPPFGRYMDFENAEFYKEYYYVEAFWGSATGIGGATMAISVSWLAWKWHKSSALWRVTEDTTVRVEDDVSLDWLT

SEQ ID NO: 17735 - protein, 880 aa, Magnaporthe grisea 70-15
MPRRAASPAASEHEIDILGSIFANDNDTEVKAKAKKRTGGHDEIDLDIDALLNGAEDGGDGDDEALIALQQAASFRKTTNLKGKTGKKSGGFQAMGLNPSLLQAITRKGFAVPTPIQRKSIPLILDRRDVVGMARTGSGKTAAFVIPMIERLRAHSARVGARALIMSPSRELALQTLKVVKEFGKGTDLKTVLLVGGDSLEDQFGFMTTNPDIIIATPGRFLHLKVEMSLDLSSIKYVVFDEADRLFEMGFATQLTEILHSLPPSRQTLLFSATLPRSLVEFARAGLQDPSLDVIKMPTGTPEGFKEDKDEGSKKRKRGPDRPNAKEKPTEHSTIIFTATKFHVEYLTSILVQAGYAVSHAYGALDQTARKIQVEDFRRGKTNILVVTDVAARGIDIPVLANVINYDFCDQPKVFVHRVGRTARAGQKGWSYSLVSDIDAPYLLDLQLFLGRRLVVGQDTSAGANFASDVVLGALQRNSIETNVEWVEKVVQESHDIALMRSVVVKAQKQYLRTRVSASSQSAKRARELTASRAWSQPHLIFGINTDDTEALRVEMLAKISGFKPQETVFEIGHGGKGTISEAVEVMKQLRKRAPVRKSKTDKDADDEDEDVPVIKRAKSDESSDEDASFDEDDFVAVNDDSDEELEVTVSNNADSAKNASAWRDSEHFMTYTPRQSNVAEERGYGVNAGSNGANFLEAARDVAMDIANDEKSTSFGAPTRTTMRWDKKNAKYVSRAHDEDGSRGNTKMIRGESGVKIAASFKSGRFDRWRKDNRLGKLPGVGEAETGLPRGMGGGGFGGGGRRFNHKREDAPKEADKFRDDYHVRKKRVAEAKEKRIGKFRDGEGSKREIKNNDDIRKARKIKELKMRKNARPARKKKN

SEQ ID NO: 17736 - protein, 229 aa, Zea mays
  misc_feature (79)..(79): Xaa can be any naturally occurring amino acid
  misc_feature (88)..(88): Xaa can be any naturally occurring amino acid
  misc_feature (120)..(120): Xaa can be any naturally occurring amino acid
  misc_feature (127)..(127): Xaa can be any naturally occurring amino acid
  misc_feature (176)..(176): Xaa can be any naturally occurring amino acid
  misc_feature (190)..(190): Xaa can be any naturally occurring amino acid
  misc_feature (216)..(216): Xaa can be any naturally occurring amino acid
  unsure (1)..(229): unsure at all Xaa locations
IGTLEAGRDPLASSQHGPLYASTSLDSFLVHRLATASSPAQGRTTWREILARQEAQELHARQTGESCQQRQPIDHHLRXTYMNAAIPXRVYQDTSKTNIWHNISYYMWNAGVETSINTLXMTEMRQXDLRITLKNFCQRSGTINYPSERAPLSARFAGQCTLSEDTHAGPHQGLGXTLCEDIWPAHAITXEAEDHLPLRRRTTTYDIDLTSCLYCXGLCQHACPVSSYC

SEQ ID NO: 17737 - protein, 132 aa, Brassica napus
TDEFDKMRPEDRVAIHEAMEQQTISIAKAGITTVLNSRTSVLAAANPPSGRYDDLKTAQDNIDLQTTILSRFDLIFIVKDIRKYSQDKEIASHIIRVHASADKVTDENTDSKEDNWLKRYIQYCRSRCHPRL

SEQ ID NO: 17738 - protein, 480 aa, Synechococcus sp. CC9311
MLEINKIFDKFQLFYVDGEWEVSSSKERLSVINPATEESIGKIALAGDADVEKVVAAATIAFKSFGHSSVEERIDLLQNILKIYEQRVDEFASAISMEMGAPIDFARSAQAQAGIDHLSALIDDVKEYKFERKLRNGDTIVMEPIGVCGLITPWNWPINQIVLKVAPALAAGCTMVLKPSELTPLSAILFAEVMHEAGVPKGVFNMIHGLGNVAGSALSKHPNVAMISFTGSTGAGRSIIRNSAERIAKTTLELGGKSPNLVFADCELSTAIDQGIDACFINSGQSCDAATRMLVERSVYEKSIELAHDKCERISVGDPTKSGNHLGPLVSQIQFDRVQSLIACGLEEGARCISGGLGKPQECQVGYFARPTVFADVKNTMKIAREEIFGPVLCMIPFDSEKEAIELANDNAYGLAAYIQTLDQGRAQTVARLLRSGSVNINNSFIAPGSPFGGYKLSGTGREGGAEGVNEYLEVKVIAS

SEQ ID NO: 17739 - protein, 618 aa, Candida albicans SC5314
MSKKYSEENTSSIPLTDLTSPSTGETSSQQQRQRASQQQPPQQPKSNTATGSRWSNFVDSFKPAIENEKLAMRYRDADADVEEDAGGYYNSTDQLTEIQRININSSKSNLKRKLKNRHLQMIAIASSIGSGLLIGTGGALATGGPGGILIAWILSGISILCTIQAMAELAVTFPVSGGFNVLFSRFIDPSVGFSVAWNYGLQYLVLLPLELVAASMTIRYWSTDITPDVWVIIFYVTVTSINFFGVRLYGEVEFILSSLKVIAVVGFIILSIVLAAGGAPNGVHHGTKYWHDPGAFANGFKGVSSTFITAAFSFAGTELTGLTSAEAENPRKALPKACKQVFWRILLFYVVSIILITFLVPYDNPRLLGASDVSASPFVIAIQDGGISGLASVMNSVILISVISVGSSSVYATSRTLVSLAEQNLAPKICGYVDRAGRPLVAILITNVFGLLSFIAASGKEDEVFTWLLSISGLSSIFTWLCICISHIRFRRALHVQGRNTNELTFVSQTGVIGPGFGILLNVLVLVAEFWLAIFPLGEKSNAKSFFETYLGFVILIIFYFGHKLWRNNWILFIRSRDIDIDSGRRETDLEALKRELQEEREVLRNKPFWYRAYHFWC

SEQ ID NO: 17740 - protein, 283 aa, Xanthomonas campestris pv. vesicatoria str. 85-10
MPVSRYAVFGHPVAHSLSPAIHTEFGKQTGIALDYTAIDAPLEDFSAALQRFADEGGKGANVTLPLKEAAYALASSLSDRARLAGAVNTLVRNDGQWQGDNTDGAGLVRDLTERQGLDLRGRRVLLLGAGGAARGVAPALLEAGITAMVVVNRSPERADALCDALGEPARVTSRYIEDLRELGDFELIVNATAAGRDRDAGAFALPLGLVNSLTAAVDLNYGDTAIAFLAWARAAQCRYAIDGLGMLVEQAAESFALWHGVRPDTDPVYAALRAREAVLVSAD

SEQ ID NO: 17741 - protein, 214 aa, Hordeum vulgare subsp. vulgare
MDAADAASPCDGHRTVWSEPPKRPAGRTKFKETRHPLYRGVRRRGPAGRWVCEVRVLGMRGSRLWLGTFTTAEMAARAHDAAVLALSGRAACLNFADSAWRMLPLLAGPFSTAKEIKDAVAVAVLAFQRQHPVASTAPMSPARTAVDEKEVDGSPAPSALFMSSELLNEHWFGGMDAGSCYSEGMFIESPDTRPWREDLELGGVQTPPWSYLFD

SEQ ID NO: 17742 - protein, 250 aa, Arabidopsis thaliana
  misc_feature (226)..(226): Xaa can be any naturally occurring amino acid
  misc_feature (234)..(234): Xaa can be any naturally occurring amino acid
  misc_feature (242)..(243): Xaa can be any naturally occurring amino acid
  unsure (1)..(250): unsure at all Xaa locations
SPPPPWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNGSMESNGKGVXIDGLPLPXETGEIDFXXPWTNGQH

SEQ ID NO: 17743 - protein, 934 aa, Oryza sativa
MPSASAALVLLFVAFSLSNAQPGFISLDCGGDDDYTDGIGIQWTSDAKFVSAGQKANLLLQNQQLQQYTTVRSFPADNRKYCYTMNVRNRTRYLVRATFLYGNFDNSNVYPKFDLSLGPTPWTTVVIDDATTPVVQEAIILAAAPTLSVCLSNASTGQPFISTLELRQFNGSLYYTTDEKQFFLRLSARINFGAESNASVRYPDDPFDRIWESDLVRRANYLVDVAPGTERISTTKPIFVSTNEEPPQRVMQTAVVGKNGSLTYRIDLEDFPGNAWGVSYFAEIEDLTPNQTRKFKLVIPGKPEFSKPTVDVEENAQGKYRLYEPGYTNIPLPFVFSFGFKKTNDSSEGPILNAMEIYKYIEISVGSQDANIMASLVSRYPEAGWAQEGGDPCLPASWSWVQCSSEAAPRIFSISLSGKNITGSIPVELTKLSGLVELKLDGNSFTGQIPDFTGCHDLQYIHLEDNQLTGALPPSLGELPNLKEFFSGNSDLRMGHSNTGRTIVIIVCAVVGAILILVAAIVCYLFTCKRKKKSSDETVVIAAPAKKLGSFFSEVATESAHRFALSEIEDATDKFDRRIGSGGFGIVYYGKLTDGREIAVKLLTNDSYQGIREFLNEVTLLSRIHHRNLVSFLGYSQQDGKNILVYEFMHNGTLKEHLRGGPDDVKINSWVKRLEIAEDAAKGIEYLHTGCSPTIIHRDLKSSNILLDKNMRAKVADFGLSKPVVDGSHVSSIVRGTVGYLDPEYYISQQLTEKSDMYSFGVILLELISGHEPISNDNFGLHCRNIVEWARSHMESGDIHGIIDQSLDAGYDLQSVWKIAEVATMCVKPKGVLRPSISEVLKEIQDAIAIELQRELPSSIHHLMSKTSPSEAVNTTGSLQDLEQNASFDELLMRPGLRLNGTGRAAQAASEILNETAILVEQFQGKRNRDFVMN

SEQ ID NO: 17744 - protein, 893 aa, Francisella tularensis subsp. holarctica
MSDFTKDIDVLETQEWLEAFEDVIKREGADRAKFLFEQLLAKGSELGIKSAYSTAKVKNYVNSIDVSEQPSYPGDIELEQKIEAINRWNSTVIVAAANKKDGSIGGHIGTGAGAMTLYEVGFNHFWKAPNDEHAGDLIFYQGHLSPIVYARSFLEGRITAEQLENFRKQAFNGQNAVSSYPHPYLQPTYWQFPTVSMGLGPLQAIYQARFMKYLEARGLAKTSDRKVWAFCGDGEMDEPESIGSITRAGREGLDNLIFVVNCNLQRLDGLVNGNGNIVEELADVFAGAGWNVIKVLWSSDWDKLLQDPRGGKKLAQRLSELNDGQFHTIKAHGGAECRRVVFSGDEDLEALAKDMTDDDIQALRRGGHDPLKIYAAYKKAVENPNGRPTLILPMTVKGYGLGEWGESKNIAHNVKKLDTDALEHIKNRFNVPASKEDIENYRLIKLDENSPEMKYLHSKRKDLGGYIPKRLENKQALEIPSYKDFAKSLLDDSGDREFSTTTAFVRILSYLAKDKNLGKHIVPITVDESRTFGMEGLFRQLGIYNPHGQQYVPEDKQQVMFYKESVDGQILQEGINEQGGFCSWIAAATSYSVHKVPMIPFMIYYSMFGFQRFGDLAWAAGDSMAKGFVIGGTSGRTTLNGEGLQHEDGHSHIQAGLIPNCISYDPTYAYELAVILGEGMKRMYVDGDHVYYYITVMNENYFHRAMPEGCEEGIIKGLYKLDEEKKPASKHVQLLGSGSILREVEAAAKMLKEEYGITSNVWSMTSANELYREAKDVARANMLHPTAEKKESYIEKCFKNEQGPVIASTDYIKLYTDQLREFIPHTFVNLGTDGFGRSDTRAALRSFFEVDRYHVVVASLYALYLDGKVEASEVKAAIEKYNIDPERMAPFYS

SEQ ID NO: 17745 - protein, 470 aa, Francisella tularensis subsp. holarctica
MSDIKTQVVVLGSGPGGYSAAFRAADLGLEVVLVERYAEIGGVCLNVGCIPSKAMLHIAKVINEARHLESLGIIEMGGLKINRENLLKYKDGVIGKLTGGLKGMAQMRKVKIVQGYGKFTSDKELAVEAADGKVTKIAFYNCIIAAGSSVIKLPFVPEDDRIIDSTGALEMKEIPETMLVVGGGIIGLEMAQVYSELGTKITVVEFADQLMNGVDKDLVKAYQKVNSRYDVRLKTAVTAMEAKEDGIYVTMEGDHPAKDERFDRVLMAIGRKPNGKLIDAEKAGVKVDERGFIPVDKQLRTNVPHIFAIGDIVGQPMLAHKAVPEGRIAAEVISGLNHSFDPLVIPSVAYTDPEVAWVGETETSAKAKGIKYEKGVFPWAASGRSLSIDRSEGITKILFDENHKIIGASIVGTHAGELISEAALAIEMGCDAEDIALTVHPHPTLSESLMMATEVYEGTATDLPPQKKKK

SEQ ID NO: 17746 - protein, 385 aa, Thermus thermophilus
MRGLSRRVQAMKPDAVVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSRQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 17747 - protein, 459 aa, Rickettsia akari str. Hartford
MQEFDLVVIGSGPAGYTGSIRAAQLGMKVVCVEKNDTLGGTCLNIGCIPSKALLNSSEKYEEALKHFESIGITADVKLDLQKMIANKDKVVSDLTKGIESLFAKNKITRIKGEAKIIASNIVEVNNEQIKAKNILITTGSSVIEIPNIKIDEEFIVSSTGALKLSKVPETLIVVGGGYIGLELGSVWRRLGAKVTVIEYAPSIVPMLDKEIATQFMKLQQKQGIEFKLNTRVLSAEVKSGKVNLTIEEGGKSAVVTSDVILMAVGRKAYTQNLGLESVGIITDKQGRIEINDRFQTAISNIYAVGDVVKGAMLAHKAEEEAVAAVEIMAGQAGHVNYNLIPSVIYTYPEVASVGETEEQLKAKGINYKVGKFPFLANSRARAIGSTEGLVKILADSKTDRVLGAHIIGANAGTLIAELTAYMEFGAASEDIARTCHAHPTLSEAIKEAALSVDKRSINM

SEQ ID NO: 17748 - protein, 565 aa, Aspergillus oryzae
MAFAGQAPTIIVLKEGTDASQGKGQIISNINACVAVQSTIKSTLGPYGGDLLLVDGNGKQTITNDGATVMKLLDIVHPAARILTDIARSQDAEVGDGTTSVVVLAGEILKEVRELVEQGVSAQTIIKGLRRGSAMAVNKVKEIAVDMIEAAGSEEKKVETLRRLAATAMNSKLIKRNSDFFTKMVVDAVLSLDQDDLNEKLIGVKRVTGGGLQDSLFVDGVAFKKTFSYAGFEQQPKYFKDPKIVCLNVELELKSEKDNAEVRVEQVSEYQAIVDAEWQIIYNKLEAIYKTGAKVVLSKLPIGDLATQYFADRDIFCAGRVASDDMDRVCQATGAATQSTCSDIQERHLGTCGIFEERQIGGERYNLFSECPAAKTCTLVLRGGAEQFIAEVERSLHDAIMIVKRALRNTTIVAGGGATEMELSSYMHGFADRNVPHKQQAVVKAFAKALEVIPRQLCDNAGFDATDILNRLRVEHRKGNVWAGVDFDNEGVRDNMVAFVWEPSLVKVNAIQAAVEAACLILSVDETIKNEESAQPQAPGRGLPPGAAQRALGGGRGRGMPRRGR

SEQ ID NO: 17749 - protein, 277 aa, Brassica napus
  misc_feature (227)..(227): Xaa can be any naturally occurring amino acid
  misc_feature (260)..(260): Xaa can be any naturally occurring amino acid
  unsure (1)..(277): unsure at all Xaa locations
MPATEYQRSFGRTLLNLRRDSVHSVAESSTTEPTQMEAELDSFQRRVAERFADLNASTSEDLLSLEWVGKLLDSFLLCQEEFRVIIVSNHRELVAKPPMDRMVSEYFDRSVKALDVCNAIRDGVERIRQWQKLIEIVVCAFDRTRPLGEGQFRRAKKTLIELAIGMLDDKEASSSSSVTQHRNRSFGRNKEKTIGHFRSLSWSVSRSWSASKQLQALGNGLAPPRAXDVTATSGLAVPVYTMTFVLLFVMWALVAAIPCXDRGLQVHFNGPRSFQWG

SEQ ID NO: 17750 - protein, 830 aa, Streptomyces coelicolor A3(2)
MSACVPARADSARTKHVHPPHSPPPHGPRRFRVAGADVSAAIAVFLIALPLSLGIALATGAPLQAGLVAAAVGGIVAGRIGGCPLQVSGPAAGLTVVTADLIQHYGWRTTCAITVFAGIAQLGLGCLRVARSALAVSPAIVHGMLAGIGVTIAVAQLHIVLGGTPQSSVPDNLVALPAQLANLHPADLAVSVLTLTLLLLWPRIPGRAGQALGKLPAALIAVAGATAVAALTGLRLPKVDLPSWSSHALASLPDGPVLGLVAAVLTTTLVCSVQSLLGAVAVDKLVAARPSLTGRVKRSDLDRELLGQGAANIVSGSLGGLPIAGVAVRSSANVAAGAVSRNSTMLHGVLVVIAALLMVPALELIPLASLAALVMAVGLKMVSLNHIRTVTRHREVLVYAVTTCGVVFLGVLEGVALGIAVAVGVALHRLTRTRITHDETEGVHHVHVRGQLTFLAVPRLSRVLHQVPHGADAVVELDGSFMDHAAYETLQDWQKTHTAQGGSVDITGRRPGTRISEPAEEDGCRCRPWTPWRNHQCERPPTAPPRGTAGRSATDGSPAGNLGTSTGPNTPGTRDATGARGATGGSSAPDGPTGHELARGISAFHRNTGPLMRRELARLAREGQQPSQLFLTCADSRVVTSMITSSGPGDLFVVRNVGNFVPLPGEESGDDSVAAAIEYAVDVLKVRSITVCGHSGCGAMQALLAAEPGGARTPLQRWLRHGLPSLERALPDVDVDVDLNEQEQKRGAGRARPRLAGRGAADTAERLCLANVVQQLEHLRAHDSVARALGAGDLELHGMYFHVGEAQSYLLSEDAEGSVFELVRETNLTA

SEQ ID NO: 17751 - protein, 355 aa, Yersinia pseudotuberculosis IP 32953
MSQKFLFIDRDGTIIAEPPTDYQVDRLDKLALEPDVIPALLALQKADYKLVMITNQDGLGTSSFPQETFDPPHNLMMQILTSQGINFEQILICPHLPEDNCTCRKPKTALVESYLADGVMNSATSYVIGDRETDLQLAENMGISGLRYQRDGLNWTQIAKQLTQRDRHAYVNRVTKETAIDVNVWLDREGGSKIKTGVGFFDHMLDQIATHGGFRMDIQVSGDLYIDDHHTVEDTALALGEAINIALGDKRGIGRFGFVLPMDECLARCALDISGRPHLEYKAEFNYQRVGDLSTEMVEHFFRSLSYAMACTLHLKTKGRNDHHRVESLFKVFGRTLRQAIRVEGNTLPSSKGVL

SEQ ID NO: 17752 - protein, 458 aa, Chlorokybus atmophyticus
MAAATLSSSISSCSGLRAQAKAATPTKARRVAAAPSRHVLGGFSGLKAVRNNVLLVQKRPTDEDRLFAQAAAPQASSSAGKQETTMKLRVAINGFGRIGRNFLRCWHGRGDDSPLEVIAINDSGGVKQATHLLKYDSMLGTFNANVGIIDEKTISVDGKPITIVSNRDPAQLPWAELGIDLVIEGTGVFVDGPGAGKHLQAGAKKVLITAPAKGAEIPTYVVGVNEDQYDHDASAIISNASCTTNCLAPFVKVLDEEFGIVKGTMTTTHSYTGDQRLLDASHRDLRRARAAALNIVPTTTGAAKAVALVLPQLKGKLNGIALRVPTPNVSVVDLVINTEKKGITADQVNAAFRKAAEGPLNGVLAVSDLPLVSIDFRCSDVSSTIDSSLTMVMGDDMLKVVAWYDNEWGYSQRVVDLAHIVANNWPGQKADSEEESGDPLDKYCATNPEADECRVYDE

SEQ ID NO: 17753 - protein, 229 aa, Oryza sativa (japonica cultivar-group)
MTKSSCAHVVGVPVTSKAYAIEEATTARDGGKKVDGDRLAVSLTHPSPYTSFGYKHSSKLQVIHWVNKLGRRAQGFRDHVTLGPKLSETVRGKLSLGARILQAGGVERVFRQAFSAEKGERLVKALQCYLYTTGGPIAGMLFVSNRKIAFRSDRSLAVTSPAGDVVARVPYKVVVPLRRIKRVRPSENADKPEQKYIHVATVDGFEFWFMGFVSYQRCCKYMQQVISEL

SEQ ID NO: 17754 - protein, 144 aa, Glycine max
MGSLMAGWDSLILDPESATIERNRSLTKEEIDAYWRAKKETELEHLRAISKLSETIQTRKCEDSENSHKSSTVTLASIKESLGMDVDQKSLEQLIKKNGWWTKSNWAFLNEPPVIEAASNEYASQFHVANLGSTKFNPGDGISA

SEQ ID NO: 17755 - protein, 638 aa, Arabidopsis thaliana
MEALRIYLWSLCLSLCLIIYGANSDPLEDKRALLEFLTIMQPTRSLNWNETSQVCNIWTGVTCNQDGSRIIAVRLPGVGLNGQIPPNTISRLSALRVLSLRSNLISGEFPKDFVELKDLAFLYLQDNNLSGPLPLDFSVWKNLTSVNLSNNGFNGTIPSSLSRLKRIQSLNLANNTLSGDIPDLSVLSSLQHIDLSNNYDLAGPIPDWLRRFPFSSYTGIDIIPPGGNYTLVTPPPPSEQTHQKPSKARFLGLSETVFLLIVIAVSIVVITALAFVLTVCYVRRKLRRGDGVISDNKLQKKGGMSPEKFVSRMEDVNNRLSFFEGCNYSFDLEDLLRASAEVLGKGTFGTTYKAVLEDATSVAVKRLKDVAAGKRDFEQQMEIIGGIKHENVVELKAYYYSKDEKLMVYDYFSRGSVASLLHGNRGENRIPLDWETRMKIAIGAAKGIARIHKENNGKLVHGNIKSSNIFLNSESNGCVSDLGLTAVMSPLAPPISRQAGYRAPEVTDTRKSSQLSDVYSFGVVLLELLTGKSPIHTTAGDEIIHLVRWVHSVVREEWTAEVFDIELLRYTNIEEEMVEMLQIAMSCVVKAADQRPKMSDLVRLIENVGNRRTSIEPEPELKPKSENGASETSTPSEI

SEQ ID NO: 17756 - protein, 332 aa, Silicibacter pomeroyi DSS-3
MDAKVSTKPHEMLAATLSQEMAAVNALIRTRMASEHAPRIPEVTAHLVEAGGKRLRPMLTLAAARLCGYQGEDHVKLAATVEFIHTATLLHDDVVDESGQRRGRPTANLLWDNKSSVLVGDYLFARSFQLMVETGSLRVLDILANAAATIAEGEVLQMTAASDLRTDESVYLQVVRGKTAALFSAATEVGGVIAGVPEAQVRALFEYGDALGIAFQIADDLLDYQGDAKATGKNVGDDFRERKLTLPVIKAVAQATDEERAFWVRTIEKGKQAEGDLEQALALMEKYGTLAATRADAHAWAEKARTALELLPNHEIRTMLSDLADYVVARLS

SEQ ID NO: 17757 - protein, 222 aa, Glycine max
VTARQDLHHRNRPSDHYRLLKSNVDALNLIQVGLTLTDAAGNLPDLAGNRSIWEFNFRDFDVARDAYAPDSIDLLRRQGIDFARNTADGVDSTCFAELMMSSGLVCNDAVSWVTFHSAYDFGYLVKILTRRNLPTRLEEFLKTVKVFFGDNVYDVKHMMRFCDTLYGGLDRVARTLNVDRAVGKCHQAGSDSLLTWHAFQKIVDIYFVKEEHRKHAGVLFGL

SEQ ID NO: 17758 - protein, 483 aa, Streptomyces avermitilis MA-4680
MTSSQVDKQYDGNGAVGGDAPEEGYERGLGSRQVQMIAIGGAIGVGLFLGAGANIAKAGPSLILMYALAGVIIFFIMRALGELLLYRPVSGSFAEYSREFLGPFFGYFTGWTYWLMWVVTGMAELTAAAIYVHYWFPAVPQWVTALVFLVVLFVANLISVKLFGEIEFWFSMVKVTALIGMIVIGLGVLTFGFSSAGDTASVANLWQFDGFFPKGIGSSLMTLQGVMFAYLAVELVGVTAGESEDPEKTLPKAINTLPWRIALFYVGALTVILCVVKWTEFAPGVSPFVKAFAMIGIPAGAGIVNFVVLTAALSSCNSGMYSTGRMLRTLADNGEAPRVFSKLSASKTPAFGITISVLFMGIGVILNYVVPEKAFGYVTSVATAAGIWTWLMILVSHVLYRRAVDAGRLPASSFPAPGGAKCSWVAIVFLLFVTGLIAYDADSRVCLYVMAVWAAALAIGWYVLKARNPQVAERHEPKFEKVG

SEQ ID NO: 17759 - protein, 158 aa, Bacillus licheniformis ATCC 14580
MEILTNFPLLASFAAIFFAQFIKVPIYFVVSKKWDWRLVTSTGGMPSSHSAAVTALSTGVALDHGMDSSLFAVSAIFAVITMFDATGVRRHAGEQATVINRLVRDFNRFVNEAKDFPKSHQEEKQKKLKELLGHQPIEVFFGGLTGIALTLLLDYLLM

SEQ ID NO: 17760 - protein, 775 aa, Arabidopsis thaliana
MDEDGNLQISNSNYNGEEEGEDPENNTLNQPLLKRHRTLSSTPLALVGAKVSHIESLDYEINENDLFKHDWRSRSKAQVFQYIFLKWTLACLVGLFTGLIATLINLAVENIAGYKLLAVGYYIAQDRFWTGLMVFTGANLGLTLVATVLVVYFAPTAAGPGIPEIKAYLNGIDTPNMFGFTTMMVKIVGSIGAVAAGLDLGKEGPLVHIGSCIASLLGQGGPDNHRIKWRWLRYFNNDRDRRDLITCGSASGVCAAFRSPVGGVLFALEEVATWWRSALLWRTFFSTAVVVVVLRAFIEICNSGKCGLFGSGGLIMFDVSHVEVRYHAADIIPVTLIGVFGGILGSLYNHLLHKVLRLYNLINQKGKIHKVLLSLGVSLFTSVCLFGLPFLAECKPCDPSIDEICPTNGRSGNFKQFNCPNGYYNDLSTLLLTTNDDAVRNIFSSNTPNEFGMVSLWIFFGLYCILGLITFGIATPSGLFLPIILMGSAYGRMLGTAMGSYTNIDLGLYAVLGAASLMAGSMRMTVSLCVIFLELTNNLLLLPITMFVLLIAKTVGDSFNLSIYEIILHLKGLPFLEANPEPWMRNLTVGELNDAKPPVVTLNGVEKVANIVDVLRNTTHNAFPVLDGADQNTGTELHGLILRAHLVKVLKKRWFLNEKRRTEEWEVREKFTPVELAEREDNFDDVAITSSEMQLYVDLHPLTNTTPYTVVQSMSVAKALVLFRSVGLRHLLVVPKIQASGMSPVIGILTRQDLRAYNILQAFPHLDKHKSGKAR

SEQ ID NO: 17761 - protein, 554 aa, Pseudomonas putida GB-1
MAYYRTPHDVTALPAWQALQQHRDAMQGFSMREAFAADAQRFDQFSLSCCGLFLDYSKNLITEQSRDLLVNLANEVGLQDAIKSMFAGEIINASEGRPVLHTALRRPVGDKLSVNGVNVMPEVHKVLNQITELVGRIHDGLWRGYSEKPITDVVNIGIGGSFLGPELVSEALLPYAQRGVRCHYLANIDGSEFHELSANLRAETTLFIVSSKSFNTLETLKNAMAARTWYLAQGGSEAELYRHFIAVSSNKAAAVAFGIREENIFPMWDWVGGRYSLWSAIGLPIALAIGTANFKELLSGAYTMDQHFQTAPFDKNMPVLLALLGVWYGNFWGANSHAILPYDHYLRNITKHLQQLDMESNGKSVLQDGTPVKTDTGPVIWGGVGCNGQHAYHQLLHQGTQLIPADFIVPVVSFNPVADHHQWLYANCLSQSQALMLGKTREEAEAELRGKGLNEADIEKLAPHKVIPGNRPSNTLVVERISPRRLGALVAMYEHKVFVQSVIWGINAFDQWGVELGKELGKGVYQRLVGSLEESAEDGSTQGLINYFRGRHRG

SEQ ID NO: 17762 - protein, 395 aa, Campylobacter jejuni subsp. jejuni NCTC 11168
MKMDYKEQSHIIPTYKRFDIVLEKGQGVYLFDDKAKKYLDFSSGIGVCALGYNHAKFNAKIKAQVDKLLHTSNLYYNENIAAAAKNLAKASALERVFFTNSGTESIEGAMKTARKYAFNKGVKGGQFIAFKHSFHGRTLGALSLTANEKYQKPFKPLISGVKFAKYNDISSVEKLVNEKTCAIILESVQGEGGINPANKDFYKALRKLCDEKDILLIADEIQCGMGRSGKFFAYEHAQILPDIMTSAKALGCGLSVGAFVINQKVASNSLEAGDHGSTYGGNPLVCAGVNAVFEIFKEEKILENVNKLTPYLEQSLDELINEFDFCKKRKGLGFMQGLSLDKSVKVAKVIQKCQENALLLISCGENDLRFLPPLILQKEHIDEMSEKLRKALKSF

SEQ ID NO: 17763 - protein, 201 aa, Rickettsia rickettsii
MICDIINLLKEDLNKADIENEIYMRLKEPYSVLKKMKRKEVPIDALKDLIACRIIVKSKALCYNALDIVKSSPHLDWLYTKDYINRPKSNGYQSLHNIMQLLHSKRNFEIQIRSENMHKDAELGRAAHLNYKEEQDRHLQKVFDITNDTILFKARQMVKQFEGFEEQIVEYEKEIMRIWHTKYDEMLKWANTAEVLIFNKD

SEQ ID NO: 17764 - protein, 134 aa, Bacillus halodurans C-125
MRDQMLPSIILFDGVCNFCNYWVQFIIKRDPQATFQFASLQSEVGQELLEKHSIDRSTDSVVLIMEGQAFVCSDAVLKIVAQLDSPIRWLKWAVIFPRFLRDFIYRIVARNRYKWFGKRDECQIPTKEQRSRFL

SEQ ID NO: 17765 - protein, 196 aa, Picea sitchensis
MAMAIKSNRFVHLCFLLFVVSTVLLQTTDGRSWKKRPLRQPCRNMVLYFHDVIYNGKNAMNATSTLVGAPRGANLTLLYGKDNHFGDLAVFDDPITLDNNFHSPPVGRAQGFYFYDMKNTFSAWLGFTFVLNSTDHKGTITFGGADPILTKYRDISVVGGTGDFLMTRGIATVNTDSYEGDVYFRLRVNITLYECY

SEQ ID NO: 17766 - protein, 235 aa, Zea mays
IRHQIQWEALALLLIGISINQLRTVPAGNTAFGLPVTAIAYIYTLIFVTVPSMASVYNEYALKSQYDTSIYLQNLFLYGYGAIFNFLGILGTALFQGPESFNILRGHSRATMFLICNNAAQGILSSFFFKYADTILKEYSSTVATIFTGLASAAFLGHTLTINFLPCISVVFISMHQFFSPLAKVKDDKPADLIELEDTQNHRSSESSFVNMTAGAAVDASHRIGTDERQPLLPT

SEQ ID NO: 17767 - protein, 267 aa, Alpinia hainanensis
MEHKADQDRLLGFKGGKLEPPVAAVGRMGRGKIEIKRIENTTSRQVTFCKRRNGLLKKAYELSLLCDAEVALVVFSCRGRLYEYASSSVKSTIEKYKKACKDTTNDGFVSEANAQYYQQEASKLRQQINSIQISNRNLMGESLHSMNLRDLKQLESRLEKGIGKIRNKKNELLFAEIEYMQRREMELQSDNIFLRNKIAETDRVHQQMSMLPSTGATVAYEAMPTYYSGNFMQCKNRSQTNIYPQQRQRTFTSTPMRSKHGAWVLRG

SEQ ID NO: 17768 - protein, 196 aa, Picea sitchensis
MAVKNHNSAVHLGFVWLVVSSTVLLQTSDGHSWKKHSLPKPCRNLVFYFHDVIYNVLNAKNATSTLVGAPHGANLTLLTGKDNHFGDLAVFDDPITLDNNFHSPPVGRAQGFYFYDMKNTFSSWLGFTFVLNSTDHRGTITFGGADPILAKHRDISVVGGTGDFLMARGIATISTDAYEGDVYFRLCVNITLYECY

SEQ ID NO: 17769 - protein, 224 aa, Picea glauca
MNVMAMPVKPASSRAAHLCIVWLVVSTLLLQSTDAFIWMKPKHPKPCWNKVLYFHDILYNGKNAKNATSAIVAAPQGANLTILTGNNHFGDLVVFDDPITLDNNLHSPPVGRAQGFYFYDMKKTFSAWLGFTFVLNSTDHRGTITFTGADPILTKYRDISVVGGTGDFLMARGIATISTDAFEGEVYFRLRVNITLYEGYHSLYSVTASDDSASQNRKWKSVLA

SEQ ID NO: 17770 - protein, 379 aa, Bacillus cereus ATCC 14579
MVAEKGTQTKTQQQREQHFELLNSTQIVISEALEKLGYPNEVYELLKEPIRMMTVKIPVRMDDGTVKIFTGYRAQHNDAVGPTKGGIRFHPNVTENEVKALSIWMSLKCGIVDLPYGGGKGGIICDPREMSFRELERLSRGYVRAISQIVGPTKDIPAPDVFTNSQIMAWMMDEYSRIDEFNSPGFITGKPLVLGGSHGRETATAKGVTICIREAAKKRGIDIKGARVVVQGFGNAGSFLAKFMHDAGAKVIAISDAYGALHDPNGLDIDYLLDRRDSFGTVTKLFNNTISNKELLELDCDILVPAAIENQITEENANDIKAKIVVEAANGPTTLEATKILTDRGILLVPDVLASAVWLPVSTLSGSKTPKVTTGLRRK

SEQ ID NO: 17771 - protein, 421 aa, Silicibacter pomeroyi DSS-3
MDHFLYRDGALCAEDVPLAEIAATVGSPFYVYSTATLLRHFQLFDEALDGTDHLICYAMKAASNQAILRTLAQAGAGMDVVSVGEYLRARAAGVPGVRIVFSGVGKTAEEIRVALVGGIRQFNVESEPEMEVINAIALELGKVAPITIRVNPDVDAKTHAKIATGKSENKFGIPIARASAVYAQAAALPGLEVVGIDVHIGSQLTDLAPFETAYRKVAELTERLRAEGHDIRRLDLGGGLGIPYTRSNEAPPLPMEYGALIKRTLGHLGCEIEIEPGRLIAGNAGLMVSKVIYVKSGEGRDFLILDAAMNDLIRPAMYDAHHDIVPVVEPEPGVEPQPYDIVGPVCESGDTFAKARMMPPLAAGDLVAFRSAGAYGAVMSSEYNSRPLIPEVLVHGDQFAVIRPRPSFDEMINRDTIPPWL

SEQ ID NO: 17772 - protein, 576 aa, Candida albicans SC5314
MSRKSSIDMPKEASSPECYTTSTSSNEISEKPGMWRNFKDSFKPPVPIDDIENGSISSTQLKGGQNVPLQQSLKKRQLQMIALGGCVGSGLLVASGAALRNGPASLLIAWFIVSTFLYCTMQCLAELSSTFPVSGSFAVYSIKFIDPSWGTAMGYNYALFWVVVMPLELVASSMTIKFWPSNINTSVWVAVFYVLIIGTNLFGGTRAFGETEFVASVIKLLGIVGFNILAIVLICGGGDQGYIGGKNWHPPFTTGVKGVISVLLTATYSLAGTELVGLTSAEAAGDARKVLPKAIKQVLWRILIFYLLTLTLVGFLVPASDPQLIGGGSGASASPFVIAIREGGIKGLPSVFNVVVLVALLAIANSAVYGFSRTILALAEQGVAPSIFKYVDRQGRPLAGIATSAIVGLLSFVSASKQQEQVFDWLVALSGLSTFFTWGSINAAHIRFRIAMKVQGRSLDELPYKANTGVLGAYYGLIMNVAVLALQFWLAVWPIGGKPDATYFFKQYLAAVLVLAVYVIHKVATRNWKFMVDYKDMDLDSGRSDIDIDILKQELEEEREAYKRQPWYYKFYQFWC

SEQ ID NO: 17773 - protein, 390 aa, Pseudomonas putida GB-1
MAHPYSARSRAIEPFHVMALLARANELQAAGHDVIHLEIGEPDFTTAAPIVAAGQAALAAGHTRYTAARGLPALREAIAGFYGQRYGLSIDPERILITPGGSGALLLASSLLVDPGKHWLLADPGYPCNRHFLRLVEGGAQLVPVGPEVNYQLTADLVERYWDKDSVGALVASPANPTGTVLGREALASLAKATHERHGHLVVDEIYHGLTYGMDAPSVLEVDDSAFVLNSFSKYFGMTGWRLGWLVAPPGAVADLEKLAQNLYISAPSMAQHAALACFQPETLAIFEERRAEFARRRDYLLPALRELGFRIAVEPQGAFYLYADISAFGGDAFAFCRHFLETEHLAFTPGLDFGRHLAGHHVRFAYTQSLPRLEEAVQRIARGLRSWQG

SEQ ID NO: 17774 - protein, 248 aa, Aspergillus nidulans FGSC A4
MSEVRQRAGVPKDASRSTSTTKDRGNDAQSRTRSGISILDIFRVMVSLAVVSCGLSYYLTETVTWGYNPWFTNWSQLVRYVKGPIALTPSELSLYDGTNPDRPIYVAVNGTIFDVSANPRMYGPGGGYHFFAGRDATRAFVTGCFAEDLTDDLTGVEEMFIPIDEPEELEKLSSGEKKKRREQDMRNAKKRVEKQIAHWVGFFGKHQKYFEVGRVVKDDTEKDEMKGKRELCEAARKQRPKREKSKSA

SEQ ID NO: 17775 - protein, 444 aa, Bacillus subtilis subsp. subtilis str. 168
MAKYTREDIEKLVKEENVKYIRLQFTDILGTIKNVEIPVSQLGKALDNKVMFDGSSIEGFVRIEESDMYLYPDLNTFVIFPWTAEKGKVARFICDIYNPDGTPFEGDPRNNLKRILKEMEDLGFSDFNLGPEPEFFLFKLDEKGEPTLELNDKGGYFDLAPTDLGENCRRDIVLELEEMGFEIEASHHEVAPGQHEIDFKYAGAVRSCDDIQTFKLVVKTIARKHGLHATFMPKPLFGVNGSGMHCNLSLFKNGVNAFFDENADLQLSETAKHFIAGIVKHATSFTAVTNPTVNSYKRLVPGYEAPCYVAWSAQNRSPLIRIPASRGISTRVEVRSVDPAANPYLALSVLLAAGLDGIKNKLEAPAPIDRNIYVMSKEERMENGIVDLPATLAEALEEFKSNEVMVKALGEHLFEHFIEAKEIEWDMFRTQVHPWEREQYMSQY

SEQ ID NO: 17776 - protein, 159 aa, Picea sitchensis
VPLKPCRNLVLYFHDILYNGKNAKNATSAIVGAPQWGNLTTLTVNNHFGDLAVFDDPITLDNNLHSRPVGRAQGFYLYDMKNTFSSWLGFTFVLNSTDYRGTITFGGADPILTKYREISVVGGTGDFLMARGIANVSTDAFEGDVYFRLRVNITLYECY

SEQ ID NO: 17777 - protein, 493 aa, Glycine max
TQRFLSVQSWKTSRTSRNLRNSKPGSGIAHAVLTSDIDEDSMAFQGVPTFEKPEVDPKSVASIILGGGAGTRLFPLTGRRAKPAVPIGGCYRLIDIPMSNCINSGIRKIFILTQFNSFSLNRHLSRAYSFGNGMTFGDGFVEVLAATQTPGEAGKKWFQGTADAVRQFIWVFEDAKNKNVEHILILSGDHLYRMDYMDFVQRHVDTNADITVSCVPMDDSRASDYGLMKIDKTGRIIQFAEKPKGSDLKAMRVDTTLLGLLPQEAEKHPYIASMGVYVFRTETLLQLLRWKCSSCNDFGSEIIPSAVNEHNVQAYLFNDYWEDIGTIKSFFDANLALTEQPPKFEFYDPKTPFFTSPRFLPPTKVEKCKIVDAIISHGCFLRECSVQHSIVGVRSRLESGVELQDTMMMGADYYQTEYEIASLVAEGKVPIGVGANTKIRNCIIDKNAKIGRNVIIANTDGVQEADRAKEGFYIRSGITVTLKNATIKDGTVI

SEQ ID NO: 17778 - protein, 326 aa, Bacillus cereus ATCC 14579
MQKETVIIIGGGPCGLAAAISLQKVGINPLVIEKGNIVNAIYNYPTHQTFFSSSEKLEIGDVAFITENRKPVRNQALAYYREVVRRKSVRVNAFERVEKVQKDGEAFQVETTKRDGSKEIYIAKYIVVATGYYDNPNYMNVPGEELKKVAHYFKEGHPYFDRDVVVIGGKNSSVDAALELVKSGARVTVLYRGIEYSPSIKPWILPEFEALVRNGTIQMHFGAHVKEITEHTLTFTVDGEALTIKNDFVFAMTGYHPDHSFLTKMGVQIDEETGRPFYTEDRMETNAENIFIAGVIAAGNNANEIFIENGRFHGDAIAQTIASREK

SEQ ID NO: 17779 - protein, 404 aa, Mycobacterium avium subsp. paratuberculosis K-10
MREAPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRLHIDSGAGATVAGIRVPRSEATAFGCIDSDESGRIRKFVEKPLDPPGTPDDPETTFVSMGNYIFTTKVLIDAIRADADDDHSDHDMGGDIIPRLVDDGMAAVYDFSDNEVPGATDRDRGYWRDVGTLDAFYDAHMDLVSVHPVFNLYNKRWPIRGESENLAPAKFVNGGSAQESVVGAGSIISAASVRNSVLSSNVVVDDGAIVEGSVIMPGARVGRGAVVRHAILDKNVVVGPGEMVGVDLERDRERFAISAGGVVAVGKGVWI

SEQ ID NO: 17780 - protein, 415 aa, Mesostigma viride
MAAATFANFTGLKATSLFSAKSADEAFAARLAPVQATGSSQKQVTEAKLKVAINGFGRIGRNFLRCWVGRENSPLEVVAINDSGGVKQAAHLLKYDSMLGTFKADVKVISETALAVNGKTIEIVSSRDPLQLPWAKMGVDLVIEGTGVFIDGPGAGKHIIAGAKKVLITAPAKGAEIPTYVVGVNEKDYTHDVSNIISNASCTTNCLAPFAKVLDENFGIVKGTMTTTHSYTGDQRLLDASHRDLRRARAAALNIVPTSTGAAKAVSLVLPKLKGKLNGIALRVPTPNVSVVDLVINTTKKGMTAEEVNAAFRKEANGAMKGILAVSDLPLVSIDFRCSDVSCTIDSSLTMVMGDDMVKVVAWYDNEWGYSQRVVDLADIVANNWPGMVQETGSDPLETFCNTNPDADECRVYND

SEQ ID NO: 17781 - protein, 456 aa, Photobacterium sp. SKA34
MSINAEQNLHLRCEGDTNTTEARKQWYRNLNSPQTEAMLEQDSQYFLHQSMSTPCMNALAAADGIYIEDINGKRYMDFHGNNVHQLGYGHPKVVERIQQQLTELPFAPRRFTHQSAIDCAKKLTEIAGGELERVLFAPGGTSVVGMALKLARIITGNAKVISLWDSFHGASLDAISVGGEACFRQGMGPLMAGVERIPPPITYRGAFPREDNSDLQYADYLEYVIEKEGGVGAFIAEGIRNTDVQVPSKAYWQRIREICDKHNVLLIIDDIPNGMGRTGHWFSYQAFGIEPDILCIGKGLGGGVVPFAALITKDKYNQAADISLGHYTHEKSPIGCAAALATIDVIESEKLLAKVKQDQDYVSERLFQMKKSYSVIGDIRGIGLLWGIELVTNRLTKTRAHDAAEQVLYRCLELGLSFKVSQGNVLQLSPPLIIKRKDLARALDIVEQAISEVIIN

SEQ ID NO: 17782 - protein, 254 aa, Geobacillus kaustophilus HTA426
MKRRIRFIILFGALAAVLAGCTEIHKPITPESKGFWNEYIVYPLSWLIKYVAGLLGGSFGLSIIVVTILIRLLILPLMIQQTRNAKAMQALQPEIEALRKKYSSKDAQTQQKLQQEMMLLFQKHGVNPMAGCFPILIQMPILIGFYHAIMRTREIAQHNFLWFDLGEKDPYYILPVIAGVTTFIQQKIMMAGSAQQNPQMAMMLWMMPIMIVIFAINFPAALSLYWVVGNIFSIVQTYLIKGPEIAAHSGGAKK

SEQ ID NO: 17783 - protein, 357 aa, Debaryomyces hansenii CBS767
MTLTYQNPSLQVTKDHRIELKEAPVKPPLKGQVLIHVRATGICGSDIHFWKSGSIGDLKVLDNCILGHEAAGDVVEIGEGVTNVSVGDRVAIEPGVPCGNCFLCSQGDYNLCEDVQFIGVFPYHGSMQRYITHNSRYVYRLPDNMTYSQGALVEPISVAYHGIERANLKLGEGVLIAGAGPIGLVALLLAKASGCTPLCITDLSKEKLEFAKTLVPQVRTYKVNTKLSPQENAKEVRSIFGDQECNFPHVTLECTGVESSIITCAYVTRRSGTLMVIGVGKDIINNFPFMRLSLAEIDVKFINRYHDSWPTVIRLLSHGIINADLLITHRFTLENAIEALTLSSDACNGSIKVIIED

SEQ ID NO: 17784 - protein, 358 aa, Thermotoga maritima MSB8
MKVVIVGNGPGGVELAKQLSEEHEVTIVERETVPYYTKPMLSHYVAGLAEEKSLFPYPIDWYEKKGIKLLLGTTAKRIDAEKKVLETDRGTLEYDVLVLATGAKPRTLKIPGWERMYTLRTIEDAKRLKGAVEREKDLLIIGGGFIGLEIAGNLSKQGIKVKVVEKMTRLMGLDEELTERIKGELEKHGVEFYLGRDVERIENDVLVTDKEEIPARVILCSIGIVPEVSLAKESGLDVNRGILVDKTFRTSKPDIYAIGDCAEHEGIICGTAKAAMAHAKVLANTLKGIPDEYDFHFRSSYFKFGDFPIAIVGELTDRGEWIDSETKSFYRDEKIVGVVVLSDVRKAREWEERLRSTR

SEQ ID NO: 17785 - protein, 430 aa, Robiginitalea biformata HTCC2501
MVIKEPKSKKPVKQGMLDNVMRQFDHAADLLELNPNIRKILEVTNNELLVHFPVRMDDGTVKIFTGYRVQHNNALGPYKGGLRYHPTVDIDAAKALAMWMTWKTSLAGLPFGGAKGGIQLDPSRYSQEELQRITRRFTFALGDNIGPELDIPAPDVNTTAQTMAWILDTYMSTKSPAERSTNLHVVTGKPIGAGGSAGRDRATGYGVYLTIKFWAETRGHTLHGKTFAVQGFGNVGYWASHFLEEEGGVLIGVQDASGTLYRAEGIDVGELAEYARANRGRIHGFSKASPIDSGDFFGLDCDILIPAALGNQITAKNAPDIKASLIAEGANGPTDVSAEAILLEKQVDIIPDILCNSGGVIGSYFEWLQNKNSEIWPMEEVMDRLEKKMRESFNRVTAEAEERQVDWRSAAFIIAIERLADAYTQRGIFP

SEQ ID NO: 17786 - protein, 357 aa, Synechococcus sp. CC9311
MPQHRVVLLPGDGIGPEITAVAKQLLEAVSTRHGFSLEFSEAPIGGSAIDATGEPLPASTLEACKAADAVLLAAIGSPRFDSLPREKRPESGLLALRAGMELFANLRPVKIVPALIGASSLRPEVVEGVDLMVVRELTGGIYFGQPKGRVQADGEERAFNTMTYSDSEIDRIARVAFKLACERRGQLCSVDKANVLDVSQLWRDRVEGMKSDYAAVDVSHLYVDNAAMQLVRDPRQFDVVLTGNLFGDILSDISAMLTGSIGMLPSASLGSEGPGLYEPVHGSAPDLAGQDKANPMAMVLSAAMMLRTGLKQNAAADDLEHAVDRVLAAGFRTGDLMSEGCTALGCQAMGEELLKTL

SEQ ID NO: 17787 - protein, 419 aa, Oryza sativa (japonica cultivar-group)
MGGVIGALFRGGGHRREMHRAPMNQPGYGGGGENHRRAMLTKKYSYIPDNYQSLDQVTAALRDQGLESSNLILGIDFTKSNEWTGKRSFSGQSLHKIGSTPNPYEQAISIIGKTLAPFDDDNLIPCFGFGDATTHDYNVFSFHPDNSPCHGFEEVLSCYKKIVPHLRLSGPTSFAPIVEAAVDIVDRSGGQYHVLVIVADGQVTRSVDTSDNDLSPQERRTVDSVVMASSYPLSIVLVGVGDGPWEDMQKFDDKIPARQFDNFQFVNFTSIMSRSTTQQQKESAFALAALMEVPIQYKATMELGILGRSTGKAKRIMPAPPPLPSAAGRQPSLRREDSAAATAAAAPPSPREDQVCPICLTNAKDLAFGCGHMGMWGEPDQMPNLSTDDSVQAEAVLRMIKCLWTDGMELKSVLNVQNA

SEQ ID NO: 17788 - protein, 556 aa, Moraxella osloensis
MLLNHRKRLLQLWRIAAHYRVDTHLPIEETPQLEPIAKLIRMHPASYFQKPNPDGVRLALEEMGTLFLKLGQLLSTRRDLVTPEIIEQLVHLQDRVKPFSVDTVIEQIEQSTKKGGLGQTINQLFARFDGTPLAAASIAQVHTARLHDGREVVVKVVRPTIREQIIEDFELLRDLAGWASARIEAARAVHIIDIVEDYRQVLLNELDLTLEAANTTQMRNNFLGSSMMYVPEVYQASKNIMIMERIIGVPISQTQVFDALGYDRAALAAKGLTIFFTQVFRDNFFHADMHPGNVFVETLPADTPNPNPRYIALDCSIVGELSKADQMIVARLLLSVMNNNFTGLVDIIARAGWIPPNTDKYALMRDMRRTVSPMISKPINDIDFAGVLMSVLDIARRYHLDIPPQLMLLLKTLVHVEGLGRDLYPELDIWSLAKPILTGWVKQQFDPMQKIGELRKQLPELLLSLNDMPQLLDNSLQSLSNLGGHQDQQLREIQQIRSDMLKSRQQDWLAILGFVGSLFIAQMIASHVVWQVSSWLAPIFYVIAVLFVFDALGYDR

SEQ ID NO: 17789 - protein, 462 aa, Silicibacter pomeroyi DSS-3
MATYDVIIIGAGPGGYVCAIRCAQLGLKTAVVEGRETLGGTCLNVGCIPSKALLHASHSLHEAQHNFAKMGLKGKSPSVDWKQMLAYKDEVIEGNTKGIEFLFKKNKIDWIKGWASIPAAGKVQVGDDTHEAKNIIIASGSEPASLPGVEVDEKTVVTSTGALELGKIPKSLVVIGAGVIGLELGSVYARLGAEVTVVEFLDVITPGMDGEVQKTFQRILKKQGLTFVMGAAVQKTEIARGKAKVTYKLLKKDTEHEIEADTVLVATGRKPYTAGLGLDKLGIEMTQRGQIKVGKDWQTNVPGIYAIGDVIEGPMLAHKAEDEGMAAAEQVAGKHGHVNYGVIPGVIYTTPEVANVGATEESLKAEGRAYKVGKFMFMGNGRAKANFASDGFVKILADKETDRILGAHIIGPAAGELIHEVCVAMEFGASAEDLALTCHAHPTYSEAVREAALACGDGPIHS

SEQ ID NO: 17790 - protein, 398 aa, Silicibacter pomeroyi DSS-3
MVPTLGESVTEATVSTWFKKVGDSVAQDEMLCELETDKVSVEVPAPASGVLTEIVAAEGATVNASAKLAVISGSASGASPAPAAPAAAVTPAVATGKDIANAPSAEKAMAEAGITPAQVTGTGRDGRIMKEDVTAAVAAAAAAPAPAAAAPAPAAAPRAPALAEDAAREERVRMTRLRQTIARRLKDAQNTAAILTTYNEVDMTEVMALRNTYKDAFEKKHGVRMGFMSFFTKACCHALKEVPEVNAEIDGQDIVYKNYVHMGVAAGTPQGLVVPVIRDADQMSFAEIEKAIAEKGKRARDGKLSMAEMQGGTFTISNGGVYGSLMSSPILNPPQSGILGMHKIQDRPMVINGEIKIRPMMYLALSYDHRIVDGKGAVTFLVRVKEALEDPRRLLMDL

SEQ ID NO: 17791 - protein, 444 aa, Moraxella osloensis
VDCQVLVLMRHFRSSDYAVMLQELAPEARHQSYHNLELVQLPNLKRVIWIDSPESTEDFSYMQKFSAWIAEGDADDPAVAERAKKLNPNNPINIQFTSGTTGTPKGATLTHRNILNNGYFIGEAMNLTADDRLCIPVPLYHCFGMVLGNLAILTHGGTIVYPNDGFDPITVLETVQKEQCTGLHGVPTMFIAELDHPDFANYDLSTLRTGIMAGSSCPIEVMRRVIDQMHMKEVTIAYGMTETSPVSCQTNQHTPLEKQVSTVGLVQPNLEVKIVNPETGETLGIGETGELCTKGYSIMLGYWNDTNKTAEAIVDGWMYTGDLATMDEEGYVKIVGRSKDMVIRGGENIYPVEIENYLYRHPKIRDVQIVGVPDKKFGEVLAAWIIPKKDSNLTEQDIRDFCKDHIAHYKVPTYMKFVDEFPMTVTGKIQKFKIVEAMTQELGL

SEQ ID NO: 17792 - protein, 297 aa, Lactococcus lactis subsp. lactis Il1403
MSAKETIEKLQNARIITALVTPFKENGQINFGAFPKLIEDLLANHTEGLILAGTTAESPTLTHDEELAIFAAVNKIVDGRIPLIAGVGTNDTRDSVEFVKEVAELGYIDAGLAVTPYYNKPSQEGIYQHFKAIATASDLPIILYNIPGRVVTEIQVETILRLAELENVIAIKECTNTDNLAYLIEKLPKDFLVYTGEDGLAFHTKALGGQGVISVASHILGQEFFEMFAEIDQGSIQKAAAIQRKILPKINALFSVTSPAPIKTVLNAKGYEVGGLRLPLVACTTEESKIILEKIGN

SEQ ID NO: 17793 - protein, 116 aa, Staphylococcus epidermidis ATCC 12228
MSNHKLIEAVTKSQLRTDLPTFRSGDTLRVHVRIVEGSRERIQVFEGVVIKRRGGGISETFTVRKISSGVGVERTFPLHTPKIEKIEVKRRGKVRRAKLYYLRSLRGKAARIQEIR

SEQ ID NO: 17794 - protein, 448 aa, Arabidopsis thaliana
MADSKSGDTEVAHRSSDPSEKRGGWITLPFMLALALVIIGSAGTRFTLAAAGANQYKKPKEQGRFFNWFFLALYIGAITGTTAIVYTQDNASWKLGFGLCAVANLISFIVFIAGVRFYKHDKPLGSPYTSLIRVLVAATMKRKAVISSKDEDYHQYGLGKEAKTYTTMPSKSFRFLNRAALKNKEDLNTSGDSSNNMWRLCSVQEVEDFKAILRLVPLWAAVMFLSTPVAVQMSMTVLQALVMDRKLSPHFEVSAGSLQVIVLVFGCVFIMLNNWIIYPMYQKLIGKPLTPLQQVGIGHVFTILSMAISAVVEAKRLKTVENGGHPMSVLWLVPALVMVGIGEAFHFPANVAVFYGEFPESLKNTATSLTSVVIGISFYLSTAVIDVIQRTTSWLPNDINHGRVDNVYWVVVIGGVLNLGYFLVCSWFYKYRNLKDDDHEQDPKDVKT

SEQ ID NO: 17795 - protein, 658 aa, Lactococcus lactis subsp. lactis Il1403
MFDTTDQLAVNTIRTLSLDAIQKANSGHPGLPMGSAPMAYVLWSKFLNVNPKTSRKWSNRDRFVLSAGHGSAMLYSLLHLAGYNVTTDDLKGFRQWQSKTPGHPEVNHTDGVEATTGPLGQGIANAVGMAMAEAHLAAQYNKPGFDIVDHYTYALNGDGDLMEGVSQEAASLAGKLKLGKLILFYDSNNISLDGDLSMSFIDDIQKRFESYGWQHLLVKDGNDLEEIAAAVEVAKAEKSKPTIIEVKTVIGFGAEKQGTSAVHGAPLGAEGVAFAKKAYGWDYPEFTVPEEVSKRFLETTVARGEAMEQVWRSTFDDYSEKYPELAEQYAKAFENETPELTLTKHEMETSKASRVTSQEAIQELSAQMPNLWGGSADLSASNNTMVKVEEDFMPDNYAGRNIWFGVREFAMGAIMNGIALHGGTRVYGGTFFVFSNYMLPSVRMAALQSLPVTYVWTHDSIAVGEDGPTHEPVEQLASVRSIPNLDVIRPADGNEVVAAWRRAASSKSRPTALILTRQNLPVLPDTYELAEEGLNRGAYILSKEEGKLEGIIIATGSEVALALEAKKTLGSGIRVVSMPSMNIFDEQEAAYREEILPKDVRRRLAIEAGTSYGWGKYVGLDGATVTVDTWGASAPANIVLPAYGFTAENVVKAYKELD

SEQ ID NO: 17796 - protein, 356 aa, Crocosphaera watsonii WH 8501
MESLKLLEKINQSSALSPSEIETLLQEELQDKSFCNIFNINPENGREKINNRLDLLGKSYHLIAQYCHDLGFNTLDIMSFMWKLLLPLAVQLSQEKSQQKSPLIQGILGGQGTGKTTLSKVLCLILKQLEYTTITISIDDFYKTYSERQKLREIDPRLIWRGPPGTHDIELGIKILNQLKYPNHLSPISIPRFDKSLWNGQGDRKEPEMINKKPDIILFEGCFLGVQPINETQFHDAPLPIKTEEDRQFAKDINEKLKAYLPLWEKLDRLIILYPKDYRFSKQWRKEAEQKMILSGKTGMDDQEVEDFVNYFWKALHPELFITPLAQNPTLVDLVITIDNNHHPQQVDSHLKLTKD

SEQ ID NO: 17797 - protein, 448 aa, Oenococcus oeni PSU-1
MSLIASIYAREVLDSRGNPTVEAEVYSEDGFFGRGIVPSGASTGEHEAVELRDGDKSRYLGKGVTKAVANVNGAIAEALIGKFDVADQRGIDLAMIALDGTPNKGKLGANAILSVSIATARAAAEEAGLPLYQYLGGPNSYVLPTPMMNVINGGVHSDNKVDFQEFMIMPVGAKTVKEAIRMGSETFHNLKKLLEADGKNTSVGDEGGFAPDFANNEEPLQYLVKAIQAAGYKPGKDIALATDVAASELYDADTKKYKLKWSTGEEFTAPEFEKYIEGLVAKYPIVSVEDPLDENEWDDWVEVTKELGKKVQIVGDDFFVTNTDYLKRGIEMGAANAILIKLNQIGTLTETFEAIEMAKEAGYTAIVSHRSGETEDTTIADLVVATNAGQIKTGSMSRTDRIAKYNQLMRIEDELNQGEPEGVSIYKGINSFYNLNADAKKEIQSHQG

SEQ ID NO: 17798 - protein, 316 aa, Lactococcus lactis subsp. lactis Il1403
MTEFITLGEPLVVLASENQDISLDVAEHFSKYLAGAELNVAIGLSRLGHKGIYLSKVGEDSFGNFIIESVKKAEIETTYLTKDKNYSTGFYLKQKVSEGDPKVDYYRKNSAAANLSIAELKALDLSGIKIAHLSGIFPALSETSLKTFQAFNQKLNEADILTIFDPNLRPVLWDNQEKMIRTINDLAKQSQIILPGINEGEILTGSSEPEKIANFYLEQSPLTKIVVVKLGADGAFVKLKNGEQYFVSGFKVAKVVDTVGAGDGFAVGLESALLEGKTLKEAVKRACAVGALAVQSSGDSEGYPTKEELKAFYKEM

SEQ ID NO: 17799 - protein, 323 aa, Aspergillus oryzae
MEECEVEVSKLAGAKSSGNHRDADWTAGTKCAQSLRVAASGNHLNSRTRPYKIIVAQFLLPHTSSRLDPPGSSNNYRIFLKLLSFHSTGGNTSKAYRIPHLSPTAMASTNSGITTDAATGERYIPSSVRADGSKRREIRVRPGYRPPEDVELYKNRAAQAWKNRGNTGVPGAESLKNENESPAKTGTAASNKNAKRREAKKKAKAAQEGTATTEGKNVTEIDNWRAPASGADKKQSNGPDKATGGSEETVDLEAENEKKARNLKKKLRQARDLRDKKNQGEALLPEQLEKVIKIQELIRQLDALGFDSNGDKKDDSAEKEEKV

SEQ ID NO: 17800 - protein, 597 aa, Aspergillus oryzae
MRLPCVPSCALRGVRTPLAFARIGQRYSSTYDAAVIGGGITGLTAAYRLSQDPNCSKITLYEKAPRVGGWLLSEKIPVEGGNVVFEYGPRTLRTAVPSCLPLLDLLVELGLHDDVLLTSSSSPAARNRYIYYPDHLVRMPAPDPNAGPIENITNPLFAMLREPVFEGLIASALLEPVRAPPDHKTFNSDESVADFVSRRLCPEVADNLVSALFHGIYAGDISRLSAQTLLGTFRDLENDDRRVIGGYINSLMSDVKLMAMDDLLALESVAHEKPGMYWKSLRTLVNKTSVLTLKDGLSQLSDALVDALKKSKKVDVLANTDVKSITQNPMTDDLIVGSGQDRSRIHNRVIATIPAPELANKLATTTVKDQKVPQSTIRNLQEHNYAVTVMVVNLYFPNPDLLPVSGFGYLIPRSIPYEQNPERALGVIFGSDSSVGQDTAPGTKLTVMMGGHWWDGWKESDYPDHDTAVAMSRALLHRHLGITDAPTLTSSRLQRNAIPQYTVGHLSRMRELSRSTRHELNNRLTLAGSWYNGVGVTDCIRQGYLAASFGVGARKLGPGDGDRPWRRFDYEKWELEGGIVTSPVRWAEVYRTERKHF

SEQ ID NO: 17801 - protein, 338 aa, Morganella morganii
MIMKALVLEKAGKIAIQDWQSNEVLGDDDVEIKIHTVGICGSDVHYYQHGRIGPFVVDEPMVLGHEASGVITAAGKNVKHLKVGDRVCMEPGIPDLQSPQSRAGIYNLDPAVRFWATPPIDGCLRESVIHPAAFTFKLPDNVSFAQGAMVEPLAIGMQSATKAGIKPGDIGLVIGAGTIGIITQSALAGGCSDVIICDVFDEKLKVAEKYQGLHAVNSKDQQALADKVRELTGGEGVNVLFECSGAKPVIASISDHIAPGGTAVLVGMPIDPAPLDIVAAQAKEVTFKTILRYANMYPRTIRLLSSGKLNVAPLLSATYKFKDSVEAYERAAEPVRLM

SEQ ID NO: 17802 - protein, 321 aa, Spirogyra sp. SAG 170.80
KIGINGFGRIGRNFLRCWYEREDSPIEVIAVNDSGGVKNAAHLLKYDSMLGTFKADVKIVDDKTISVGGKNILVVSSRDPLQLPWAELGIDIVIEGTGVFIDTPGAGKHLTAGAKKVIITAPAKGNEIPTYVCGVNADEYSHEAANIISNASCTTNCLAPFVKVLDEEFGIVKGTMTTTHSYTGDQRLLDASHRDLRRARAAALNIVPTSTGAAKAVALVLPNLKGKLNGIALRVPTPNVSVVDLVINTEKKGMTAEEVNAAFRKAADGPMKGILGVCDLPLVSIDFRCSDVSSTIDSSLTMVMGDDMVKVVAWYDNELGY

SEQ ID NO: 17803 - protein, 533 aa, Ostreococcus tauri
MSRAQVSLAPARVADRRRVGRTRAARRAVAVRASTVERDVVIVGAGVSGLSTAFTLAKKTMPNASVMVTEARDRVGGNITSKSDGTYTWEEGPNSYQPGDAILTLACDAGMRDDILLADPASNRYVLWDGKLRILPHSIESAVLGDFLTWPGKIRAGLGAIGIRPPAPGKEESVKEFVSRNLGTEAFERLIEPFCSGVYAGDPASLSSVAATGRVQRLEPLGGSLVVGALKAQAEAAKAKKESGFKRDPRLPEVKGQTVGSFRGGLKTFPEGLAKQLGDDVVKCNWKLVNVNKAAEGGYTCEYDTPEGRRTVIAKCLLLTAPAYVTAEIVKDMAPAASTALNKFYYPPVASVTVSYKKDSFRLDGTSALPEGGLTGFGQLHPRSQGIRTLGTIYSSSLFKDDKRQPDDEFMILNYIGGARDVAIKDLSEDELVQQVHEDALKTILKPGTPLPKVVGVKLWEKAIPQFNLGHLDVLAEAENALEAAACGEKDGLFLGGNYTAGVALGRCVEFGVEQADEVATFLKSAKKLTAAV

SEQ ID NO: 17804 - protein, 433 aa, Clostridium difficile 630
MNYTTQMDAARKGIITKEMEIVSQKEQVDVNELRELIANGQVVIPANKNHKSLSAEGVGKNLRTKINVNLGISRDCKDIEKELEKVRVAIDMKAEAIMDLSNYGKTREFREKVVEMSPAMIGSVPMYDAVGYLEKELKDITEEEFLNVIRQHAIDGVDFITIHAGLTRSVCQKIKNHERLTHIVSRGGSLLFAWMELNNKENPIYTNFDKILDICEEYDVTLSLGDACRPGCIKDSTDGVQIQELVVLGELTKRAWERNVQVMIEGPGHMAIDEIEANVVLEKRLCHGAPFYVLGPLVTDIAPGYDHITSAIGGALACAKGVDFLCYVTPAEHLRLPNLDDMKEGIIAAKIAAHAGDIAKNVKGAREWDNKMSKARADLDWCEMFRLAIDPEKAKRYRDESTPTHEDSCTMCGKMCSMRTVKKILNNEELNLI

SEQ ID NO: 17805 - protein, 532 aa, Rhodococcus sp. RHA1
MTPLKFLERSAEVHPNKTAVVDGGRRISYSDLASIVTRLAHGLRRSGVGPGDRVAYLATNSAELLAAHYAVPLIGAVLVAINTRLSPPEIEYICNHSEAVLLLGEPVFLEQLQDTSLLTVRETVQLPQQDGGYVDTAQSHLTYDALMARGSEERLPWEVDDETRTISINYTSGTTGRPKGVMYTHRGAYLNSLSQIHHQHFDIDTKYLWTLPMFHCNGWCGPWAVTAASGTHVCIRVVRGDAMWSLIDSEKIDHMSGAPTVLTTLATADGAHPLDRSMTITTAGAPPSPTTIRAVRALGAEIVHVYGLTETYGPCAVCEPQADWAALDEDTLARLLARQGVGMLASGPVRVVRTQRGPHGELVDVASNGTEIGEIVMRGNIVMKGYFGDDSATAEAFSGGWFHSGDLGVMHPDGYIQLMDRAKDIVISGGENISTIEVEQVLMSHPSVLDVAVIGVPDTKWGERPKAFVVLKTNSTVSDCDLTQFAREHIAAFKAPREIVFLPELPKTSTGKTRKNELRDREWHGERERIRG

SEQ ID NO: 17806 - protein, 739 aa, Oryza sativa (japonica cultivar-group)
MGGGGGGGFFVLLMLGAVYTLHATALPSPAPHPSGSPDTRILGPRISPAFSPRAMSPESTGGPVHPPSHKHHRRPYHPHSPSPSPLPQGCTDNCSDPMTTTPIGSPCGCVLPICVIVDLDVAPYLLFMRIAELEVEVAAGTFLKQSQVKIMAAIPSIQDDQKTRVTIYLVPLREQFDGYTASLISDRFWNNKIQINSSIFGDYEVINVTYPGLRSPPPSLPETSHGSDPTGTGEDPITADVHHGKNKKLDSWIIVVVAGSSITLIAACIGLGVLLLKWYKLRQLQEAVSPATTPAVNRRYGGRSTLSVSRVSSASASMLSTVATCTTSVKTFSLSQLEKATDGFDSKRVLGQGGFGRVYHGTMDGGDEIAVKLLTREDRSGDREFIAEVEMLSRLHHRNLVKLIGICIEHNKRCLVYELIRNGSVESHLHGADKAKGMLNWDVRMKIALGAARGLAYLHEDSNPHVIHRDFKGSNILLEEDFTPKVTDFGLAREATNGIQPISTRVMGTFGYVAPEYAMTGHLLVKSDVYSYGVVLLELLSGRKPVCMSDTNGPQNLVTWARPLLCHKEGLERLIDPSLNGNFNFDDVAKVASIASMCVHNDPSQRPFMGEVVQALKLIYNDAEAACDDSYSHRDSSCDQYDDYHGALALDSGSGSWWNRSSNPSGFFDNRNPLPVITMEYSSGRIEGARDPRFALSTGGHAQSPALQNRSGPIRMKKKLASFYRSRGSFSEHGQLPRH

SEQ ID NO: 17807 - protein, 411 aa, Vitis vinifera
MNALAATNRNFRHASRILGLDSKLEKSLLIPFREIKVECTIPKDDGSLATYVGFRVQHDNARGPMKGGIRYHPEVDPDEVNALAQLMTWKTAVVDIPYGGAKGGIGCTPKDLSMSELERLTRVFTQKIHDLIGTHTDVPAPDMGTNAQTMAWILDEYSKFHGHSPAVVTGKPIALGGSLGREAATGRGVVFATEALLAQHGKSIKGLTFVIQGFGNVGSWVARLIGERGGKIIAVSDVTGAVKNQNGLDIVDLLRHKEETGCLTNFSGGDHMDPNELLTHECDVLIPCALGGVLNKENAADVKAKFIIEAANHPTDPEADEILSKKGVVILPDIYANAGGVTVSYFEWVQNIQGFMWEEEKVNNELQKYMTKAFHNIKAMCQSHNCSLRMGAFTLAVNRVACATTLRGWEA

SEQ ID NO: 17808 - protein, 1006 aa, Saccharomyces cerevisiae
MTAQFISVVIQSLVIGSLFYEIPLTTIGSYSRGSLTFFSILFFTFLSLADMPIAFQRQPVVKKQSQLHFYTNWVETLSTTVFDYCFKLCLVIVFSIILYFLAHLQYKAARFFIFLLFLSFYNFCMVSLFALTTLVAPTISVANLFAGILLLAIAMYASYVIYLKNMHPWFVWIAYLNPAMYAMEAILSNELYNLKLDCSETIVPRGPTYNDVPFSHKACAWQGATLGNDYVRGRDYLKQGLSYTYHHVWRNFGIIIGFLVFFIACTLFASQYIKPYFNKDEIERNNSRLTRWLPFLNKKRGTRSSARNDSKYVGIPKSHSVSSSSSSLSAVPYQISPSNKEMALNDYNEQPITETVETQKHIISWKNINYTVGTKKLINNASGFISSGLTALMGESGAGKTTLLNVLSQRVETGVVSGEILIDGHPLTDEDAFKRSIGFVQQQDLHLDLLSVKESLEISCLLRGDGDRAYLDTVSNLLKLPSDILVADLNPTQRKLLSIGVELVTKPSLLLFLDEPTSGLDAEAALTIVKFLKQLSLQGQAIFCTIHQPSKSVISHFDNIFLLKRGGECVFFGPMDDACGYFMSHDNTLVYDKEHDNPADFVIDAVGNSNSSAGKDTAEEALTLNKEAIDWSALWESSVEKKLVKKETARLEDDARASGVDYTTSLWKQPSYLQQLALITRRQYICTKRDMTYVMAKYCLNGGAGLFIGFSFWHIKHNIIGLQDSIFFCFMALCVSSPLINQIQDKALKTKEVYVAREARSNTYHWTVLLLSQSIIELPLALTSSTLFFVCAFFSCGFNNAGWSAGVFFLNYMLFAAYYSTLGLWLIYTAPNLQTAAVFVAFIYSFTASFCGVMQPYSLFPTFWKFMYRVSPYTYFVETFVSILLHNWEIKCDMSEMVPGQPLTGQSCGQFMEAFIEEYGGYLHNKNTFTVCAYCTYTVGDDFLKNENMSYDHVWRNFGIEWAFVGFNFFAMFAGYYLTYVARIWPKVFKIITKVIPHRGKKPVQN

SEQ ID NO: 17809 - protein, 480 aa, Oryza sativa (japonica cultivar-group)
MAEEQSKAQAGAKALSEPVRVGGSAAEATLSGGELAWRPTGGGGGGGEAGRLELESEVLGVRVDGRALRVATFARGDDAAAAAARPATCGGGERRREREREREVVVEMESEEAAAAWGDAMRDRLASLRPKRLFIIVNPYGGKRGGRKIFQTEVLPLIEAAGILYTMQTKHRLHAQEIAHSLDLRKYDGIVCVSGDGVLVEVVNGLLQREDWNTAIKIPLGIIPAHKRPLDVTSVVQGKTRFFSVLMLTWLVADIDIESEKYRWMGSARLDFYSLLRVVSLRRYNGRVLFVPAPGYEGLGDLVEQISSCKSNGASTGVQEDRSNDFNDETCAYAGPSIDETDHEWRSLDGPFVSVWVSGVPFASENVMTAPEAKFGDGYLDVAIIKDCPRSALAGLMFQMKDGSYVKSPYVEYFKVKALRIEPGMRVGSTTKGGIIDSDGEVIARGDGSHTGDEIEHLMAYGPPIQLTVDQGLATIFSPR

SEQ ID NO: 17810 - protein, 175 aa, Medicago truncatula
MSVTSSIPCIKIPTTHSSSSSCSTSSYSFRFSSSKLYAVTIRNVQNDGPLRRPAAPSVKEPSNLPQPLKPSPPSQPPPPQPQKTSSFVGDDKSVVSLEFQRQKAKELQEYFKKKKLEQAADQGPFFGFIAKNEISNGRWAMFGFAVGLLTEFATGSDFVDQVKILLSNFGIVDLD

SEQ ID NO: 17811 - protein, 419 aa, Bacillus subtilis subsp. subtilis str. 168
MDMNEHRNRRLKLIMISATFGGLLFGYDTGVINGALPFMARPDQLDLTPVTEGLVTSILLLGAAFGALLCGRLADRDRRRKMILNLSFLFFLASLGTALAPNVFIMAVFRFLLGLAVGGASAMVPAFLAEMAPHEKRGRMVTQNELMIVGGQFLAYVFNAILGVTMANTGHVWRYMLVICAVPAIMLFASMLKVPESPRWLISKGKNSEALRVLKQIREDKRAEAECREIQEAVEKDTALEKASLKDFSTPWLRRLLWIGIGVAIVNQITGVNSIMYYGTQILKESGFGTKAALIANIGNGLISVIAVIFGIWLVGKVRRRPILLIGLAGTTTALLLIAIFSIVLDGSMALPYVVLSLTVLFLAFMQGCVGPVTWLVIAEIFPQRLRGLGSGISVFFLWILNFVIGFAFPILLSSVGLS

SEQ ID NO: 17812 - protein, 207 aa, Medicago truncatula
MAKKRKSIATTLDEVDRTMYASFCSAANSLSQLHMQALNHQKLSFQAGQRHGLEKLYQWIWRQQEGGSRVATVDILNYIQNELDYFGEEQSTSPRAPLQHQQLQPAVHVASSGFPVTSGSSCQTVIGQGLRSENWDNQSKSFEFSNASSNSVHRSLEHYQIGEGGSYLSSPSMGSESLNSESSFLHQQRRDSTGFNSNDSTMDMHSD

SEQ ID NO: 17813 - protein, 438 aa, Penicillium chrysogenum
MPISKIHARSVYDSRGNPTVEVDVVTETGLHRAIVPSGASTGLHEVVELRDGDKTKWGGKGVLNAVKNVNDVIGPALIKENIDVKDQAKVDEFLNKLDGTPNKGKLGANAILGVSLAVAKAAAAEKGVPLYAHISDLAGTKKPFVLPVPFQNVLNGGSHAGGRLAFQEFMIVPDTAPTFSEGLRQGAEVYQELKALAKKKYGQSAGNVGDEGGVAPDIQTAEEALDLITEAIEQAGYTGQIKIAMDVASSEFYKEDAKKYDLDFKNPESDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADGWGVMVSHRSGETEDVTIADIAVGLRAGQIKTGAPARSERLAKLNQILRIEEELGANAVYAGEKFRTAVNL

SEQ ID NO: 17814 - protein, 294 aa, Zea mays
MEQYEKVEKIGEGTYGVVYKALDKTANETIALKKIRLEQEDEGVPSTAIREISLLKEMNHGNIVRLHDVVHSEKRIYLVFEYLDLDLKKFMDSCPEFAKNPTLIKSYLYQILHGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRILGTPNEQSWPGVSCLPDFKTAFPRWQAQDLATVVPNLDPAGLDLLSKMLRYEPSKRITARQALEHEYFKDLEVVQ

SEQ ID NO: 17815 - protein, 294 aa, Zea mays
MEQYEKVEKIGEGTYGVVYKALDKTANETIALKKIRLEQEDEGVPSTAIREISLLKEMNHGNIVRLHDVVHSEKRIYLVFEYLDLDLKKFMDSCPEFAKNPTLIKSYLYQILRGVAYCHSHRVLHRDLKPQNLLIDRRNNALKLADFGLARAFGIPVRTFTHEVVTLWYRAPEILLGARQYSTPVDVWSVGCIFAEMVNQKPLFPGDSEIDELFKIFRVLGTPNEQGWPGVSCLPDFKTAFPRWQAQDLATIVPNLEPAGLDLLSKMLRYEPSKRITARQALEHEYFKDLEMVQ

SEQ ID NO: 17816 - protein, 748 aa, Cryptococcus neoformans var. neoformans JEC21
MFVLKSLLGKMWGNPANPELIQIPAGLLYLVRPDSIKGSRECIFQDAVATIRRTGTEYQYQLVVTRAYEEGEEQLLDEDAETDDERVFLIDQSLQFRFGTLDGDATCSWKDLSGEEGDLWEFVSSKSVPRATNSLFELTLLHCMFERKYLRSHEEATDEQLQALKYTEEHDTLKTAARPEDITVEDQLSSLGLEDPEDPFQDVPILHRASADLYVFDTETELFVIQGSNVSADLAENAEFDTWIIVRQGTTPFISAPVDAELNAHFDMANHAFMFTFREGDGVPAMTWCLRFKADCFCEWKDKFTIYMWEGKNKVKYAKAKADEQKYIQEAYEDIEMAEPEEEEVNEDGGEIEGEEGHEDSAHEDEDNDSGEESFAQGSKNQHLAVGYKNDLSYVTRGDMIGVFAHNGDRLKFRTAIDRIKNVQGKTFSPHKMMLHNQDSDMLLLDPSNKGSVYRMDLEYGKVVDEWKVSDAVAVNNIIPDTKYAQMNPQQTLIGHSHNGVFRIDPRVSGNKLVESQFKQYASKNDFSAATTTESGKLVVASNKGDIRLFDQIGKNAKTALPALGDPIIGVDVSADGRWLVATCKTYLLLIDTLIGDGRYKGSLGFDRSFPAESKPIPRRLQLKPEHVAYMEDPVSFTPARFNTGINEAEKSIVTSTGNYVITWNFRMLKQGRTDTYQIKRYDSRVVADNFKFGADKNIIVALEHNVLVANKKDMAKPTRSSLAPNTLLSTPARKIHQSHNDIVNSPY

SEQ ID NO: 17817 - protein, 699 aa, Debaryomyces hansenii CBS767
MTVSSKQHLADQGQIHDKVLKVFRLLIADLVQNFNGGHPGGAMDMAAIGIALWRYVLNYAPNNPTFFNRDRFVLSNGHTCLFQYAFHHLVGYQHMTMKQLKTYHSPNLESYCPGHPEIEHPGIEVTTGPLGQGITNAVGLAIASKNLQATYNKPEFPVVSNHTFCIVGDACLQEGVALESISFAGHLGLNNLTAIYDNNQISCDGSVDLTNTENIGEKFKACNWNVIEVENGCYDVIAIVNALESSKKSENKPTLINVYTNIGIGSNVEGKAAAHGAAFGETEVDRLHRVNGFRPEDKFFIPKDVYTFFEDLPAKGDQIVNDWLRLVKSYKESYPDLGTDFERRISGKLPCDWESLIPASFPTNPTASRKSSGLVINPLAKEINNFIVGSADLSPSVNLVWEGKKDFQNPRIKVSCNINGDYSGRYIHYGIREHAMAGIANGIAAFNEGTFIPITSSFFMFYLYASPAVRYGALSKLQVIHVATHDSIGTGEDGPTHQPIALAALYRAMPNINYIRPCDSEETAGAWEIAIKSQGMPTIISLSRQNLPQYPGMSNRSLVKKGAYIFQERIDAVLNIVGVGAELKFALETANILNEKGIKTRVISFPSHNLFEMQPDEYKRSILKRGKIPTVVIEAFAPNGWERYATAGINMKTYGKSLPGAAAYEYFGFNSTVIASKVEKYFSRWNQEHEIRYEFLDLN

SEQ ID NO: 17818 - protein, 323 aa, Bacillus cereus ATCC 14579
MNNMKLQLMYSFLRSDINVIEKELKKTVASEQPLVEEAALQLIEAGGKRIRPVFVLLAGKFGDYKLDAIKHVAVALELIHMASLVHDDVIDAAFLRRGSATVNAKWGDRIAMYTGDYLFAKSLECITNIEIPEAHQALSHTILEVCKGEIEQIKDKYNYDQNLRTYLRRIKRKTALLIAASCQLGAIAAGANRDTVNRLFWYGYFVGMSYQIIDDILDFVSTEEKLGKPAGGDLLQGNITLPALYAMEDPVLRQKITSVHENSTASEMQEIIDAVKNSTAIDQAFAFSERYLHKALEIIKPLPRGKAKYALQNVAKYIGKRKF

SEQ ID NO: 17819 - protein, 148 aa, Bacillus cereus ATCC 14579
MEKTFLMVKPDGVQRAFIGEIVARFEKKGFQLVGAKLMQVTPEIAGQHYAEHKEKPFFGELVDFITSGPVFAMVWQGEGVVDTARNMMGKTRPHEAAPGTIRGDFGVTVAKNIIHGSDSLESAEREIAIFFKEEELVDYSKLMNEWIY

SEQ ID NO: 17820 - protein, 319 aa, Oryza sativa (japonica cultivar-group)
MAGGVSSVEVVKDGATGLEKLVLREAHGCSVQVFLYGGQVIFWENEYREQLLFVSRKSSYVFQEFCLPCNTQNGRSIMQFGNHGVLEQHGFARNRLWSVDETPPPFPATTSNCHIDLILKQSPEDLKIWPHSFEFRLRVALSPTGDLMLTSRIKNTNADGKPFKFGFSYNTYFSVSDISEVRVEGLETLDYIDNLQCGKRCTEQGDAVVFESEAEKVYLSAPPKIVIIDHDKKRTFELRKEGLPDVVVWNPWDRKAKTILDFGEEEYKCMLCVGAANAEKPITLRPGEEWQGRQEISVVPSSYSSGQWDPEIIHRIQDI

SEQ ID NO: 17821 - protein, 220 aa, Arabidopsis thaliana
  misc_feature (21)..(21): Xaa can be any naturally occurring amino acid
  misc_feature (25)..(25): Xaa can be any naturally occurring amino acid
  misc_feature (149)..(149): Xaa can be any naturally occurring amino acid
  unsure (1)..(220): unsure at all Xaa locations
MASSMLSSATMVASPAQATMXAPFXTGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKXEYPNAFIRIIGFDNTRQVQCISFICLQAHQASPVKFPLLLLCKPSKLYPPSLILSLVFLLFSSFLGFNFRT

SEQ ID NO: 17822 - protein, 471 aa, Thermotoga maritima MSB8
MILFGTGGIRGVMRKGEFDEETVKRASLSTALWLKEKGQKSVVIAYDTRKNSKEFAELAGRVFAGEGIEAYVFPEPTPTPVLSFAVRYMKTGGGVVITASHNPPEYNGYKVYTWDGVQAIPEYTNEITEIYKKVDLSHVKEGEIKFVPPEVKESYIKAVLEIVSNLPMKTDLDIAYSPLHGTGANYVPEVLKRLGFKVRLVEEQMKPDPNFSTVPTPNPEEDEALVLLNKKGATLGLATDPDCDRVGVVFKGRRLTGNQVGVLLTDFLLDHVKVENPLVIKTIVTTDMVRPICEEKGAFLEETPTGFKFIGHLIEEHTKKGDRNFVFGFEESCGYLAGNHARDKDGVVGSVLSAVAFSNYDPYEKLEELYQKYGYYMEKLINFKFEDVDRAVEIYRSLKNYDGIIDYSKGYGNVIPNETIAFVFEKSRIFVRPSGTEPKLKVYIHVRGDTREEAEELMKESESKIKEILKL

SEQ ID NO: 17823 - protein, 638 aa, Oryza sativa (indica cultivar-group)
MKLRSPMSRRAPPPVLALPARGWGGRTVVVVGVRDDAEGRELLTWALAMVASAGDRVVALHVATPAAAAAAADQEGAMRMAARRIRATESLAALLRAYHDFCDLNQVPAHRPNTPRRIYRKLVRAATTITREKSQDDAAIAGGGRHLRRNISTPGSAPVSPVVAFTPRQARSPEVTAGWPLLSPDLKSALPEWTEMSVARWAMQLPSRCPAPSPLNPRNNSGDQATSPAITASEIPSPATDEAAEQVAQELASLRNKYSSKYTMFSYSELARMTCNFSPDRIIGKGGASEVYKGCCDDGKEVAVKVLRSSDKVMEELVSEMEIVSSVRHGNAMPLAGFCLDDGGGGAKLMLVYDYMARGSLEEILHGEKEGKDLFGWPERFKVAAGVARALVYLHGGDGDGRPVIHRDVKSSNILVSEDFQPKLCDFGLALWATEAASPVTGDDVAGTFGYLAPEYFMHGKVSDKIDVYAFGVVLLELVSGRKPVSSGGGKGKESLVMWANTIIQGGKLTDLVDPSLPTDGSGVAGEVERMTLAAALCIRRSPQRRPSIANVLKLLDGDGDAVRWARSQAGLSAGDDTDDGDGASPEKKDIQSYINLALLDVDDDSASVSSGGGDFTAANVSLEEYMKGRWSRSSSFD

SEQ ID NO: 17824 - protein, 629 aa, Oryza sativa (indica cultivar-group)
MSRRAPPTMLALPAPPRLGWGGRTVVVGVRDDAEGRELLTWALAMVAFAGDRVVALHVATPAAAAGADQEGAMRMAARRIRATESLAALLRAYDGFCDLNQISLELRICHGSSIKKALVNEASSYGAAHLILGVTNNSRSHLRPSSSPSSSSAAVAKYCAKRVPPSCSVLAVGNGRVVYRRDAAQQQLNQCISPLVETPRRIYRKIYRKLVRAATTITREKSQDDAAIAGGGRHLRRNISTPTSAPVSPVVAFTPRQAEVAAGWPLLSPDLKSALPEWTEMSVARWAMQLPSRCPAPSPLNPRNNSGDQATSPAITASETPSPATDEAAEQVAQELASLRNKYSSKYTMFSYSELARITSNFSPDRIIGKGGASEVYKGCCDDGKEVAVKVLKSSDKVMEELVSEMEIVSSVRHGNAMPLTGFCLDGGGGAAKIMLVYDYMARGSLEEILHGEKEGKDLFGWPERFKVAAGVARALVYLHGGDGDGRPVIHRDVKSSNILVSEDFQPKLCDFGLALWAAEAASPVTGDDVAGTFGFVAAAASSHLLEEFKYLAPEYFMHGKVSDKIDVYAFGVVLLELVSGRKPVSSGGGKGKESLVMWANTIIQGGKLTDLVDPSLPTDGSGVAGEKS

SEQ ID NO: 17825 - protein, 1230 aa, Cryptococcus neoformans var. grubii
MNGFMPALRLHHTHSSSVSPTASNDAASSSPTSSQPHQLAAYSPLYATSPNRGSKITKGSSLSSSTAHHGLKYVRPSTSPLLKPPKGKSFSEYLGDWGSQELFTFLDIHKCGQYLAIFQENDINGKILLDLDVTALKSMGIDKISERVRLIGGIKDLRKRIADETIRAPFIQRCYPPERTLLPSLPSHSNVFLDKWDYSSSASRLGKGQIAFRPPPLDLQGHMPRKLLPHASQGIATIDTHDIRTTKPKIEAYIQQNPLGQPQSVPTKRSDSLTLCAPPSRNVRRRSPSSRHFEGRESQTDGFTILNMASDRQVPSSTMNSVTLGEDCHLQREEGLPLFLKVPQFRNTFASSHKTLIAGRGPLTRGDTISHQPSGPAIAGQDSPVNYRISKTVTTTKEASQGDLEHPFAVKSIGSQLGLLVGVSGMAHDPVTDGSKSKGKTSVPLTGTSSSDISAVNANSAALSLADLRRQLVKFINTEDDTIRTVNVMHVTSGEEILERALKKFGKWGTGMHSSPDVYGDEDGDETLEIDGWEVYTERTPDESSKPLSESSLLKTCTFHREGTAIQDKGLFLRKKQRLQKRKNIQHFFGETLPPPMSPTSPTLITGPHLGIVQGKSQLASEPAFSSSNRLSTLTNKGPNRASMISVMSGLGVPVINTLPSPQGNGLCPTGSVHSHKKKSMYNFFGHRPPSELISNHLADYFPSAKKSDVEKARHSLLRLSGDTVAYKKNGIDEGDNAPDHWSKPGNNQPPSLPPFEPSQDTLSDSLQAYASSTPVYLSRPKHNVALRRRRDSDSSSRSHTSVLMQTRRNRDRSDTASLLTVDEITAEVENRRASTIPKGDYIEETEDSSFIEGDTLPEYEESKGLLRTVCSDSNSIVDSGKSFQRDSDVDQQQELEDEEEDELDDEEEEEEEEKEDEDEQGKAFTSTGSKRIIKWIKGALIGAGSFGSVYLGMDAQSGLLMAVKQVELSAGSVKSEDRKKSMLSALEHEIELLKELQHENIVQYLDSSVDTNHLNIFLEYVPGGSVAALLNNYGAFEEGLVRNFVRQILTGLNYLHMRGIVHRDIKGANILVDNKGGIKISDFGISKKVENSLISGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKDPFIDSPRVRTTASNFISEAIVSEKMEVQVVEEM

SEQ ID NO: 17826 - protein, 245 aa, Glycine max
  misc_feature (228)..(228): Xaa can be any naturally occurring amino acid
  unsure (1)..(245): unsure at all Xaa locations
MERENWREHINSNGNYYDDDGVERSPAKPSSLSSSPPRLAYIDHRVSKFDTLAGVAIKYGVEVADIRKMNNLVTDHQMFALKTLHIPLPGRHPPSPCLSNGSSTPGHGNYDHSPPSQARHDLLDSFESLRIKSSERKVSPAMNSLQGYYGLKGTPSPSEDGPFPRNLPMSDRRLSRHRKSKSLVNVILEEIMEKSDDAPAAETREINSNKWNDKLGQGHQKSVADCTXIPELLLREDIAAGVVLS

SEQ ID NO: 17827 - protein, 511 aa, Cryptococcus neoformans var. grubii
MFARQPLSQNLLRPLSRPSSSFCRTSTIPKLAFLQSARGFASASEPYDVVIIGGGPGGYVAAIKAAQLGFKTACIEKRGALGGTCLNVGCIPSKAMLNNSHIFHQTQHDLKNRGIDVSDIQLNLPKMLAAKEASVKALTGGIETYLFKKNGIDYIKGEASFETANKLSVKLLEGGETQVEAKNVIIATGSEVTPFPGLEIDEERIVSSTGALELKEVPKKMVVIGGGVIGLELGSVWSRLGAEVTVVEYLGAIGAGMDGEVGKQFQKILTKQGFKFKLNTKVVSGHREGDIVKLKVDSAKGGREETIEADVVLVAIGRRPVTTGLNLEAIGVETDKRGRIIIDDEFNTSAKGVKCIGDVTFGPMLAHKAEEEGIAAVEILKTGHGHVNYDAIPSVVYTHPEVAWVGKNEEELKAAGVQYKIGKFPFAANSRAKTNQDSEGFVKFIVEKETDQVLGCHIIGPNAGEMIASATLALEYKASAEDIARTCHAHPTLSEAFKEAALASYDKTINF

SEQ ID NO: 17828 - protein, 106 aa, Glycine max
  misc_feature (83)..(83): Xaa can be any naturally occurring amino acid
  unsure (1)..(106): unsure at all Xaa locations
MATLDSDVTVFPAGEASSSAGPSSSTKKPKRFEIKKWNAVSLWAWDIVVDNCAICRNHIMDLCIECQANQASATSEECTVAWXRWLKTRQVCPLDNSEWEFQKYGH

SEQ ID NO: 17829 - protein, 637 aa, Senecio squalidus
MKTGQNFTLTSWLSNDIPDSGSFTLSWEPVDEASQRLIIRRSHQPYWTSGNLNDQTFQYLYALNSPGSQSHYNLSSVYSNEARYFSYERTNADLPMWILTPKGQLRDSDNSTVWTPEFCYGYESSNGCVESSLPQCRREGDNFSEKNGDFAPDIARSATDDNSSLSISDCFVKCWNDCSCVGFNSSTTDGTGCVIWTGSNNFLVNPRDNSTLKYVISQSPINPSAGNKTEESKTKESKTWIWILLGVVIPLALLCFGLLLYTKIKHRRKEYERRKRDEYFLELTASESFKDVHQLESNGGKGNDLLLFSFSSIMAATNDFSVENKLGQGGFGPVYKGKLSDGREIAIKRLSRTSGQGLVEFKNELILIAKLQHTNLVRVLGCCIHGEEKMLIYEYMPNKSLDFFLFDENRKAELDWPKRFNIIEGIAQGLLYLHKYSRMRVIHRDLKANNILLDENLNPKISDFGMARIFKENETEAMTNRVVGTYGYMSPEYAMEGTFSIKSDIFSFGVLMLEIVTGRKNTSFVHLDRTFNLIGYAWELWQQGDTLELKDPTLGETCGIQQFLRSVHVALLCVQESATDRPTTSDMISMLLNDTISLPTPNKPAFVIGKVESKSTDESKEKDCSVNDMTVTVMEGR

SEQ ID NO: 17830 - protein, 520 aa, Bordetella pertussis Tohama I
MNAMLTFLRLLRILLVSLRYGLDELVLSSLNHPLATCLLRIMRLGTRPRAPRGARLRMALESLGPIFVKFGQVLSTRRDLIPADIANELALLQDRVPPFPSAQAAACIEAALGAPPAQLFAQFDVDPVASASIAQVHFAVLHDGREVAVKVLRPGMLNVIEKDLALLRVVAGVIERLGADGRRLKPREVVAEFDKYLHDELDLVREASNCSQLRRNFGPESGRGEMLIVPEVVWEYTASTVFTMQRMYGIPVGQVDRLRAAGIDIPTLARSGVEIFFTQVFTDGFFHADMHPGNIYVSDAPQTLGRYIALDFGIVGSLSEFDKNYLAQNFLAFFHRDYRRVAQLHIESGWVPPETREEELEGAVRAVCEPYFDRPLAEISLGQVLLRLFQTSRRFNVEIQPQLVLLQKTLLNVEGLGRQLDPNLDLWKTAKPYLEHWMRQRIGLTGLRQSLAKEAGQWSQMLPSLPRLVHEHFSRPNLTPHLLAEMNRLRRAQEQGNRLTAALTAVLAVAVAVALWALSR

SEQ ID NO: 17831 - protein, 565 aa, Magnaporthe grisea 70-15
MTIKSRWQNEIPSCSLQQWIFGSSRGPLEGSKVFIDADRPDTHYLTINEFRLVAKRVAIGLQAAGLKPGDRVLVYSGNSIWFPVVLIGVLMAGGIFTGANPGFVARELAYQLRDSGASFMFAAPVVMDVALEAAAEAKMKPSQIFIFDPEINAKDEEPQYEPDSEGSGTRHWAELLKGTLAKAETWDWVEPANPAEATCCLNYSSGTTGVPKGVEISHSAYVANGDGVTFVMNLDPDLAVNKKSLTHLCFLPMYHAMAQTYFVANYPRRRDPTYIMPYFDFEKMLQHVQNYRINALVVVPPIVVALAKHPLARQYDLSSVENLGCGAAPLGAEAIKECEALWPDGSVKIRQGWGMTEVTCTALGWDPRLEATETTAVGELMPNFYAKLVETDGSDRPITEANKRGELWVSGPTMLKGYWNNPQATNATIVYDKEENRRYLRTGDIAYVERYEAGTPFHVVDRLKELIKVKGNQVAPAELESVLLQRPDIIDVGVVGVTIKGEEYPRAYVVLAPGVKTTGEDIVKWIEPKVAKYKQLKGGVAIVDAIPKNPVRALSYSHTMVFHLW

SEQ ID NO: 17832 - protein, 292 aa, Vibrio vulnificus YJ016
MLSGSIVALLTPFKADGEVDFDGLQKLVEYHIAAGTNGIVAVGTTGESSTLTVEEHVKVVNKTVEFVNGRIPVIAGTGANATHESVTFSRLLNDSGIDACLSVTPYYNKPTQEGLFQHYKAIAEVSNVPQILYNVPGRTAVDLLPETVARLAELENIVALKDATGDLNRVAIHRELCGEDFILLSGDDATGLDFVKLGGQGVISVTNNIAAKDMADMFRLALEGRFEEAEVINQRLMPLHKNLFIESSPIPVKWAATQLGLIECGHLRLPLTELSEKCHPIVAQAMTDAGIY

SEQ ID NO: 17833 - protein, 293 aa, Yersinia pseudotuberculosis
MFTGSIVALITPMDDNGDVDRASLKSLIDYHVASGTAAIVSVGTTGESATLNHDEHVDVVMQTLELAGGRIPVIAGTGANSTSEAISLTQRFNDTGVVGCLTVTPYYNRPMQEGLYQHFKAIAESTDLPQILYNVPSRTGCDMLPPTIARLAKIKNIVAVKEATGNLSRVSQIQVLVDDEDFILLSGDDASGLDFMQLGGKGVISVTANIAAREMVELCALAAQGNFAEGRRLNQRLMPLHQHLFVEANPIPVKWAAKRLGLMANDTMRLPMTPLTDPAKRIVEDALKSAGLL

SEQ ID NO: 17834 - protein, 244 aa, Marinobacter sp. ELB17
MTKVADRKLPNRKLLERIHQAALDLQRQHSDPLCAYIYDLDSLSSHVQAVVEALPPQCEMFYATKANPSLPLLQTLTPWVHGLEVASGGELRWVRDHFPELPVIFGGPGKLVSELKHAVESNVELIHVESLLELERLTEITGKSQQTQEILLRINLNLPEMATTRLTMGGVPTPFGMDEDTLQQALPMLARASHVRLRGFHFHLMSHQLDPDRHLALIQTYCRRVSQWESDYDLQITQINVGGG

SEQ ID NO: 17835 - protein, 541 aa, Sulfitobacter sp. EE-36
MLGQMMNKPLLISSLIEHAQRFHGETEIVSVKTTGGLEQTSWGQVARNARALASALTNLGLDPQARCGTIAWNNRRHLEIYFGASGGGFVCHTINPRLFPEQLVYILNHAEDKVLFIDKTFVPLIAGIQDKLEHLEHVVLMEGTDEEAAAQLPGIKFYDDLIASGDPEFIWPDLDENTASSLCYTSGTTGNPKGVLYSHRSTVLHSFGINLADSIAITAKDVVLPVVPMFHVNAWGAPYACAMVGAAMVMPGPGLDGPSLVKLIDTNHVSLALGVPTIWLGLLNEADKIGSKLESLQRTVVGGSACPPSMMTAFREKYGVETIHAWGMTEMSPVGSINQLLAKHTKLSADAQNKLRENQGRPVFGVDLEILDDDGNPVAHDGVTQGDLVTKGYWILDSYFRKTRSETLNKDGWFDTGDVATMDPDGYVTIRDRSKDIIKSGGEWISSVELENIAIGHPQIADAAVIGARHEKWDERPILIAVKAEGQDPSEAEILSIFEDKIAKWQIPDRVVFTDALPRNATGKVLKRDLRESFGEVLING

SEQ ID NO: 17836 - protein, 529 aa, Sulfitobacter sp. EE-36
MTQFDDLIRMQAAVQDRSILSLFDTADRAQTFSAQTGDMLFDFSKTNLDRDTMDALLGLVDAADVPARRDAMFAGEKINETEDRAVLHTALRNLDGGAVMVDGADVIPGVHDTLDRMRGFADQIRSSDITDVVNIGIGGSDLGPAMAVQALSPYHDGPRCHFVSNVDGAHISDTLRGLDAKTTLVIVASKTFTTIETMTNARTARAWMTENGGDPAKQFAALSTAQDKTSDFGIDADQVFGFEDWVGGRYSVWGPIGLSLMIAIGPRAFDAFLRGGQAMDRHFCAAAPHENMPMLLALVGIWHNQICGYATRAVLPYDQRLGQLPDYLQQLEMESNGKSTLMDGTAAPYHTGPVVWGAAGTNGQHAFYQLIHQGTRVIPCEFLIAANGHEPDLTHHHKLLIANCLAQSEALMRGRSLQEASELMAAKGLTGAELDRQARHRVFPGNRPSTTLSYPLLDPFTLGQIIALYEHRVFVEGVILGINSYDQWGVELGKELATSLQPIVEGAAPATDKDGSTAALVAFIAKHAD

SEQ ID NO: 17837 - protein, 448 aa, Streptococcus pneumoniae TIGR4
MHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIAFPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKIPKNATILTGLASAVAAGMFPLASIAAFLNICTLAYLIMLAYGLIRLRKEKGMPKAGEFKTPLVPLLPILSIIICLSFMLQYNMNTWIAFLVALLVGSIIYFTYGYKHSTIEE

SEQ ID NO: 17838 - protein, 239 aa, Saccharomyces cerevisiae
DGAHIGNYAAAAKVKLAYHTTTGQKVALKIINAAMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLL

SEQ ID NO: 17839 - protein, 249 aa, Frankia sp. CcI3
MYPCADQARPPTGRRRGADGRGGTGRRRRGRRTDRPARSAPGSDRDARRVPAPAPILGGGGRDGSGGRPVARHRCGAGREQNGGVTIRPSALDPAIARRLRRNDAGLFPAVAQQYDTGEVLMLGWMDDEALHRTLTTGRATYWSRSRAEYWVKGETSGHRQWVRSVALDCDGDTVLVRVDQVGPACHTGTRTCFDGNLLPTVTVEAADTARPRDLSGAASVSGAASVSGAAGDPAGVDRAGVSKAGADR

SEQ ID NO: 17840 - protein, 489 aa, Salmonella enterica subsp. enterica serovar Typhi str. CT18
MGSKTKTTEAPALRRELKARHLTMIAIGGSIGTGLFVASGATISLAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 17841 - protein, 479 aa, Oryza sativa (indica cultivar-group)
MASGQKAKQQVMKPMEVSVEAGNAGDAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGVVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSG

SEQ ID NO: 17842 - protein, 475 aa, Oryza sativa (indica cultivar-group)
MASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGVVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWISLKTLSACCLVVSIAAAAGSIADVIDALKVYRPFSG

SEQ ID NO: 17843 - protein, 217 aa, Oryza sativa (indica cultivar-group)
  misc_feature (202)..(202): Xaa can be any naturally occurring amino acid
  unsure (1)..(217): unsure at all Xaa locations
MQGAVSKNMVESLAVPTFRVGYTFTTDALDALYKKIKPKGVTMSALLAKATAMALVQHPVINSSCRDGKSFTYNSSINIAVAVAIDGGLITPVLPDADKLDIYSLSRKWKELVDKARAKQLQPHEYNSVYVKIDSVLIKLQTHYSAFDEMQKKTCTFTISNLGMFGVDRFDAILPPGTGAIMAVGSSQPTLVGTKGGSIGIXEPNLQIIEDPKDLTF

SEQ ID NO: 17844 - protein, 519 aa, Schizosaccharomyces pombe
MLIFVSMAGWMFGADTRSIGGVTSMRDFRERYADRYDPITDQYSLSSARQGLLTGMVNVGSLFGCIISSPIADRFGKRLSIIGFCAVYIIGIIVQVTAVPSWVQIMVAKIWTGIGIGALSVLAPGYQSETAPPSIRGTVVVTYQLFVTGGIFIAACINMGTHKLHKTAQWRVSIGINLLWGIITMIGILFLPESPRYLIQVGKDEEAVRVLSESAELFPDSEEVQNEYHRLKSSIDEEFAGGPCSWASIFGKDIRYRTFLGMFVMSLQQLTGNNYFFYYGFSVMQGAGINSPYLSAMILDAVNFGCTFGGMYVLERFGRRNPLIIGGIWQSICFFIYSAVGSRALYHKNGTSNTRAGAVMIVMACLFIFGFAQTWAPAAYVIVGESYPVRYRSKCAAVATASNWLWNFLISFFTPFIQASIGFKYGYVFASCNLTGAIVIFLFAKETKGLTLEEINELYMSVIKPWESGNFKLNYSEQKKVEKEKSRKGGARGESVEYVERASNTDSSPQYSSHEEDYA

SEQ ID NO: 17845 - protein, 170 aa, Robiginitalea biformata HTCC2501
MNFKDYIRDIPDFPKKGVVFKDITPLLEDPKAFRETAAALLAFTDGLKVDKVVGIESRGFFFAPLLADRLGAGFIPARKPGKLPHRIHRKEYDLEYGTDALELHAESISPGDRILVHDDVLATGGTARAICDLVTELGGEVVQCNFLIELSFLKGRTRLDGFPLKSLITY

SEQ ID NO: 17846 - protein, 881 aa, Phaeosphaeria nodorum
MAPTLLAAIDLGSQSNASQGLDEQALSFVGSVFVRVTDETVDQALAHLQQSVGRYSNYLGVATLTSTDDILSLLDAGAAKVFVTRQQLDTLKSLNIDQDRIVLCLPGNSRSEVIDAISGTQVDVYSHQVHDIDLVEAWLKEYGPDRPNVFVSFSEPNLENSLKLAKLSAIPIIPAQSLTIDEKKDSSLISVAKLVMANATSDRPDGLYTTLVTDERGVALGLVYSSEESVAESLRTGRGVYQSRKRGLWYKGESSGDIQELVSMSFDCDSDCLQFVVRQKGRGFCHLATPTCFGDYRGLSKLQKTLQSRKESAPQGSYTARLFNDAQLLRAKILEEATELCDATTKEHIAFEAADLFYFALTKCVAAGVSLEDVERNLDAKSIKVKRRQGDAKPAFAAQAAAAVNGTSNAATNGASNGVSVETLKEAASVPKSKDDPAGTKDGRIAMKRYVTAQETSETIAAALQRPSQKSTEKIIGICRPIIDAVKTRGDAALLEYTHKFEKATSLTSPVLRAPFPPELMQLAPETAKAIDISFENIRKFHAAQREEKPLVVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGLNEAQLTAIEDELHKQANALPRVDIVRGAIEHSLTLAASTIEEALELSNQYAPEHLILQVANADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 17847 - protein, 74 aa, Arabidopsis thaliana
MVLVLALGDLHVPHRAADLPPKFKSMLVPGKIQHIICTGNLCIRVVFFFLQIFNFYISSMLYFFSLMSLWDHSV

SEQ ID NO: 17848 - protein, 629 aa, Coccidioides immitis RS
MVSPSFVKPSAPSLRLLRFLRSQSDICCFKQNVDHPRPRVSHGNYGFYRNFRLTSDQLGCGGLKSSAVRCPSTLEASLLSFIRPKPRKYSSLLKVSSARPPHLRGGAIRHPASQQISWFSGTSKRNRNFLRRLLGLQVPRPPAHLKPDDLPSSGAFEDGQECNPFTTGRKLALKASNEPRLRCTEFDENGNVTLISEEFKKSELIAKYGLLPRDLRKIDSSVIPHILVRHSAILLSLLHLRVLIKANRVLVFDAYGSADTYTQSLFMYDLEGKLRQKEPASSRQAAALGALPYEFRALEAVLVSVTSGLEAEFEGVREPVVRVLRALEEDIDRDKLRHLLIYSKRLGTFEQKARLVRDAIEDLLEADDDLTAMYLSERSGGVRRDEHDHQEIEMLLESYHKVCDEIVQASGNLVTNIRNTEEIVKAILDANRNSLMLLELKVSIGTLGLAVGTLLSALYGMNLKNFIEESDLGFGAVSAVCFASSAFVCIYGLLKLRRVQRVKMWGEGGIQDPYMGGLGLRGSTPLPSRGNWRSDAIDPAWTGLPVEGRAQRMRRVRGAIGTAASQPSVSLSSHAAAKPKLSGKTSPVNAPQSGNVSNKNQTQKQRQSEPEKDEFEDPTMGGAALGASR

SEQ ID NO: 17849 - protein, 464 aa, Oenococcus oeni PSU-1
MKQAIETIPANKKLKYIKKIAILATFGAFLFGYDTGVINGSLSFMARGDELNLSPFMEGLVTSSLLFGAAIGAVIWGRLADRYGRKSILRVLAIIFFFSTLGSSIAPNSYVLIIGRLFMGLAVGGVAGIVPVYLGEMAPSNIRGSLVCQDQMMIVLGQLLAYVMNGILGNAFNVSYIWRFMIALAAIPAIILWIGTYIIPETPRWLAIEKKSDQALVVLRNTRDDKTADQDLKHIEQNIKKESSRGHASLHDFHTPWIKRILIIGITIAVMQQLAGINIMMYYGTTILEKTGFSTKAALIANIGNGVLSVLGTTIYMFFLANRIKRRLAWIGGFCFTTTILAAIAILSHYAAGLSILPYIVITCTMLFVFVDQMTLGPVCWLLLSEIFPLHVRGLGVGIATFGMWIMDFGVGFFFPILIEIFGLSNTFWIFAVIGVICIIISFFIIPETSGRSLEQLEDSFRRS

SEQ ID NO: 17850 - protein, 458 aa, Oenococcus oeni PSU-1
MKAHHLNIFFIFVFGALGGLLFGFDTGIISGASSLIESDFSLNIEQTGFITSSVLIGSSIGALSVGSLSDKFGRKKLLILASVLFLIGSGLSMSAVGFVSMVIARIILGFAVGSASALTPAYLAELADAPHRGSLGSMFQLMITLGILLAYVSNLGFLGHNLLGLRDWRWMLGSALIPALILFIGSIVLPESPRYLVEKGRIDEARSVLHYLREKTNEDPDKELADIKKVSNQPKGGFKELFTFARPAVIVAIGLMLLQQLVGINSVIYFLPQVFIKGFGFQAGNAIWISVGIGVVNFLCTVLAYNIMDKFNRRTILLFGSIVMSVSIGILSVLNFTLSIKQAAIPTMILIAIYIFGFAVSWGPICWLMIGEIFPLNIRGVGTSIGSAANWIANFIVSQFFLVLLATFHYNVGGPFAIFTFFAILSIFFVIYLVPETRGKSLEQIEMDMRRKPLPKKN

SEQ ID NO: 17851 - protein, 453 aa, Magnaporthe grisea 70-15
MDAYQINFAALIGLCGALFLAQPKAKEAASETKGSKAGENKTKKSADTTDASQWPFLVVFCLVMGSDWLQGPFLYSLYREEHGISASVVSTLFTTGFLSGAVSGYFVGTLADKHGRKAACLLFCAAYAASCLLTTIPSVPLLFAGRVLGGISTSMLFSVFDSWMVTDFQNRKLADKGGDLSRTFGLMSTLNSVTAIISGVFSEWIVAVTGTRKAPFVTSMLLLGVAAYFISSKWAENYGGSAKQEKKKDDKSEVIVDHTNKLSHILTDPKIIALGLASTMFEGSMYLFVFFWSPALNAAKTNDAGLPYGIIFASFMASGLAASLFFNVFMERGLLRYITLMIMILGAADVCFVSLSGTPRSEQSTFWIFCAFEACVGMYWPCMGLLKGKLISDGARAQVYSVLRIPLNLFVVVSLMLTEGDAGYAQVFGACSKLLMFSCLGLGAMVMNEEHLP

SEQ ID NO: 17852 - protein, 566 aa, Bacillus subtilis subsp. subtilis str. 168
MKQFRVTNEGDIQTTLRGLEVLSVPFLNKGVAFTEEERKELGLKGFLPPKVLTIDDQAKRAYEQYSAQPDDLSKNVYLTALHDRNETLFYRLLNDHLGEMLPIVYTPTVGTAIQRYSHEYRKPRGLYLSIDDPDGMKEAFKQYKDQSDTIDLIVATDAEGILGIGDWGVGGIAISIGKLAVYTAAAGIDPSRVLAVVLDAGTNQESLLNDPLYVGNQHSRVRGERYDQFIDDYVALARETFPNALLHWEDFGAKNARSILKRYKDKVCTFNDDIQGTGAVSLAAVLSCAKASKVPLRDHRVVIFGAGTAGIGIAEQLREALVREGLSEEESYKRFWCIDRNGLLTDDMDQLLDFQKPYARSADEVKDYQRNGDGGGIDLLEVVRQAKPTILIGTSTVSGAFTEEIVKEMASHVKRPAILPMSNPTTLSEAKPEDLIEWTEGRALITTGSPFPPVEYNGVTYHIGQANNALVFPGLGLGTIVTKSKLITDGMFEACARAIAGMVNVGVPGAPMLPKVEDLRTVSATVAVEVAKTAMKEGVATEEPEDIIQAVQDAMWYPVYKPIRAI

SEQ ID NO: 17853 - protein, 346 aa, Magnaporthe grisea 70-15
MAVPLMHQTMHSQVHEASDASHEIPTIDISGFRSSPETAQERIETQHVVDRVRSACLTTGFFCLTGHGIPRELQERVLDGAEKFFDMPLEEKLKLVHPTQKNRGYEVLGGQTLQRGAKPDLKEGFYIGKHLDGNDPRVRRHPRLMGPNIFPSGSLEDHEFKNPLETYYEAILALSLTVFKILAKGLPYGDDVFDRFVSDDPVCILRLLHYPPQTSKDPRQLGAGAHTDFGAVTLLYQTAPGLQVKSPSGSGSSGADRWIPVPPNRDAYVVNIGDMLHAWTEGLYKSSMHRVLNLGGSHRYSIPFFFDGNADCPLTPFGKSDDVGAETASEHLLRRLDETYAMAAKI

SEQ ID NO: 17854 - protein, 741 aa, Oryza sativa (japonica cultivar-group)
MAKPNGKEKTGDTGLSMAPPKISKDRFDAAIRAMADIGILKETAAPVLNNLLNLFDYNWVHIEADNYLALADAIFCDSDPKEGQKRQANETNLDADQSNKKLKTKKRSQNPTSKMHGNDNREFVEAPPQQGRGTLSARTVNGKKVTRAHLELPSSQLLIKEPHTCPSIAKNTTIVENNSAVLCHGQDLQTFEVPVATTCPQVVAPSTRKDARRTSGARHDQKHEGVSGAHERNRAVACSNQEIVSSKDSPSNIEVVLSNYGAGKLSFTYNSSLANRSDFHLPDIKLICKKMEARCLRKYKSLEPNFSFKNLIKDTCQCIVESSGPRHEGIIQTVPALDILSKPSVPQILQSNQANSAFMPPNNVMSLGGTSSSCTVAGVSQNSSNMPVVPHQLHIGANRPPHDVNDITKGEERLRIPIINEYGNGILPPPFHYIPHNITLQEAYVNISLARIGDDNCCSDCFRDCLAQSLPCACAAETGGEFAYTTDGLLKGAFLDSCISMIREPLKHPHFYCKICPNERMKIEVNSDSSNTEMNPGPCKGHLTRKFIKECWRKCGCTRNCGNRVVQRGITRHLQVFLTPEKKGWGLRSTEKLPRGAFVCEYVGEILTNIELYDRTIQKTGKAKHTYPLLLDADWGTEGVLKDEEALCLDATFYGNVARFINHRCFDANIIGIPVEIETPDHHYYHLAFFTTRIIEPFEELTWDYGIDFDDVDHPVKAFKCHCGSEFCRDKTRRSKSRARV

SEQ ID NO: 17855 - protein, 195 aa, Frankia sp. CcI3
MARTARIERKTLESDVLVELDLDGTGISSSDTGVPFFDHMLSQLGKHGGFDLTVRTRGDLHIDAHHTVEDTSIAFGSALREALGDKAGIRRFGDATVPLDEALAQAAVDLSGRPYCVHVEPDLVGMIGTYDTTLTRHIFESITASARLALHVRVLSGRNAHHVVEAQFKAVARALRDAVALDARVAGIPSTKGVL

SEQ ID NO: 17856 - protein, 284 aa, Zea mays
ARLLRRTWRPTGAPPRPARVLSCSPPETRDTAHLLRSCLLNSESGSALAKLAPLEAILFDIDGTLCDSDPIHFCAFRELLQQAGFNGGVPITEEFYSANISGGHNDDLARSLFPGMDHQKAMRFMDDKEAMFRKLAPGQLKPVDGLQELCGWMEGRDLKRAAVTNAPRANAELMLSLLGLTDFFPVLVIGSECDRAKPFPDPYLKALQLIGASPQHTFIFEDSASGVRAGVAAGVPVVGLTTRNPGKVLKDAGASLLVKDFQDPELMSVLQQVEVEPAAANAQG

SEQ ID NO: 17857 - protein, 718 aa, Bacillus subtilis subsp. subtilis str. 168
MVSIRRSFEAYVDDMNIITVLIPAEQKEIMTPPFRLETEITDFPLAVREEYSLEAKYKYVCVSDHPVTFGKIHCVRASSGHKTDLQIGAVIRTAAFDDEFYYDGELGAVYTADHTVFKVWAPAATSAAVKLSHPNKSGRTFQMTRLEKGVYAVTVTGDLHGYEYLFCICNNSEWMETVDQYAKAVTVNGEKGVVLRPDQMKWTAPLKPFSHPVDAVIYETHLRDFSIHENSGMINKGKYLALTETDTQTANGSSSGLAYVKELGVTHVELLPVNDFAGVDEEKPLDAYNWGYNPLHFFAPEGSYASNPHDPQTRKTELKQMINTLHQHGLRVILDVVFNHVYKRENSPFEKTVPGYFFRHDECGMPSNGTGVGNDIASERRMARKFIADCVVYWLEEYNVDGFRFDLLGILDIDTVLYMKEKATKAKPGILLFGEGWDLATPLPHEQKAALANAPRMPGIGFFNDMFRDAVKGNTFHLKATGFALGNGESAQAVMHGIAGSSGWKALAPIVPEPSQSINYVESHDNHTFWDKMSFALPQENDSRKRSRQRLAVAIILLAQGVPFIHSGQEFFRTKQGVENSYQSSDSINQLDWDRRETFKEDVHYIRRLISLRKAHPAFRLRSAADIQRHLECLTLKEHLIAYRLYDLDEVDEWKDIIVIHHASPDSVEWRLPNDIPYRLLCDPSGFQEDPTEIKKTVAVNGIGTVILYLASDLKSFA

SEQ ID NO: 17858 - protein, 424 aa, Thermotoga maritima MSB8
MTQMEMARKGVVSDEMKKVAEYEGVDVEIVRQKLAEGRAVLPKNKLHRIERPMIVGEGFSVKVNANIGTSQGFSSLEEEKEKARVAIEYGADSLMVLSTWGDLREIRRAIVEMSPVPVGSVPIYDSAVRSYQMKKNVVDFSEKDFFDMVIAHAEDGIDFMTIHVGVTRRVLDRIKSSRRVLKIVSRGGAIIAGWMIKNNKENPFYEHFDELLDIAKDYDITLSLGDGMRPGAVVDASDAQQFEELFVMGELVERAREKGVQVMLEGPGHVPLNEVEMNVRLMKKIGKGAPIFLLGPLPTDRAMGYDHIACAIGGALAGYYGADFLCYVTPSEHISLPDVEDVREGVIASKIAAIVADVARGNKKAWELEKKMALARKNFDWETMFSLSLGKDVAKKKYEERPYPDKGCSMCGPFCAIKIAEEFS

SEQ ID NO: 17859 - protein, 703 aa, Rhodopirellula baltica SH 1
MTSSNELTFPKQRRQHGFYRIAAVSPKVVVADPAANAAETIQAMDAVVQQSDPDLILFPELGLSAYTCGDLFATQTLLDASLDALRTIVTHSHSCDAAIIVGLPLRVGTSVMNVAALVRGGVIRGLVPKTFLPNYREFYEARHFRAASATDPATVRIDRQDIPFGTDLLFQDGAATLGVEICEDLWVPVPPSSHAAIAGANVVVNLSASNELIGKAQWRRDLVVSQSGRLIAAYAYSSAGGGESTSDLVFGGHCLIAENGALIGESRRIGDTDDEDLPVQTQLIRDVDLQRLDHDRRVVGSFDDFQASLPRPYRTIDVAWAGSKKQSSSTTLLRTGKGNEKDATHSDQSDFNRLLRRVDPHPFVPDDLSKREERCGEILAIQTAGLVKRLQQLPADLPLTIGISGGLDSTLALLVAVSAVDQLKRDRKVIDAIIMPGFGTTQHTNDSATQLVEGLGVTSESIDIRPLALRTFLDIGHSPLGLAIDVSTKIDDLQSRLQKVDVNATDLKFENVQARLRTMLLMSRGFVLGTGDLSEQALGWSTYNGDHMSMYNVNASVPKTLVRYLVQYAADHRYRSSLHETLHRIADTPISPELLPPTEDGEIRQNTEASIGPYELHDFFLYHFVRGGCDVAKMCFMAEQTKFDLPHSAELIEATAKTFVRRFFQNQFKRNCVPDGPKIGSVSLSPRGDWRMPADASSAAFRD

SEQ ID NO: 17860 - protein, 310 aa, Oryza sativa
MAAAAASAAAATAAEDGARLLRLEEQAGHGGGGAWEYLCLARRLRARRPEPVLRLGLALLNDSSARSRLASEQWTLYEQVAVAAMDCQRLDVAKDCIGVLSKQFPGSMRVGRLEALLFEAKGEWTDAERAYALILENNPFDQIVHKRKIAIAKAQGDMALAVEYLNKYLELFMADHDAWRELAETYVALQMYKQAAFCYEELILAQPTVPLYHLAYAEVLYTMGGLENLQTARKYYASTIQLTGGKNTRALFGVCLCSSAINQLTKGRNKEEESSELQSLASEALLKDYKQRAPSKEALITSLLKNMKLS

SEQ ID NO: 17861 - protein, 69 aa, Zea mays
ADIYETEEEASKLLLAGKVPVGIGRNTKIRNCIIDMNARIGKNVVITNSKGIQEADHPEEGYYIRSGIV

SEQ ID NO: 17862 - protein, 168 aa, Oryza sativa
  misc_feature (124)..(124): Xaa can be any naturally occurring amino acid
  unsure (1)..(168): unsure at all Xaa locations
MSSIGAGAGGAVVGAAVAAVAVGGGAPPHVLAVDDSSVDRAVIAGILRSSRFRVTAVDSGKRALELLGSEPNVSMIITDYWMPEMTGYELLKKVKESSKLKKIPVVIMSSENVPTRISRLPSTXTIVLPSLLCSIGLLTRCLEEGAEDFLVKPVRPSDVSRLFSRVLP

SEQ ID NO: 17863 - protein, 667 aa, Bacillus subtilis subsp. subtilis str. 168
MDTIEKKSVATIRTLSIDAIEKANSGHPGMPMGAAPMAYTLWTKFMNVSPANPGWFNRDRFVLSAGHGSALLYSMLHLSGFDLSIEDLKGFRQWGSKTPGHPEFGHTAGVDATTGPLGQGIAMAVGMAIAERHLAETYNRDSFNVVDHYTYSICGDGDLMEGISSEAASLAGHLQLGRLIVLYDSNDISLDGDLDRSFSENVKQRFEAMNWEVLYVEDGNNIEELTAAIEKARQNEKKPTLIEVKTTIGFGSPNRAGTSGVHGAPLGKEESKLTKEAYAWTYEEDFYVPSEVYEHFAVAVKESGEKKEQEWNAQFAKYKEVYPELAEQLELAIKGELPKDWDQEVPVYEKGSSLASRASSGEVLNGLAKKIPFFVGGSADLAGSNKTTIKNAGDFTAVDYSGKNFWFGVREFAMGAALNGMALHGGLRVFGGTFFVFSDYLRPAIRLAALMGLPVTYVFTHDSIAVGEDGPTHEPVEQLASLRAMPNLSLIRPADGNETAAAWKLAVQSTDHPTALVLTRQNLPTIDQTSEEALAGVEKGAYVVSKSKNETPDALLIASGSEVGLAIEAQAELAKENIDVSVVSMPSMDRFEKQSDEYKNEVLPADVKKRLAIEMGSSFGWGKYTGLEGDVLGIDRFGASAPGETIINEYGFSVPNVVNRVKALINK

SEQ ID NO: 17864 - protein, 505 aa, Pseudomonas putida GB-1
MTTSPSTSPAKRPEDENLGLGANLAYGLQHVLTMYGGIVAVPLILGQAAGLNGAEIGMLIAASLFAGGLATLLQTLGLPFFGCQLPLVQGVSFAGVATMGAILSSEGGGGLPGVLGAVMAASLIGFLITPVFSRITKFFPPLVTGIVITTIGLTLMPVAARWVMGGNSASPEFGSVANIGLAGLTFAIVLLLSKLGSATISRLSILLAMVIGTLIAWSLGMADFSKVTEGPMLAFPTPFHFGMPEFHIAAILSMCIVIMVTLVETSADILAVGEIIDTKVDSKRLGNGLRADMASSILAPIFGSFTQSAFAQNVGLVAVTGVKSRYVVATGGVILVVLGLLPIMGRVIAAVPTPVLGGAGIVLFGTVAASGIRTLSKVSYKNNVNLIIVAASLGFGMIPIAAPTFYHHFPNWFETIFHSGISSAAIMAILLNLIFNHFTTGNSENQSVFAAAYERTIQYSDISALRDGDYFKDGKLFDAEGNEVPMLELDEHGNETVRRAAVAEH

SEQ ID NO: 17865 - protein, 237 aa, Bacillus halodurans C-125
MLTTWLTEAKKIVIFTGAGMSTESGVPDFRSSRGLWQGKNPEALASVDAMDHNREAFIDFYRMRIEGLQGVRPHKGYDVLAAWEKELPITSIITQNTDGLHEQAGSEVVLPLHGSIQRLYCVACGQRYDVARYITNEPYCSCGGFIRPAVVLFGEMLNTDTLALAERHTKEADLFLVLGSSLVVSPANLFPKIAKECGAKLVIVNHDETPLDPLADLVIQDQSIGTFLEETNRALQA

SEQ ID NO: 17866 - protein, 120 aa, Glycine max
  misc_feature (19)..(19): Xaa can be any naturally occurring amino acid
  unsure (1)..(120): unsure at all Xaa locations
SSQLRRAPPPQAHDGYILXKCLLSPEFCDPNRYLATASSDRTVKIWNVDGFKLERTLVGHQRWVWDCVFSVDGAYLITASSDTTARLWTMSTGEAIRVYQGHHKATVCCALHDGAESAPS

SEQ ID NO: 17867 - protein, 565 aa, Oryza sativa (japonica cultivar-group)
MAAAAARGAAAARSPLVLHRHPHPAHHRRLRLLPLVAGGGGGSPPRVGRRIRASREKGRRVGIRVFARYSQAQDFSTRLQDRAGELPKLVEDLLQTSISTGPRGAFRFAQGIQAVLGVGGEWLNDFSKTANTSAGIPAQMQLGLLSPLYLRRLFERMGATYIKLGQQTETKTTNISFSNPDNKYVEEFQNCFDRAPPVPYSEIESILREELQQPLDSVYEYIDPVPIASASIAQVHGARLKSSQKDVVIKVLKPGIEDTLVADLNFIYVVARILEFLNPELQRTSLVGIVKDIKESMLEEVDFRKEAMNIEAFQRYIDAMGFDRQAKAPFVYRHCSTKRVLTMERLYGVPLTDLDSIRSLVPDPELTLVTALNVWYAPCVLVIPYIIYLDVHAGNLWLLRDGRVGFLDFGIVGRISPRTWAAMEVFLASFATDDYNAMASALSEMGATGNDINVNEFAKDLEKIFSSIQDLDTEVIVATARTPDATAVSANVVVDERQMNALFLDLVRVSESYGLKFPREFALLMKQLLYFDRYTRLLAPSMNMLRDERVNISSRQQARRVDRFQ

SEQ ID NO: 17868 - protein, 512 aa, Lactococcus lactis subsp. lactis Il1403
MKLKDIEKSTNKNLYLLFLSVLVGLTAGFLASLYRLALEKAETWGLSIYRFVSSHLIFIPLLILGLAFLAFVVTFFMKKYPMSSGSGIPQVKGQLQGYFKNNWFTTAFAKFIAGTLAMFAGLSLGREGPSVQLGASMGQMVSSRLAETERHKRILIASGASAGLSAAFNAPLSGVMFTLEEVFKYFSPLILLTCMTSAMVADMVARIMFGSGPVFHFQIVGSIELSNYWLLIILGIILGFFGAFYNWTLLTSQNLMKKIKSPFLRVLLTFLVVGATGLLFPNIIGSGHRLMDSFSLGMGLAFLCLILIGKYLISMVSYASGVPGGIFFPLLVLGASLGAVFATIVISLFHLPSHLFANLVILAMAGTFTAIVRAPMTGILLLVEMTGSFDHLLPLALVSLIAYVVADLLQSEPIYDSLLDNMLKEKEIDVDDSDKQMMFETIVQFDSVADRKKLSEIHLPEGCLLVSVHRSGKDIIPHGNTELQAGDYLTFLIRREDEVIAREQLRQVLNEK

SEQ ID NO: 17869 - protein, 325 aa, Methanothermobacter marburgensis str. Marburg
MTEVLDILRKYSEVADKRIMECISDITPDTLLKASEHLITAGGKKIRPSLALLSCEAVGGNPEDAAGVAAAIELIHTFSLIHDDIMDDDEMRRGEPSVHVIWGEPMAILAGDVLFSKAFEAVIRNGDSERVKDALAVVVDSCVKICEGQALDMGFEERLDVTEDEYMEMIYKKTAALIAAATKAGAIMGGASEREVEALEDYGKFIGLAFQIHDDYLDVVSDEESLGKPVGSDIAEGKMTLMVVKALEEASEEDRERLISILGSGDEGSVAEAIEIFERYGATQYAHEVALDYVRMAKERLEILEDSDARDALMRIADFVLEREH

SEQ ID NO: 17870 - protein, 433 aa, Sulfitobacter sp. EE-36
MSDFEMMGLPRRLVKALTNMGMTDPTPIQKQAIPHGMNGRDVMGLAQTGTGKTAAFGIPLVAQMLEREARPEPRTVRGLVLAPTRELANQIMENLKGFCEGTQLKTMMIVGGQSINPQIKRMERGVDLLVATPGRLLDLMDRRAVLLHKTTFLVLDEADQMLDMGFIHDLRKIAAVLPKERQTMLFSATMPKLMNEIANSYLNSPIRIEVSPPGKAADKITQEVHFIAKAEKKSLLIELLGKHTEERALVFGRTKHGCEKLMKDLVKAGFKAASIHGNKSQGQRDRAIESFKKGEVTVLVATDVAARGLDIPDVKHVYNYELPNVPDNYVHRIGRTARAGKDGAAIAFCAPDEMGELKDIQKTMKISIPVASGRPWEAIDEPAKPKGRGGRGRGRGGRPGGGGGNGGGGNGGGAGKPAGAARRRRKPAGQRAA

SEQ ID NO: 17871 - protein, 159 aa, Glycine max
MVSELINANPIIYEKKERRPRTAPSAPHDEYAVELIDQQEVFDHIRDIKDPEHPYSLEELKVITEEAVEVDDQRNYVRVMFTPTVEHCSMATVIGLCLRVKLMRSLPSRYKVDIRVAPGSHATEAAVNKQLNDKERVAAALENSNLLNMVDDCLAPSYD

SEQ ID NO: 17872 - protein, 500 aa, Oryza sativa (japonica cultivar-group)
MAMMAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNRHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 17873 - protein, 201 aa, Brassica napus
  misc_feature (179)..(179): Xaa can be any naturally occurring amino acid
  unsure (1)..(201): unsure at all Xaa locations
MSCSSSSGSEGEEEGFDSYRKGGYHAVRIGDPFSGGRYIAQRKLGWGQFSTVWLAYDTLSSSYVALKIQKSAQQFAQAALHEIEFLSAAADGDLQNTKCVVRLIDHFKHAGPNGQHLCMVLEFLGDSLLRLIRYNRYKGLKLDKVREICRCVLTGLDYLHRELGMIHSDLKPENILLCXTIDPCKDPVRSGLTPLLEEPEG

SEQ ID NO: 17874 - protein, 641 aa, Ostreococcus tauri
MRACARAVTRRWRPGRWTRASFGDGGARAPAIGADGDDDARDVGECAWTRRPRRRTYATSRTEDGDDGAPRTMVPWNRTVISGVELLRSGRYNKGMSFARDERDRLNLRGLLPPAVFDQATQVERVIERLRRVTSGVEKHAWLPALYERNERLFYRVVKDHLEELLPVLAEPTVWQVCREAGLMYRQPRGLYVSMQDKGSVYRLLKNWPVRNVKAVVLTDGQRVTGIGDLGVQGMPAAVSKASLFTALGGLDPADVLPICIDVGTDNQTLLEDKFYIGLRQKRVGGEAYEELLDEVVSGLKRRFGPRVLLCFEEFSNANAKKLLSRYNRDSVAYVDDLQGVAAITLAAVISSLPRMGGSLLDQRFLFAGAGETGAHAADLLATYIAQEHGITLPEARKNMYFIDRKGLLTRRRAEQEDDLEFHKLPYAHDIPDGCGKTVLESVELLKPTALIGVRRHRFSFFEGSKLCDEKLFTTDVLGAMAKHTERPLIMALSRPAALHECTAEEAYAATDGRCIFVGACRSTSFEFGGRTISPSECSTDYIYPGLGLGLAIAEGTRLRDSLIIEAAQAVAASTTDADIDQGAVFPRKRLIPDVSARVAARVASKAFASGLSALPVKPKGDWLGLAKSWMFDPTYRPYTH

SEQ ID NO: 17875 - protein, 1073 aa, Bacteroides thetaiotaomicron VPI-5482
MEKEIKKVLVLGSGALKIGQAGEFDYSGSQALKALKEEGISSVLVNPNIATIQTSEGIADKVYFLPVTTYFVEEIIKKERPDGILLAFGGQTALNCGAELYTQGILDKYGVKVLGTSVEAIMYTEDRDLFVKKLDEINMKTPVSQAVESMEDAIAAARKIGYPVMVRSAYALGGLGSGICANEEEFLKLAESSFAFSKQILVEESLKGWKEIEFEVIRDANDHCFTVASMENFDPLGIHTGESIVVAPTCSLDDKELKLLQELSAKCIRHLGIVGECNIQYAFNSDTDDYRVIEVNARLSRSSALASKATGYPLAFVAAKIALGYSLDQIGEMGTPNSAYLAPQLDYYICKIPRWDLTKFAGVSREIGSSMKSVGEIMSIGRSFEEIIQKGLRMIGQGMHGFVGNDDVHFDDLDKELSRPTDLRIFSIAQAMEEGYSIDRIHELTKIDPWFLGKLKNIVDYKAKLSTYNKVEDIPADVMREAKILGFSDFQIARFVLNPTGNMEKENLAVRAHRKALGILPAVKRINTVASEHPELTNYLYMTYAVEGYDVNYYKNEKSVVVLGSGAYRIGSSVEFDWCSVNAVQTARKLGYKSIMINYNPETVSTDYDMCDRLYFDELSFERVLDVIDLEQPRGVIVSVGGQIPNNLAMKLYRQSVPVLGTSPVSIDRAENRNKFSAMLDQLGIDQPAWMELTSLEEVKGFVEKVGYPVLVRPSYVLSGAAMNVCYDDEELENFLKMAAEVSKEYPVVVSQFLENTKEIEFDAVAQNGEVVEYAISEHVEFAGVHSGDATLVFPAQKIYFATARRIKKISRQIAKELNISGPFNIQFLARNNEVKVIECNLRASRSFPFVSKVLKRNFIETATRIMLDAPYSQPDKTAFDIDWIGVKASQFSFSRLHKADPVLGVDMSSTGEVGCIGDDFSEALLNAMIATGFKIPEKAVMFSSGAMKSKVDLLDASRMLFAKGYQIYATAGTAAFLNAHGVETTPVYWPDEKPGAENNVMKMIADHKFDLIVNIPKNHSKRELTNGYRIRRGAIDHNIPLITNARLASAFIEAFCELKLSDIQIKSWQEYK

SEQ ID NO: 17876 - protein, 253 aa, Glycine max
LGHVIDKLSVSFGLEILKVVPGYVSTEVDARLSFDTAATIARAHRIIDLYEKAGIKKDRVLIKIASTWEGIQACKHLQKEGISCNMTLLFGFAQAVGCAEAGATLISPFVGRILDWHKAKTGKSSYESHEDPGVVSVTKIYQYYKKYDYKTIVMGASFRNTGEITELAGCDRLTISPGLLEELAKSTSKLDKKLDPETAAKAYTGEKVSYDEKGFRLSMNEDAMATEKLAEGIRGFSADIVKLEQILKAKLSA

SEQ ID NO: 17877 - protein, 326 aa, Triticum aestivum
  misc_feature (147)..(147): Xaa can be any naturally occurring amino acid
  misc_feature (176)..(176): Xaa can be any naturally occurring amino acid
  misc_feature (188)..(188): Xaa can be any naturally occurring amino acid
  misc_feature (227)..(227): Xaa can be any naturally occurring amino acid
  misc_feature (297)..(297): Xaa can be any naturally occurring amino acid
  unsure (1)..(326): unsure at all Xaa locations
MFYAGYGYHASNFEQTYRCYPASFFDKPHLEGGDKVIMPPSALDRLASLHIEYPMLFELHNGVTDRISHCGVLEFVAEEGMIIMPYWMMQNMLLQEGDIVRVKNATLPKGTYVKLQPHTTDFLDISNPKAILEKTLRNFSCLTTGDXIMVAYNNKQYYIDIVEAKPASAVSIIETXDCEVDFAPPLDXYKDPEKPQRPIVPAGKAPAEDQEAIVEDDPKFKPFTGSXGKRLDGKGPKQPAPGASLAAVAARSAPSDSNKRANQQTASPSGASTSTRQKTGKLVFGSSASSKQEAQNXKEPAKGSEPPKKEEPKFNAFTGKSYSLKR

SEQ ID NO: 17878 - protein, 299 aa, Debaryomyces hansenii CBS767
MTTLTKSIDYLSRVIDSYVCNVSEKALVVGISGPQGSGKSYLTNQLGTELRKLYPKLNIVLFLMDDLYLTHEDQLALTTRSQDYMDDNKLLQGRGLPGTHDIELGADLFSKLINRHSELIMHEVPIPFYDKGAFNGEGDRSPECNWNVVKTPVDVIIFEGWFNGFQPLSFDQLRVKYLTSDINKSVIQRHKMFHVEQVNENLKEYAKLWSLFDFFICLETDSLQNVYNWRLEQEHYLKATTPAGTGMTDEEVVKFVDRYMPIYELYYEKMCSDGCVKKVGHNLKLVINAKRNMLDSMIY

SEQ ID NO: 17879 - protein, 459 aa, Rickettsia rickettsii
MEQYDVAVIGGGPGGYVAAIRAAQLKKKVVLIEKEHLGGVCLNWGCIPTKSLLKSAEVFEYIKHAKDYGIDAKGAEINIKKIVERSREISNKLAGGVKLLLKKNKVTVIDGVASLAGNKVININDKPTVKAGNIIIATGARSRVLKGFKPDGKQIWTSKEAMIPQHVPKSMIIVGSGAIGIEFASFYNSIGVDVTVIEAHNRILPAEDMEISGIAHKNFEKKGIKIITNAKLIKQTKSKDKIEVELELADKTQKLQAEILLMAVGITANTENLGLEKTKIKVENGYITTNGLMQTAVSGIYAIGDVAGVPCLAHKASHEGIIAAESIAGLKPHTINKHNIPGCTYSSPQIASVGLTEEAATTLGYELKIGRFPFIANGKALVSGDSDGLIKTIFDAKTGELLGAHMIGSEVTELIQGYVVSKNLEGTELDLINTIFPHPTLSEMMHESVFSAYDRAIHI

SEQ ID NO: 17880 - protein, 310 aa, Zea mays
  misc_feature (221)..(221): Xaa can be any naturally occurring amino acid
  unsure (1)..(310): unsure at all Xaa locations
MMVKEEEMMAEAGGGRGYMDLLGLGEEDYLLCLSPPSYFTPSVVSATATTTAAASASTCCAASYLDLDLAPAYHHTLSFGGQDQEQQHHGDDGALGFQHYGGDHAIPAAAAAVQQKSSPTTECSSSLSSMSPSPPATAVSAAVSCPKPQAFKKKKAGSRSSASAAAPAATNKRPRSDTASVLHEALGYIRFLHDQVQVLSTPYMQMRRQPASAGARPRRRXSAAGTVVEPALPSDLRSRGLCLVPVSYTDNFAGHGHGHGNGADLWSVVAGTGMGTAKAAVDNEGAAGGTLLPGGGGGAGHPRFTDYARV

SEQ ID NO: 17881 - protein, 425 aa, Sulfitobacter sp. EE-36
MSTIIDIHAREIIDSRGNPTVEVDVTLEDGTMGRAAVPSGASTGAYEAVERRDGDKNRYMGKGVLEACASVNGEIADALVGIDATEQVEIDGTMIELDGTDNKSRLGANAILGVSLATAKAAADYCSQPLYRYVGGTSARMLPVPMMNIINGGEHADNPIDIQEFMIMPVAAENIRDAVRMGSEVFHTLKKELSAAGLSTGIGDEGGFAPNISSTRDALDFILKSIEKAGYKPGEEIYLALDCAATEYFKDGSYVLSGEGKTLTSAENVDYLAALCADYPIISIEDGMSEDDWDGWKLLTDRLGDKIQLVGDDLFVTNPERLAEGIKRGSANSMLVKVNQIGTLSETLQAVDMAHRAGFTNVMSHRSGETEDATIADLAVATNCGQIKTGSLARSDRLAKYNQLIRIEESLGVTAEYAGRSILKG

SEQ ID NO: 17882 - protein, 198 aa, Oryza sativa
  misc_feature (84)..(84): Xaa can be any naturally occurring amino acid
  misc_feature (100)..(100): Xaa can be any naturally occurring amino acid
  unsure (1)..(198): unsure at all Xaa locations
MVVYTQEHVYRHPWDRVTAAAWRKFTDPASRTALSHVADVHTLHRRVDPEAGRLQAARSITVRSPPLPFILRRLLPAAASSPSXGAALCHCVETSLVDAXPRRAMDVVVRNVSLRGLIEVEERSTYRPHPERPEEWTQFRQETTIRCRPLSALAAVAEKVETRCAERFLQNSAKGREVVERICRYLEAEAAGAASSAI

SEQ ID NO: 17883 - protein, 336 aa, Oenococcus oeni PSU-1
MATMDALVLTAVKDMKIEQVDKPQVKANEVLIETKYAGICGTDHALYNGLPGSAAAVPPIVLGHENSGVVSEVGEKVTSVKVGDRVTVDPNIYCGHCFYCRTGRPELCDNLSAVGVTRNGGLEQYFTAPSTQVYKVPDNVSLKAAATTEPISCAVHGVKLLKLTPYQKALVIGDGFMGQLFVQLLRAYGVHQVDFAGIIDEKLALNKEKFGVTNTYNTTRDKIPADYDVVIEAVGLPETQEQAVNATVKGAQVLMFGVGKPNQEFKMNTYEVYQKQLTIQGSFINPNAFEDSLALLSSGKLDVLSLISNEPSLDKVSDYLDGSVKNVSKAVVKVGA

SEQ ID NO: 17884 - protein, 422 aa, Crocosphaera watsonii WH 8501
MRNLSLNDYKKYENFDFRYPGSIQPHGVLLVIDIKTFTIIQVSENTKRFLGVKPKTLLGKPLTYLMYLKQIKNIKNILENNNHFVDIIKLKKKKYDTQFKGIFHRVQDSIIGELETFKLNDNNKNIDYYKLFQDAIINTGKTNDLKKLSAKITEEIRKITKFDRVLIYRFENDDSGVVIAENKREDIESYLGLHYPYYDIPNPARQFFSKKLLRMIPNIHDEPIPILPRKHPLKKKKLDLQNAFLRSIAPCHIEYLKNMGVTASFNISLLKENKLWGLIACHHYSPKYVIYEIRKICELLGEIFSLKLMYEEEKSFRQYRQTIKEIKKRIKEELSKNKNKHDFIDNIIQKNGDSFLKLISARGIAICLDNKIYVKGNTPKKKQIKALINDFLLPKKKDVFLQIFSQSHILFPEKLKKLLQEF

SEQ ID NO: 17885 - protein, 136 aa, Salmonella enterica subsp. enterica serovar Typhi str. CT18
MKRYILATAIASLVAAPAMALAAGSNILSVHILDQQTGKPAPGVEVVLEQKKDNGWTQLNTGHTDQDGRIKALWPEKAAAPGDYRVIFKTGQYFESKKLDTFFPEIPVEFHISKTNEHYHVPLLLSQYGYSTYRGS

SEQ ID NO: 17886 - protein, 142 aa, Festuca arundinacea
GAAPLGKDLQDAFMAKIPNAVLGQGYGMTEAGPVLAMCLAFAKEPFKVKSGSCGTVVRNAELKVVDPDTGAALGRNQPGEICVRGKQIMIGYLNDPESTKNTIDKDGWLHTGDIGLVDDDDEIFIVDRLKEIIKYKGFQVPP

SEQ ID NO: 17887 - protein, 248 aa, Pseudomonas fluorescens PfO-1
MCLIVFAWRPGHAQPLIVAANRDEFYARPSLPLAQWPESPHVHAGRDLEAGGTWLGLGANGRFAALTNIRDPHQPPARRSRGELVAGFLTGNLSIDDYLSDVVARSPDYAGFNLLLGNANELWHFNARSSEPVMLQPGVYGLSNAGLDTPWPKLLKAKAALSAVLDDPQPERLLALLSDAQTAPFADLPDTGVGLATESLLSSVFIASQSYGTRASTALIVQADGTRRMIERSFGPYGGHLGEVEIDL

SEQ ID NO: 17888 - protein, 239 aa, Triticum aestivum
MMASAPAPNPRLGREAVVRAVGALLRWLKHHPSPAPEPVYLLVTLKTAPVRRFEHHLSLPLSPFPSIFLVADRLPDDLPDDIETLPSSALRSLPAVARRGLVLVDSRLKIPSSGKGAKGRGRVVPVDLADPAWAESAREAARRVELRVEAGTCRAVRVGHAAMAPAELVENVVAAVEAAAACVPRKWRNVRALHLKAPESIALPLYAAPGTGGNDDPKDAKREGATAVEQRRVKRRRNE

SEQ ID NO: 17889 - protein, 379 aa, Hieracium piloselloides
MTFAFASFRMQNHKLTKMALVFLSFFFLVASSRAAISNRIGINYGRLGNNLPSPAKSIELLESMNAGRVKLYDADHEILHLLSGKDIEVAITVANDEISAIAANQHLADQWVYEHVLAHYPNTKIRFILVGNEVFSSTNNVQDMQIARDLVPAMRRIKNTIKAQGIRNIKVGTPLAMDMMETTFPPSNGSFKPDIRELMIPLLKYLNGTRSFVLVDVYPYFRVVRQVARNNSDTGIDLGFALLRTSNMTYTDPQSGLVYTDLLDQMLDSVVYAMAKLGYDDIMLALAETGWPHDGDVDEIGANRENAAEYNNNLIKKMAAVPSNGTPARPGQIVPTFIFSMYDENQKYGPATERHWGLMNPDGSAVYAVNITGKVNPSD

SEQ ID NO: 17890 - protein, 399 aa, Oryza sativa
  misc_feature (59)..(59): Xaa can be any naturally occurring amino acid
  unsure (1)..(399): unsure at all Xaa locations
MATITAASPRPSAAPAAMEETSKAMPTSEWPAASGGNASPPARSRPSLLVIFSACLVLXGAGGPLLLRVYFVHGGTRLWLSATLQISGWPLLLPPLCVSLYRGRRHGIGNLLLPRRLVGAAAVLGGLYAVSCFVYALGSQALPLSTSSLLLATQLAFTAVFAFLFVGLRFTPFSANAVGGLTIGPAVLGVGPSSGKPAGESSRAYWTGFCEAIGAAALAGLVIPLVEVATARYGRRTGPAARVPPPYATVMQMQAVMGAAGTAVCVLGMAIKGDFQAVAREAAAFGLGAANYYLVLAWDAVSWQLLNLGIMGLITCASSLLAGIMIAVLLPLSQVLAVIFLHEKFDGTKGIALVLSLWGFASYLYGEKAQKKKEAQKMREREQEVALAQKTADVESAAP

SEQ ID NO: 17891 - protein, 637 aa, Bordetella pertussis Tohama I
MNANPTFLAATAEVDAAAVAPLPKSRKVYETGSRPDIRVPFREIEQADTPTMFGGEKNPPLTVYDTSGPYTDPQASIDIRRGLPALRRAWIEERGDTEVLDGPTSDYGKERLTDPKLTAMRFDLQRPPRRARAGANVTQMHYARRGIVTPEMEFIALRENLRREHYLETLRASGPDGEKLAKRLLRQHPGQSFGAALPSAITPEFVREEVARGRAIIPANINHPEIEPMIIGRNFLVKINANIGNSAVSSGIGEEVEKMTWAIRWGGDTVMDLSTGKHIHETREWIIRNSPVPIGTVPIYQALEKVDGKAEELTWEIFRDTLIEQAEQGVDYFTIHAGVRLPFIPMTADRMTGIVSRGGSIMAKWCLAHHKESFLYERFEEICEIMKAYDVSFSLGDGLRPGSGYDANDEAQFAELKTLGELTQVAWKHDVQVMIEGPGHVPMQMIKENMELQLKHCDEAPFYTLGPLTTDIAPGYDHITSGIGAALIGWYGTAMLCYVTPKEHLGLPNKKDVKDGIITYKIAAHAADLAKGHPGAAIRDNALSKARFEFRWDDQFNLGLDPDTAKEFHDETLPKDSMKVAHFCSMCGPHFCSMKITQDVRDYAAAQGVSEKDALQQGMQEKAVEFVKKGAEVYHRT

SEQ ID NO: 17892 - protein, 476 aa, Bordetella pertussis Tohama I
MHANFIDGAWLDGVDARPNINPSNLADVVGDYAQADAAQAGMAIAAASAAAHAWARSTGQRRADVLDAVGTELLARKEELGRLLSREEGKTLPEGVSEVTRAGHIFKFFAGEALRIQGEKLPMTRPGIEVDVTREPVGVVGIIAPWNFPIAIPAWKIAPALAYGNTVVFKPADLVPGSAWALAEILSRAGLPAGVFNLVMGRGSVVGQAILDDRRVNAISFTGSVATGRRVAEAAIGRMAKVQLEMGGKNPLVVLNDADLKVAVDCAVNGAFFSTGQRCTASSRLIVQKGIYPRFVEAVRERLQGLKVDDALAPGTDIGPVVDRSQFDQNLAYIAIGREEGAQLAWGGEPLKRANEGYYLAPALFVDCDNSLRIAREEIFGPVAAVIPVDSYEQALEVANDTEFGLSSGIVTTSLRHATHFKRESQAGMVMVNCPTAGVDYHVPFGGRKGSSYGPREQGRHAAEFYTSVKTAYTAA

SEQ ID NO: 17893 - protein, 1222 aa, Ostreococcus tauri
METPSATPSEVAVHPLVLLSVVDHFGRCDEGDEASKRVVGVLLGEQRRGRIDVTSSFAVPFEEEDDASGIWFLDHVYLENMYRMSRKISAKEKIVGWYSTGPKLRDNDIDIHELFYAYAQEPVMVIVDVRAENANIPTSAFAAQIEVKEDGTEKQQKTFVHVPNSIQAFEAEEIGVEHLLRDVKDNTCTPAIRDGTLPVNHEIMGTFRMRVRPRGSTSRQRLDARRVSELVDPSRDRSARLDQQQGTKSRARTRVRRRRRYRGCRQGEQGERERKISGRRPEDDRRKVTSTSVVVIVRSSTRLAISFSHVRPKRRLARRRIAIIQICSFDASGFIRALRLTRRLASSHTRSLRARAAQATVSRRPSERALGAPSRDTGEMRAKNTAAAARKPTERRKSDAVDDDDASRPIASSAKNTKAKSSKKTNDASKSNDVGMEKDGHVEFAQAEALTGRRRTLEAKKKKSSGGFESMEILPEVFRAVKRKGYRVPTPIQRKAIPPALEGRDVVAMARTGSGKTAAFLIPVLSKLRTHSFESGCTVRGTFAFAKELSKFTNLRVAALVGGDSMEAQFADLSNNPDIIVATPGRLLHHVEEVKAFTLRTVCHVVLDERIGYWRWVSGSTLLFSATLPSALAEFVRVGLREPEVVRLDAEMKISTDLKMSFILMRNDEKVAALLYMLREVIPKGQQTVVFASTRHHVEWLHNLLEFEGVRVSSIYGSMDMMARKMALSKFRAKKADVLMVTDVAARGIDIPLLDNVINYDFPSKGKLFVHRVGRVARAGRTGNAHSFLVKEELGFLVDLHLFLGRKIAAASKLPPNSTEEAAEIARAADESATSIIGTCPLGALDMTVDRLRELMKERDELEGMERAASNAYKLYQKTRGAASSESMSRAQPLIHAGPHPLLCASGGVDATTQELAQITASIRAYRPQATVLEAEVASATKVNGSMRLTETSRAMQQKRLKDEKFIKAKREGKTIKGRALRPLGEDDPILNQEGLDNDVNDGGADYEAMAAPAEDAFNTGKFRDQDFFLDNAPRAVNHTELGLSTREGAYGALEDATMDLVEEDGAGISRQKKLYHWDARKKRYVHIRSDEIDLKRGGKRIKNEAGQRVSAVEAGATYKKWVAKTHKSITATGSMEDESTASQQVGTPRAPSKQKRRASSELAPAKTNSKMRIRFEKSAKRTRRRNKECPADEVAADEVAADEVAADEVAADEWRARRRTG

SEQ ID NO: 17894 - protein, 251 aa, Fusobacterium nucleatum subsp. nucleatum ATCC 25586
MRRLVIAGNWKMYKNNKEAVETLTQLKDLTRDVKNVDIVIGAPFTCLSDAVKIVEGSNVKIAAENVYPKIEGAYTGEVSPKMLKDIGVTYVILGHSERREYFKESDEFINQKVKAVLEIGMKPILCIGEKLEDREGGKTLEVLAKQIKEGLVDLSKEDAEKTIVAYEPVWAIGTGKTATPEMAQETHKEIRNVLAEMFGKDVADKMIIQYGGSMKPENAKDLLSQEDIDGGLVGGASLKADSFFEIIKAGN

SEQ ID NO: 17895 - protein, 385 aa, Haloferax volcanii DS2
MSEDFYDVLGVSRDASKDEIKNAYRKKAAKYHPDVSDEDDAEEKFKKVQKAKEVLTDDEKRQMYDQVGHERFQQSQKRGGGGGGRGQGNPFGGGGNPFGGMGGGGGGFEDIFNNLFNGGAGGQQRNRPQQGRDVAQRISIDLEDAYHGVERDVTIRRREVCPECDGEGHPEDADVNTCSECNGSGQQTTVQQTPFGRVQQTTTCRACGGEGETYSEDCSECRGSGRVRRTRDVTITIPAGFRDGQRLRYRGEGEPGENGGPNGDLFVEVNVRDHDEFDRDGDDLRYTHPISFPQAVFGATVEVPTLDGEEELKVPAGTQSGSTFTVSGAGMPHLDGRGNGDLHVEVHVVTPEDLNSEQREALKEFAEAGGEEVKEGLFQKLKNSL

SEQ ID NO: 17896 - protein, 369 aa, Candida albicans SC5314
MYYITIRHQYSLLFFSSIRHIIDKIPIKKGNSIMSDNNIVGIEYNRVTNTTSTDFPGHQQNGDYSWDIEKFKNKFEIKITNLSERTGTFDLIHIDTSIANAFRRIMIAEVPSVAAETVYMFMNTSVIQDEVLAQRIGLIPWKIDPDKLTWVDETVDINDRFTEDNTIVLSLDVACSKNPHAPKNSTDPRELYKNSHVYAKDFKFEPHGNQEEKFKDTPVVPCDPDILLAKLRPGQEISLRAHCVLGIGSDHAKFSPVATASYRLLPVIDIKEPITGELAKKFQKCFPPGVIGIDANGKAYVKDARKDTVSREVLRHPEFDGKVQLGRQRDHFIFNVESTGAMPPAEIFFKSVRLLKNKAEYLRNCPIGQ

SEQ ID NO: 17897 - protein, 252 aa, Bacillus halodurans C-125
MDLQLKDKVVLVTGGSKGIGKGIAQAFVEEGAKVAIVARDAHGLQEAKRQLGNVLTIQADVTDKNEREKVFSQLLETYGTIDILVNNAGGSNGGLISETELSLFEEAFSLNYFSAVHFSQLALPVMKAKQSGAIINISSIFGRESGGKATYNSAKAAMISFTKSLADEVIRDGIRVNGIAPGSILHPTGNWQKRLEENREKMEQFIDQNIPAGRFGTVEEIANVAVFLASEKASWVVGATLNVDGGQSYSNF

SEQ ID NO: 17898 - protein, 385 aa, Bacillus halodurans C-125
MIKPSRRLAPLATSVFTELANMKAAYKQDGRELIDLSIGSPDLPPPDFVVQKMNAYVSNPNQYGYAITGLAAFHEAVAQFYQRRYQVNVKPHQVLSLMGSQDGLAHLALAYVDAGDLLLAPDPGYPIYAASAHIAGAELYTYPLNEENQFMFDVETLPDDVKQKAKLMIVNYPGNPTAAMADEAYFEKLVAFGIEHNILIVHDYAYSELLFDQREALSIFSVPRAFETAIEFNSLSKSFNIAGARIGYAIGAESILQPLAALKSHLDYGVFLPVQYGAIEALEHGDAFLETQRELYEKRRNTFVEALQLNGWTVSKPGGGMFIWAKIPDDGRDAMSFVKQAMEHAGVIVTPGHAFGKEGEGYVRMALVQPETELRKAANQLAQIL

SEQ ID NO: 17899 - protein, 399 aa, Medicago truncatula
MSSSGDESMASEIDEQEQNGGRGIPDYIMNLEDVPSTLPTHLELQKTRVFCNLDAPQHTDTIQYSGAYAALGVDNSVRLDNFYQNFKVEVKRITDEEMEFDMIGIDPAVANAFRRILIAEVPTMAIERVYIANNTSLVQDEVLSHRLGLIPIDADPKLFEYPDDAGGENNEKNTIVFKQHVRCEKGQPRLTVKSDTLKWLPNGSELIAEGTKSAADPAPKTFTTFNQKSLPKFSKDPAPYNLDVIVAKLGPGQEIELEAHAVKGIGKTHAKWSPVATAWYRMLPEVVLTKDVKDELAEELVSKCPAKVFDIEDIGRGRKKAVVKNARACTLCRECIREADEGEEGGEGEKWTDRVSLRRVKDHFIFTIESTGAIPPDVLFTEAVKILEDKCERVITELS

SEQ ID NO: 17900 - protein, 110 aa, Glycine max
NQVLPTVFTFPQFPTISSPNNLILASKPFAGNSRYKHSKTPLHLTTFSGQSKVITYLSKHKADVGASAMDYMAAIHFSSHKGHFEVVLALLSTCAFLKTVTLKSMTSLHY

SEQ ID NO: 17901 - protein, 945 aa, Frankia sp. CcI3
MAQDTPRKFSVITDGLPSQLPDIDPSETSEWLESLDAVIEESGRGRARFLMLKLLERAREKAVGVPGLTSTDYINTISPEREPWFPGNEHIERRIRAYIRWNAAIMVSRANRPAFNVGGHIATYASSASLYEVGFNHFFRGKDHLSSSPGSASGDQIFIQGHASPGIYARAFLEGRLTEKQLDAFRREGESGGLSSYPHPRLMPDFWEFPTVSMGLGPIGAIYQARFNRYLLNRQIKDTSGSRVWAFLGDGEMDEPESIGALGVAAREELDNLIFVVNCNLQRLDGPVRGNGKIMQELESLFRGAGWNVIKVVWGRDWDPLLAKDTDGVLVNRMNTTPDGQFQTYSTSSGEYIREHFFGSDARLRRMVADLSDDDLRKLSRGGHDYRKLYAAYKAATEHAGQPTVILAHTIKGWTLGKDFEARNATHQMKKLTKSELKEFRDRLYLEIPDSALSGDLPPYCHPGPDSEEIAYMRERRAALGGSIPRRVVRAKPLPQPPAKIFDELRKGSGKQPVATTMAFVRLLKDLMKTKEMGARFVPVIPDEARTFGMDAMFPTAKIYSPHGQRYEAVDRELLLSYQESETGQMLHEGISEAGSMGSVIAAGTAYATHAQHMIPVYVFYSMFGFQRTGDQMWALGDQLGRGFLLGATAGRTTLNGEGLQHQDGHSLLLASTNPACVAYDPAFAFELTHIVRDALDRMYGERDDNVFYYLTVYNEPVPQPAEPAGLDPAQIISGMYRFRSAEDLAGGLPAAGAGVGSPPRAQLLASGTSIHWALAAQEILAADFGVAADLWSVTSWNELRRDALDCDRANLLNPEADDAVPYVTRALEGAAGPVVAVSDWMRAVPDQISRWVPQPFTSLGTDGYGRSDTRAALRRHFKVDAESIVVATLEALVRAGEVKATTVGDAIRRFGLRADKAGLDGPEAIVAGIRIVAGAEQDERPISG

SEQ ID NO: 17902 - protein, 332 aa, Bacillus sp. TB-90
MTKHKERVMYYGKGDVFAYRTYLKPLTGVRTIPESPFSGRDHILFGVNVKISVGGTKLLTSFTKGDNSLVVATDSMKNFIQKHLASYTGTTIEGFLEYVATSFLKKYSHIEKISLIGEEIPFETTFAVKNGNRAASELVFKKSRNEYATAYLNMVRNEDNTLNITEQQSGLAGLQLIKVSGNSFVGFIRDEYTTLPEDSNRPLFVYLNIKWKYKNTEDSFGTNPENYVAAEQIRDIATSVFHETETLSIQHLIYLIGRRILERFPQLQEVYFESQNHTWDKIVEEIPESEGKVYTEPRPPYGFQCFTVTQEDLPHENILMFSDEPDHKGALK

SEQ ID NO: 17903 - protein, 448 aa, Bacillus subtilis subsp. subtilis str. 168
MTHDLIEKSKKHLWLPFTQMKDYDENPLIIESGTGIKVKDINGKEYYDGFSSVWLNVHGHRKKELDDAIKKQLGKIAHSTLLGMTNVPATQLAETLIDISPKKLTRVFYSDSGAEAMEIALKMAFQYWKNIGKPEKQKFIAMKNGYHGDTIGAVSVGSIELFHHVYGPLMFESYKAPIPYVYRSESGDPDECRDQCLRELAQLLEEHHEEIAALSIESMVQGASGMIVMPEGYLAGVRELCTTYDVLMIVDEVATGFGRTGKMFACEHENVQPDLMAAGKGITGGYLPIAVTFATEDIYKAFYDDYENLKTFFHGHSYTGNQLGCAVALENLALFESENIVEQVAEKSKKLHFLLQDLHALPHVGDIRQLGFMCGAELVRSKETKEPYPADRRIGYKVSLKMRELGMLTRPLGDVIAFLPPLASTAEELSEMVAIMKQAIHEVTSLED

SEQ ID NO: 17904 - protein, 323 aa, Vibrio angustum S14
MDFKAIQALTANDMAEVDAKIQAQLNSEVVLINQLGFYIVSSGGKRLRPMLAVLAARALGYDGDKHTTAAAFIEFIHTATLLHDDVVDESNMRRGKETANAAFGNAASVLVGDYIYTRSFQMMTSLRSLKILDIMSEATNVIAEGEVLQLMNCNDPNTTEDSYMQVIYSKTARLFEASTQIAAIIADAPAEIELAFQEYGRYLGTAFQLIDDVLDYIADGKEMGKNVGDDLAEGKPTLPLLHAMRHGNAEQAAMIREAIEKANGMEKLDAILACMHEHGSLEYTQQRAEEEAEKAIAALAPIADSEYKEALVALAHMSVQRNK

SEQ ID NO: 17905 - protein, 399 aa, Thermotoga maritima MSB8
MEFEGAVTKVSGWRWFLLALQHFVAMFGATVLVPLITGLDPLVALLTAGIGTLIFHFVTGGIVPVFLGSSFAFIAPILAVKEIYGDLAYATGGIFVAGLFYVLYALIVKAVGPEKVKKILPPVVTGSMIMVIGLTLSPVAIQMASSDWPLALIVIATVVFVSTMTRGFFSMVPVITGVVVGYVAGLFMGKIDTSVIVSTPLFSVPKVMLPKFDYGAIFMIVPVTLATFMEHLGDITTNGAVVGKNFFDKPGLHRTLLGDGLATAVAGLLGGPANTTYSENTGVLALTRVYDPSVLRGAALVAIFAAFVSKFGAILQTIPQAVMGGVSLILFGMITSVGVRTMVNAEVDFSKPRNLMITALMLTVGIGGAVLKVGRVELKGIGLAALVGIFLNLILPDRD

SEQ ID NO: 17906 - protein, 828 aa, Salmonella enterica subsp. enterica serovar Typhi str. CT18
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPMLRMKDGSYHKDGEFTPVSWEQAFDVMEEKFKTALKEKGPEAIGMFGSGQWTIWEGYAAAKLFKAGFRSNNIDPNARHCMASAVVGFMRTFGMDEPMGCYDDIEQADAFVLWGSNMAEMHPILWSRITNRRLSDPNVKVAVLSTFQHRSFELADNGIVFTPQSDLVILNYIANYIIQNNAVNQDFFTKHVNLRKGATDIGYGLRPTHPLEKAAKNPGSDASEPMSFDEYKAFVAEYTLDKTAEMTGVPKDQLEQLAQLYADPNKRVISYWTMGFNQHTRGVWANNLVYNLHLLTGKISQPGCGPFSLTGQPSACGTAREVGTFSHRLPADMVVTNEKHRDICEKHWQIPAGTIPAKVGLHAVAQDRALKDGKLNVYWVMCNNNMQAGPNINEDRMPGWRDPRNFIIVSDPYPTVSALSADLILPTAMWVEKEGAYGNAERRTQFWRQQIKAPGEAKSDLWQLVQFSRRFKTEEVWPEALLAQKPELRGKTLYDVLFATPAVSKFPLSELKEDQLNDESRELGFYLQKGLFEEYAWFGRGHGHDLAPFDDYHNARGLRWPVVEGKETQWRYSEGNDPYVKAGEGYKFYGKPDGKAVIFALPFEPAAESPDNEYDLWLSTGRVLEHWHTGSMTRRVPELHRAFPEAVVFIHPLDAKARDLRRGDKVKVSSRRGEVISIVETRGRNRPPQGLVYMPFFDAAQLVNNLTLDATDPLSKETDFKKCAVKLAKV

SEQ ID NO: 17907 - protein, 548 aa, Magnetospirillum magnetotacticum MS-1
MEMVHPVGLPAWKDLAALAATTGQKPMRDMFAADPGRFGRFSARLGDLLLDYSKNRIDAEVMAALIRLARQAGLAEARDAMFGGETFNITERRAVLHTALRNRSERPVMVDGQDVMPEIRAVLARMKTFAEQVRSGEWKGATGRAIQSVVNIGIGGSDLGPVMVTEALKPYQRDDLAVRFISNVDGSHAAEVLKLCDPETTLFIVASKTFTTQETIANAKTCRAWTVDKLGEAAIPNHFVALSTNARAVADFGIDTANMFEFWDWVGGRYSLWSAIGLSIAVAVGFGRFEELLAGGHAMDEHFRESPLEANLPVILALIGIWNANFLGADAYAVLPYDQYLHRLPAYLQQLDMESNGKGTARDGAMVGWGTGPMVFGEPGTNGQHAFYQLIHQGTRLIPCDFLAAAQTHNPLGEHHLMLLSNVFAQAEALMRGKTEAEARAELEKAGMSTAEIAFQLPHRVFPGNRPSNTLLYPRLDPFMLGQLIALYEHKVFVQGVIWDVNSFDQWGVELGKVLAKAILPELSSSAPVTNHDSSTTGLIEAVRALRR

SEQ ID NO: 17908 - protein, 482 aa, Streptomyces avermitilis MA-4680
MASAETSAAPVSPVTFPPAFLWGAATSAYQIEGAVREDGRTPSIWDTFSHTPGKTAGGETGDIAVDHYHRYRDDVALMAELGLGAYRFSVSWSRVQPMGRGPAVQRGLDFYRRLVDELLAHGVKPALTLYHWDLPQELEDAGGWPERDTAYRFAEYAQIVGDALGDRVEQWITLNEPWCSAFLGYGSGVHAPGRTDAAASLRAAHHLNLAHGLGTSALRAAMPARNTVAVSLNSSVVRTVSDSPADVAAGRRIDDLANGVFHGPMLHGAYPAGLFAATASVTDWSFVQDGDLEAVNQPLDALGLNYYTPTLVSATESAPAGPRADGHGASSFSPWPGADDVVFHLTPGERTEMGWSIDPTGLHELIMRYTREAPGLPLYITENGAAYDDKPDPEGRVHDPERIAYLHGHLTAVRRAITDGADVRGYYLWSLMDNFEWAYGYGKRFGAVYVDYATLARTPKSSARWYAQAARTGTLPGATAAE

SEQ ID NO: 17909 - protein, 669 aa, Oryza sativa (japonica cultivar-group)
MSISHCEDNDSDRISNLPDKLLHHVMSYLTAQEAVRTCVLSRRWQNVWSSMMFLHANAAKSSSITSFKKFLDNVLLYRNPVPLKGLWVSAACDNSDDSLDYSDIHRWVHHVLRSNAREVGIFVRCGSKLLSIDGYPFAFNSVHLSKLVLFKFTVNDCFAKKFSSGCPVLKDLVLISCGIDVTMFSSTTLKSFVIHNAEDIEHLPKQIEYLVIEMPNLVTLHIEEIPRRNIHLVDLSSVKEATIYFFEHSFRNSAVDCNILSALSNATSLKLICDSVYDEVSKLGAEEYEKFPTAAAAIDPPCKEAARTFHCEKLTEIEIVYPQGDKRVHIIRQHLARKLLDSMSLIEQVLPATGMTTSINEENAPDRISRLPDGLLRFVMLYLTAQEAVQTCVLSRRWQNVWSSTKWLKADAAKFSSMKSFKKFVDNLLPYRRPVPLDALFILATCNHSDDSLDYSDIHPWIRHALRSNAWALGIMEHCGTNLLSIDDEIPNRNIQLVDVSSVKRATFYFFELSFQNSAVDCNIIPALSNVTSLELVSPTAYEDVVPNVLIRSFPRCKTFSNLKYLKLGEWFLRDGCYPLLFLLRRSPNIEKLHLQLNKYGSDDYEDYPDAAAAIDPTCREIEEMFNCVKLRKITIFYPQGDERVHIIVRILIANISPLPAIKIKPTPV

SEQ ID NO: 17910 - protein, 873 aa, Clostridium symbiosum
AKWVYKFEEGNASMRNLLGGKGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMASHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 17911 - protein, 549 aa, Bacillus subtilis subsp. subtilis str. 168
MAELIHSTIGRLLEQTADAYPDRDAVVYPDRNIRYTYAQFDSLCRQTAKGLMRMGIGKGDHVAIWASNISEWLAVQFATAKIGAVLVTVNTNYQAHELDYLLKQSDAAALIIMDSYRGTSYPDIVNSLIPELQEAKPGQLKSERYPFLKTLIYIGNKRLSGMYHWDDTEILAKTVTDAELEERMNSLDKDNVINMQYTSGTTGFPKGVMLTHFNVINNAANIAECMALTSQDRMCIPVPFFHCFGCVLGVLACVSVGAAMIPVQEFDPVTVLKTVEKEKCTVLHGVPTMFIAELHHPDFDAYDLSTLRTGIMAGSPCPSEVMKAVIERMGMKDITIAYGQTEASPVITQTRANDSFIRRVETTGRALPHTEVKIVEPGTCQEVQRGMQGELCTRGYHVMKGYYKDKDATRKAINHDGWLFTGDLAVMDEDGYCRITGRLKDMLIRGGENIYPREIEEFLYQHPAVLDVQVVGVPDAKFGEEAAAWIKLKDGKSVSPDELKAYCKGKIARHKIPRYVIFTDDYPMTASGKIQKYKLREKTIEMFNLSSSQ

SEQ ID NO: 17912 - protein, 228 aa, Mycobacterium smegmatis str. MC2 155
MPPHFLDGEPHTHTDRPKRVRKPGEPLRIGVGGPVGSGKTALVAALCRQLRDELSLAVLTNDIYTTEDADFLRRNAVLPDERIAAVQTGGCPHTAIRDDITANLDAIDDLIEMNPALDLILVESGGDNLTATFSSGLVDVQIFVVDVAGGDKVPRKGGPGVTFSDLLVVNKTDLAPLVGADLDVMRRDAAKVRAERPTALISLTEDPTAGPVLDWVREQLRVAAAQTV

SEQ ID NO: 17913 - protein, 225 aa, Triticum aestivum
  misc_feature (187)..(187): Xaa can be any naturally occurring amino acid
  unsure (1)..(225): unsure at all Xaa locations
MPPPISPLPLMASSPIPSPPAARPGSGRALAAVAPCNSSASPSPSTSTSSVAPASGGRRGVLALGAGFLASAALLCPAGDAGATRIEYFATVGDKLCDMDFAKSGLGYCDVEVGTGVQPKRGELINIHYTARFPDGTVFDSSYKRGKPLTMRIGASKILRGLQQGIGGGGGVTPMLVGGERKLMIPXNLAYGPKPAGCFLRDGKIPGNSPKLYEFPSRRHLQVSV

SEQ ID NO: 17914 - protein, 430 aa, Oryza sativa (japonica cultivar-group)
MIWWNIMSRSKCDKAINHISTLHKQIRSRSRVAISLIAVTISLIAVIHIGSGLLVPMKARLVVLAAAVAAAALLVSLDPRSDDVPVLEIWERDVELITVDAGGAVGPESVAFDGDGDGPYTGVSDGRVLKWLPLERRWVEHSSAVIEPHMLDSCRGSKDTKREQECGRPLGLKFNSKTGELYVADAYLGLRVVSPGENVSRPLVPKWTESPFSFSNGVEIDHETGVIYFTETSTRFQRREFLNIVITGDNTGRLLKYDPKENKVEVLVDGLCFPNGLAMSNDGSYLLLAETTTGKILRYWIKTPKASTIEEVVQLHGFPDNIKMSPRGGFWVGLHAKRGKIAEWSISYPWLRKVILKLPAQRIQRITSFLTGFGRQVIALRLSEDGKTIEAMSVHGDVRKLFKSISEVEEKDGNLWIGSVLSPFLGLYRI

SEQ ID NO: 17915 - protein, 337 aa, Vibrio angustum S14
MTDIRTLGEFIVEKQSDFPHASGELSSLLGSIKLAAKIVNREINKAGLVDITGTVGENNIQGEEQQKLDVYANDKFKAALEARDQVCGIASEEEDEAVGFDKPLNLNAKYVVLMDPLDGSSNIDVNVSVGTIFSIYRRVSPVGSPPTKEDFLQTGNQQVAAGYVIYGSSTMLVYTTGNGVHGFTYDPSLGSFCLSHENMTIPQDGVIYSINEGNYIRFPTGVKQYIKYCQEAVPEEKRPYTSRYIGSLVADFHRNLLKGGIYLYPSTASYPNGKLRLLYECNPMAFIIEQAGGKATNGFQRILDIPPTELHQRVPFFVGSTNMVEKVEGFLREYPDD

SEQ ID NO: 17916 - protein, 235 aa, Triticum aestivum
  misc_feature (20)..(20): Xaa can be any naturally occurring amino acid
  unsure (1)..(235): unsure at all Xaa locations
NLLTRRRNEEVVKTSSGEKXHGAKCIITVGAWTSKLVKSVTGFDLPVQPLHTLLCYWKLKPGHKRELTTEAGFPTFSSYGDPCIYSTPSMEYPGLIKIAMHGGPPCDPDSRDWTIGTGEGVGGLPDPVARWIDEVMPGHVDTAGGPVLRQACMYSMTPDEDFVIDFLGGEEFGRDVVVGAGFSGHGFKMGPAIGRILAELALDGESTTAAEAGVELTHFRIERFDGDPMGNATSS

SEQ ID NO: 17917 - protein, 150 aa, Thermotoga maritima MSB8
MRVKDAVIYDISAVFEDETVETVIKLLSRQNLSGVPVVDHDMRVVGFVSESDLIKALVPSYFSLLRSASFIPDTNQLIRNVVKIKDRPVSEFMNKPPVVVKEDDPLIVAADYLIRHGFKSLPVVDEAMQLVGIVRRIDILRVVSEGKLEI

SEQ ID NO: 17918 - protein, 338 aa, Clostridium difficile 630
MKIKVGMNGFGRIGRAVLRIAQEELGDNIEIVPINARATTESLAHLFTYDSCYGTFRGEVEAKDEDTLVVNSKEIKILRYNDPEELPWKELGVDIVIESTGLFTQREKAEKHIKAGAKKVIITAPGKNEDITIVIGVNEKEYDNEKHNIISNASCTTNCLAPFAKVLDEKFGIVKGLMTTVHSYTNDQRILDKSHKDLRRARAAAESIIPTTTGAAKAVSRVLPQLEGKLNGFSLRVPTPTVSLVDLVCELKENVTSEQVNSVLKDAAEGELKGVLGYCDKPLVSIDYKGDSRSSIIDALSTMVIEDNMVKVVSWYDNEWGYSSRTVDLVKYVAEKLK

SEQ ID NO: 17919 - protein, 166 aa, Griffithsia japonica
GTRSNPSFTEMLKGSLVPSFGEPVGKGIFLSVSIIGSVVMAHNLFLHSWLEQKRADEAEEASSGHQVFNMNGRLSGLDKRLKYATVESCAIFLCTFLVNAAVVTAASKLPRSVEAPGLKTAGTLLESTFGHRLAGTAWAVALLASGHAATVTGALSSQAVCQGVMG

SEQ ID NO: 17920 - protein, 568 aa, Debaryomyces hansenii CBS767
MSKLRTEKSNKLEAVVSEIEPYYSDSSREGSRWANFKDSFKRQVPSDEANGSSGIQMQKSISKRHLRLMALSTGLGTGLLVAAGAKLATAGPLFLLVGYAVVGYLMLIPCINAVGELSVAYNNLPGGFQSYYRKFMDESIAFAVGWNYCFQWATVISLELVTAGMTIRFWTTSINPDIFVLIFLIVVVLINLAGAKGYGEAEFYMNSVKLLMLGGFIIFGIIIDCGGGPAGYIGGRYWHNPGAYTSFKGLCSVFVTSAFSLGGTEFISLSAAEQENPRQSIPAACKLVFFRITVFFLGSLALVGLLVPYNSDKLMGSGESGTSPYVIAAQMHGVKVIPHIFNAVILVSVTSVATAAMYSSTRLLQSLAEQGYAPQYLNYIDRAGRPLRCWIVTILSSFFAFIATYKDQESVFTWLLSISALSFIFTWASIDICHIRFRAALKYNNIPLSSLGYVSSTGTIGSYISFILNILILICQFWVSLFPIGGDGSPNALSFFQNYLGAVVLVIFYVGHKLYTRNWSLYIKVQDIDIDADRTIYDPEILELENLESKQRFNKAPFWKKILIYCFD

SEQ ID NO: 17921 - protein, 320 aa, Debaryomyces hansenii CBS767
MLTLAIGDIYIPDRAFELPLKFRKLLCPNPNTIPTNNKLSKVLCLGNITNSYDTLKFLYDLSPSFNMVGGEFDNSQILSQQIALLNGKESQVPTYNIIQHDNLRIGFTNGYLVVPKNDPLALLTLAREIDVDILIWGGTHKVEAYTLDGKFFINPGSATGAYNFDWPEKEDESEEEEEEGESQKDSKEGNSEPAKEESKEKEIAEEESKKDEENNADKKDEIESNEQENKEGAHEEVKEPSEQKNVDSKDNEGVVEKNKNKEDANDSDSDDTNLIEEVKESTSSIPSFCLLDTHDSTCTLYIYTYFHGEVKVDKVTYQKE

SEQ ID NO: 17922 - protein, 304 aa, Fusobacterium nucleatum subsp. nucleatum ATCC 25586
MKELLKELVEKNRKFTADGNVANYIPELDKADKNALGIYVTTLDGQEFFAGDYNTKFTIQSISKIISLMLAILDNGEEYVFSKVGMEPSGDPFNSIRKLETSSRKKPYNPMINAGAIAVASMIKGKDDREKFSRLLNFAKLITEDDSLDLNYKIYIGESDTGFRNYSMAYFLKGEGIIEGNVNEALTVYFKQCSIEGTAKTISTLGKFLANDGVLSNGERILTTRMAKIIKTLMVTCGMYDSSGEFAVRVGIPSKSGVGGGICSVVPGKMGIGVYGPSLDKKGNSLAGGHLLEDLSAELSLNIF

SEQ ID NO: 17923 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAILSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRSTAVKRVLVMESVADELVEKIREKVLALTIGNPEDDADITPLIDTKSADYVEGLINDANDKGATALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 17924 - protein, 411 aa, Frankia sp. CcI3
MQRIVVVGAGMAGGRAAAEVRARGFAGEVILLGAEPHRPYDRPPLSKAVLSGRIDDTTLPFDLDGVEVRLGRRATGLRPGTVETDAGPLDYDGLVLATGADPVTLPGDGPQRVLRSIDDARDLRGALRPGVRLVIVGAGWIGAEVATAAAAIGAEVTVVEAAASPLFAALGAQVGRCTIAWYARAGVTLRLATAVERVTPDGLVLAGGEELIADEVVVGVGVRPGTAWLAGSGLALDRGVVVDEHLAARWTHGADGADGDRPPVVAVGDCAAWWSRRYGRRLRVEHWDCAQQSPAVAVSTLLGGEAVYDPVPYFWSEQFGRMVQFAGLPSAEAAPVFRGDPGVVVPPDGGRPSGWSAGWFAPDGRLEALVTVGRPMDMVAGRRLMAADGIPDRERFADISVSMKELAAASR

SEQ ID NO: 17925 - protein, 243 aa, Triticum aestivum
MATDRVKASVLHGEKDLRLEERELPKPSSNEVQVAVQSTGLCGSDLHYYNHFRNGDIIVREPLTLGHESAGTVVAVGSEVTHLKPGDHVALEVGLPCETCELCDEGRYNICRGMKFRSSAKANPHAQGTLQERINHPAKWCHKMPEHVTLDLGALVEPLSVAMHARDRASLPKGSTVLVLGAGAVGLLAAAVAKADQAKTVIIADILKDRLDFATSNGFADASVVGPMEPQLSRTAGFRSKVA

SEQ ID NO: 17926 - protein, 211 aa, Staphylococcus aureus
PSADMLFEPSFVNDIDVNENDVVHFCSVDLVDSPMRDTHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPPLQEVEQAF

SEQ ID NO: 17927 - protein, 91 aa, Brassica napus
  misc_feature (71)..(71): Xaa can be any naturally occurring amino acid
  unsure (1)..(91): unsure at all Xaa locations
LLDLGINAVELLPVFEFDELELQRRPNPRDHMVNTWGYSTVNFFAPMSRYASGEGDPIKAAKEFKEMVKAXHSAGIEVMLDIVYNHANEAD

SEQ ID NO: 17928 - protein, 306 aa, Zea mays
  misc_feature (176)..(176): Xaa can be any naturally occurring amino acid
  misc_feature (213)..(213): Xaa can be any naturally occurring amino acid
  unsure (1)..(306): unsure at all Xaa locations
MAAAPSSLVSSHLSRLADLRRAAAPATPTVPQQLRVGFSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIALXIRELLEEREAGKTFEVCFEQMKAFADSISNWADVVIXAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 17929 - protein, 258 aa, Triticum aestivum
  misc_feature (115)..(115): Xaa can be any naturally occurring amino acid
  unsure (1)..(258): unsure at all Xaa locations
VSREQRWSLAGATALVTGGSRGIGHAIVEELVGLGARVHTCSENAAELEECRRRWEETKLPVTVSVCDVSVRAEREKLMETAKQTFDGKLDILVNNVGRNVAKAAVEWTAEEYSXLMSTNLEAAFHLSQLAHPFLRDASIAGGGSVVNISSVASSLGYPTLALYCISKGGVNQLTRSLAAEWAQDKIRVNSVAPGGINTELQNSVDPKVIENTLLRTPMHRLGEPVEVASMVSFLCMPAASFLTGQVIYVDGGRTISG

SEQ ID NO: 17930 - protein, 507 aa, Zea mays
MEAAAASSLWGGLNSGIMLSLLAVVWAMLWQALQGLQLQQYFGRHSRRLSRRLASILDPDLTVTVAEYDGGRMRRSDAFKEAKAYLERATREARGGVRHLKAEPDKDPDRLLLSMDDDEEITDEFRGATVTWRACTAPPREDSAPAYFWGRAPRADRRFYRLFFAERHRDLVLGDYLTHVRREGRAVMVKNRQRKLFTNISGDGSWDSDGVWSHVVFEHPKTFATLAMDPDKKKEVMDDLDAFRNGKDYYARVGKAWKRGYLLYGPPGTGKSTMIAAMANHLDYDVYDIELTSVRTNTDLRKLFIETTSKSIIVVEDIDCSLDLTGKRKKKNKKEEDGENKKDGTTTKQQEEDKEKEDEKAGGSKVTLSGVLNFIDGLWSACGGERIIVFTTNHVEKLDPALIRRGRMDKHIEMSYCCVQAFKFLAKVYLDVDDHPRFDAVAALLREVDMTPADVAENLTPKAPGEDADSCLAALVEALEKAKEDALAKKAKGKEEAGSADELDDEE

SEQ ID NO: 17931 - protein, 465 aa, Rhodopirellula baltica SH 1
MSNATKQRPHVVVVGGGFAGLQATRDLRKVDVSVTLLDRRNFHLFQPLLYQVATGELSPANIATPLRGILRKQKNARVVLEEVTSISLDSNEVYTTDSVIAFDYLIVATGAIHHYFGREEWRPLAPGLKTIENATEIRRQILGAFEAAERSSDPDEIHDLLTFVIVGGGPTGCELAGALAEISRHTLQNDFRSIQPADARIVLVESGDAPLDVYPEPLPQRAALDLKKLGVEIQTQCRVVEIEPTHVMIRNKTTEEVSRLNTRTVLWAAGVKASPLGAILCEAAGIESDRGGRVPVSPDLSIAGHGTVFVCGDLAQVKMEDGGEVPGLAPAAMQMGTQAAKCIRADLQSKPRPEFRYRDKGSLAVIGRCTAVGQIGSYKAKGFVAWFIWLFIHLMYITLFRNRLLVLMQWGWTFVTHDRSARLITDGANTDISTMEQATGWNADPAMPSTRRLEPTSQTGVGGSD

SEQ ID NO: 17932 - protein, 250 aa, Kineococcus radiotolerans SRS30216
MTEAAHTLVLLRHGESEWNALNLFTGWVDVALSEKGRAEAAAGGRMLVENGVLPDVVHTSVLRRAITTAFLALDAADRHWIDVKRSWRLNERHYGALQGKDKKQTLAEFGEEQFMLWRRSYDTPPPAIEAGSEFSQDGDPRYAGLGDDMPATECLADVVARMLPYWTESVVPDLRAGRTVLLAAHGNSLRALVKHLDGVSDADIAGLNIPTGIPLVYRLDADLKPLVPGGEYLDPAAAAAAAAAVANQGR

SEQ ID NO: 17933 - protein, 137 aa, Zea mays
KWTFLLFLGSLCIGLLFTNRLVIDKETGKPKGYGFCEYKDEETVLSACRDLHGYEINGRQLCVDFAENGRNTYSNREKVDNPQNYYRRAITTTLEFFINTSSCIVFIHVNDNSCASSDYHVSPVAISYKHVYICTTA

SEQ ID NO: 17934 - protein, 110 aa, Hizikia fusiformis
MKNFFFCLFIPYITAIIFCTPVQAADINHGENVFTANCSACHAGGNNVIMPEKTLQKDALSTNQMNSVGAITYQVTNGKNAMPAFGGRLSDDDIEDVASFVLSQSEKSWN

SEQ ID NO: 17935 - protein, 503 aa, Gossypium hirsutum
MAVQVPSRQLFIDGEWREPILKERLPTINPATEEIIGNIPAATAEDVELAVAAARRALSRNKGKDWATAPGAVRAKYLRAIAAKVTERKTELAKLEAIDCGKPLDEAVWDIEDVAGCFEYYADLAEGLDARQKAPVSLPMETFKSYVLKEPIGVVGLITPWNYPLLMATWKVAPSLAAGCAAILKPSELASITCLELAKVVKGSRLPPGVLNILAGLGPEAGAPLASHPDVDKIAFTGSSATGSKIMAAAAQMVKPVSLELGGKSPIIVFEDVDLDKAAEWTAFGCFWTNGQICSATSRLIVHENIAREFLDRLVKWTKNIKISDPFEEGCRLGPVVSGGQYEKVLKFISTAKSEGATILSGGVRPEHLKKGFFVEPTIITDVTTSMQIWREEVFGPVLCVKTFRTEEEALELANDTHYGLGAAVISNDLERCDRVSKNLQAGIVWVNCSQPCFCQAPWGGNKRSGFGRELGEWGLDNYLSVKQVTQYVSDEPWGWYRSPSKL

SEQ ID NO: 17936 - protein, 206 aa, Mycobacterium smegmatis str. MC2 155
MPNSNPVAAWKALKDGNARFVAGQPLHPSQGIERRASLTQAQRPTAVVFGCGDSRVAAEILFDQGLGDMFVVRTAGHVIDNAVLGSIEYAVTVLKVPLIVVLGHDSCGAVKATLSALDEGEVPSGFVRDIVERVTPSILLGRKAGLSRVDEFEAQHVNETVAQLQMRSTAIAQGLAAGTQAIVGTTYHLADGRVELRSHLGDIGEV

SEQ ID NO: 17937 - protein, 341 aa, Frankia sp. CcI3
MRIGVLTGGGDCPGLNAVIRAVVRKGESVYGHSFVGYRDGWRGPLTGETVPLDIAAVRGILPRGGTILGSSRTNPYAAVDGPALVREHLAAAEVDALIAIGGEDTLGVAAQLHAEGLPVVGVPKTIDNDLSATDYTFGFDTAVNIATEAIDRLHTTAESHHRVLIVEVMGRHAGWIALHSGMAGGANVILIPERPFDFDKVCAFVEARFATHYAPIIVAAEGAVPITGTLVAREGEVDAFGHVRLQGIGAVLETEIRARTGRDARATVLGHLQRGGTPTAFDRWLATRFGLHAVDAVHEGDFGVMVALHGTRIDRVPLQDATRELKTVPEELYHEAEIFFG

SEQ ID NO: 17938 - protein, 211 aa, Staphylococcus aureus
PSADMLFEPSFVNDIDVNENDVVHFCSVDLIDSPMREAHYQLITKTLNSNGTVVFDPNVRLPLWDNAEDLRQTIHTFLPLAHIVKVSDEELEFITGIHDENEAIQSLFTGNVTVVIYTKGADGAAVYLKNGNNHYHSGYKVKPVDTTGAGDAFIGAVISRILATDVLNLTQLFENEGEEILAFSNRVAAIVTTKYGAIISLPTLQEVEQAF

SEQ ID NO: 17939 - protein, 523 aa, Olea europaea
MAGGGFGPGPGTGKEYPGNLTLYVTVACIVAAMGGLIFGYDIGISGGVTSMDSFLEKFFPSVYRKQEADDSTNQYCKFDSQTLTMFTSSLYLAALVSSLVASTVTRKLGRKLSMLFGGVLFCAGALINGFAHHVWMLIVGRILLGFGIGFANQAVPLYLSEMAPYKYRGALNIGFQLSITIGILVANVLNYFFAKIHGGWGWGGLSLGGAMVPALIITVGSLVLPETPNSMIERGNHDVARAKLKRIRGIANVDEEFNDLVAASEESRKVEHPWRNLLQRKYRPHLTMAILIPIFQQLTGINVIMFYAPVLFKTIGFGSDASLMSAVITGCVNVLGTMVSIYGVDKWGRRFLFLEGGIQMLICQIVVAICIALKFGVDGNPGELPKWYAIVVVLFICVYVAGFAWSWGPLGWLVPSEIFPLEIRSAAQSINVSVNMVFTFAIAQVFLTMLCHLKFGLFLFFGFWVIIMTIFIFFFLPETKNIPIEEMVIVWKQHWFWSKFMTDVNYPNGSIELENGNGTFKKV

SEQ ID NO: 17940 - protein, 473 aa, Rhodopseudomonas palustris CGA009
MSETSFDVIIIGSGPGGYVAAIRAAQLGFKTAIVEKSYLGGICLNWGCIPTKALLRSAEIYHYMQHAKDYGLSADNISFDPKAIVQRSRGVSKRLNDGVGFLMKKNKISIIWGQATIDAPGKLTVAASKTDAPKGALPPGSYQAKHIIVATGARPRVLPGLEPDKKLVWTYFEAMVPEVMPKSLLVVGSGAIGIEFASFFHTMGAKVTVVEVLPQILPVEDAEIAALARKRFEKQGIKILTGAKVTKLDKKADSVVATIDPGNGKPETAEFDRVISAVGVVGNVENLGLDKLGVKLDRGTIVTDGLGRTNVPGLYAIGDVAGPPMLAHKAEHEGVICVEAIKGLHPHPLDKSLIPGCTYCQPQVASVGLTEAKAKEQGREIRVGRFPFTANGKAIALGEDQGLVKVIFDKKTGQLLGAHMIGAEVTELIQGYVVAMNLETTEEELMHTVFPHPTLSEMMKEAVLDAYGKVLNA

SEQ ID NO: 17941 - protein, 463 aa, Rhodopseudomonas palustris CGA009
MPINILMPALSPTMEKGNLAKWLKKEGDKVKSGDVIAEIETDKATMEVEAADEGTLAKIIVPEGTQDVPVNDVIAVLAADGEDVKAAGAGWKASAGGAPSPQRGEGAGPSGGKAEANSHIQDKADQRPTPQPPSPLPNGERSLPQAAGEGAPAPANGRVFASPLARRLAKDAGIDIARVTGTGPHGRVIARDVEQAKSGGGLKAPASAPAGPAIAAAMSDQQIRALYPEGSYEVVPHDGMRRTIAQRLTQSTQTIPHFYLTIDCNLDRLLAAREDINAAAPKDKDGKPAYKLSVNDFIIKAMAIALQRIPDANVSWTEGGMLKHKHSDIGVAVAMPGGLITPIIRSAETQSLSSISAQMKDFAARARARKLKPEEYQGGTTAVSNLGMFGIKDFTAVINPPHATILAVGTGEQRAIVKDGKIEVATMMSVTLSCDHRAVDGALGAELIGAFKTLIENPVMMMV

SEQ ID NO: 17942 - protein, 228 aa, uncultured cyanobacterium
HEVAGAGQHELGMKFAQLIEAADNVMIYKYVVRNVAKKYGKRPPFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVPPSLNGALEALSADRAFLTEGGVFTD

SEQ ID NO: 17943 - protein, 242 aa, Glycine max
MSGKRPRPMIGKLSELLVSRGRTVALLDTTGSPRGPLDMKMMQSPRGLKNYDLGGVGLGIVVALDKSNNEVAAREVLPKHTVCTSNLNRSGPIPVHYTKNPDEFDVEEYTYVTCRVPNKTFTKVYYDGGEGDIIRRQNNNNNNKNNVVVLRRTEPQPLIEPESSYPTSSFLSSCHLCGKKLHGKDIYMYRGEKAFCSPECRSSQITMDERKERCSSEASRSVEMSSSPYTREQIFSTGILAL

SEQ ID NO: 17944 - protein, 340 aa, Xanthomonas campestris pv. campestris str. ATCC 33913
MKALVKREASKGIWLEQVPVPTPGPNEVLIKLEKTAICGTDLHIYLWDEWSQRTITPGLTIGHEFVGRVAELGSAVTGYQVGQRVSAEGHIVCGHCRNCRGGRPHLCPNTVGIGVNVNGAFAEYMVMPASNLWPIPDQIPSELAAFFDPYGNAAHCALEFDVIGEDVLITGAGPIGIIAAGICKHIGARNVVVTDVNDFRLKLAADLGATRVVNVSKTSLKDVMADLHMEGFDVGLEMSGNPRAFNDMLDCMYHGGKIAMLGIMPRGAGCDWDKIIFKGLTVQGIYGRKMYETWYKMTQLVLSGFPLQKVLTHQLSIDEFQKGFDLMEEGKAGKVVLSWN

SEQ ID NO: 17945 - protein, 693 aa, Xanthomonas campestris pv. campestris str. ATCC 33913
MTASPSRRDFLKRVAALTAAGALPASIGRALALPANARTGTLRDIEHVVILMQENRSFDHYFGTMRGVRGFGDPRALQLRDGNPVWSQAASDGRRVLPFAFDARNTCAPLIKSLDHSWKAGHGQDPLRWQEYDAWVPYKGELTMGYFQRSDIPYYHALADAFTICDGYFCSLHGPTNPNRMYLFTGTSGLSVGNTGAQTVTNADDGNWTADMARDKPGYAAMQWTTYAQRLQAAGVDWRVYQEYDNFGCNSLAYFAHYRDLDRNDERYRRARACVPGSTADNAATTQADHLVAAIAADVQANRLPQVSWVIPPTAYCEHPEAPPAYGESLVARLIDALTANPEVWSKTALIINYDENDGFFDHVPAPLPALDARMGRSNVDARGEVHEGVPVGLGIRVPMLVISPWTRGGWVNSQVFDHTSVLRLLERRFGVAEPNISPWRRAVSGDLTSVFDFRQPDHSALSALPAIGDYRARTAAVRDKPLPVPPTTAQMPRQEPGQRPARALPYALQVHARVHDDSGVQLQFINTGAAAAAFNVYTSAATGGPWYYTVLPGTQLDDVPMGAVHDGAYALRVHGPNGFLREFAGNLGAEQPALAAPWVQARQDGELLVLEIGNAGRQPCTLQVRALDYAEPTTQPLQLAAGQRHTLRLTLAASDHWYDIVVEQPGSAFRRRLAGHLETGKPSRSDPALGRA

SEQ ID NO: 17946 - protein, 469 aa, Rhodopseudomonas palustris CGA009
MPIQVLMPALSPTMEKGNLSKWLKKEGDKVKSGDVIAEIETDKATMEVEAADEGTLGKILIPEGTNDVAVNTPIATILGDGESAADADKASDPAAQSKASQSAPPSAEPEAAQAKSAPAPAQHAPEAPTVSAAADPDIPAGTEMVTVTIREALRDAMAEEMRRDPDVFVMGEEVAEYQGAYKVTQGLLQEFGDRRVIDTPITEHGFAGVGVGAGFAGLKPIVEFMTFNFAMQAIDQIINSAAKTLYMSGGQLGCSIVFRGPNGAASRVAAQHSQDYSAWYAQIPGLKVVAPYSAADAKGLLKAAIRDPNPVIFLEHEMLYGQHGEVPKLDDYVIPIGKARIVREGKDVTLISWSHGMTYALKAADELAKDGIAAEVIDLRTLRPLDTDTIIASVKKTGRAVTIEEGWQQNGVGAELSARIMEHAFDYLDAPVTRVSGKDVPMPYAANLEKLALPSVAEVVEAAKAVCYR

SEQ ID NO: 17947 - protein, 434 aa, Glycine max
MPSLVAEAFEAKGAEPLSLKPIFSASGVKGKRVTALSAEANALTDFIQAIIADKPDIDSPFSVLDLGVVMGLMDKWACKLPTVQPFYAVKCNPNLSLIGALAALGSSFDCASKAEIESVLSLGVSPDRIIYANPCKSESHIRYAASVGVNVTTYDSLDEVEKIRNCHPTCELLLRIKPPQDSGARTSLGLKYGALPEEVHELLQAAHEAGLKVTGVSFHIGSGGADTRAYDGAISAAKNVFEMASGLGLPRMRVLDIGGGFTSGPPFEAAALKINAAIQASFGNEEGLVVIGEPGRYFAETAFTLATRIIGKRVRGDVREYWIDDGIYGTLNNIVFDYATVTCMPLACTSKPENPRCSRELNLKTYPSTVFGPTCDSIDTVLRDYKLPGLQVNDWLVFPNMGAYTTSSGTNFNGFSSSAKSTFLAYSSPEHSMF

SEQ ID NO: 17948 - protein, 406 aa, Vibrio angustum S14
MTTEQRVERNLFDEVMVPCYSPMAEIPVRGSGARVWDQHDREYVDFAGGIAVSCLGHCHPIMVNALKDQADKLWHLSNVLTNEPALRLAKKLTELCFADKVFFANSGAEANEAALKLARRYAVDKFSTEKDQIIAFHQGFHGRTFFTVTVGGQEAYSDGFGPKPQAVTHIPYNDLSALAEIMSERTCAVMMEPLQGEGGLVSPSVEFVQGVRELCDKHQALLIFDEVQTGNGRTGDFYAYQGLGVTPDILTTAKSLGGGFPIGAMLTTTALAEHLKVGTHGSTYGGNPLACAVAEAVINEVSKPDVLAGVKEREHWFREGLTAINAKYPIFAEIRGKGLLLGASLTEEWQGRARDILVQAGKEGLMMLVAGTNVVRFTPSLVIEKADVDEGMARLERAIATLYNAE

SEQ ID NO: 17949 - protein, 511 aa, Cryptococcus neoformans var. neoformans
MFARQPLSQNLLRPLSRPSSSFSRTSTIPKLAFLQSARGFASASEPYDVVIIGGGPGGYVAAIKAAQLGFKTACIEKRGALGGTCLNVGCIPSKAMLNNSHIFHQTQHDLKNRGIDVSGIQLNLPKMLAAKEASVKALTGGIETYLFKKNGIDYIKGEASFETANKLSVKLLEGGETQVEAKNVIIATGSEVTPFPGLEIDEERIVSSTGALELKEVPKKMVVIGGGVIGLELGSVWSRLGAEVTVVEYLGAIGAGMDGEIGKQFQKILTKQGFKFKLNTKVISGHREGDIVKLKVDSAKGGKEETIEADVVLVAIGRRPVTTGLNLEAIGVETDKRGRIIIDDEFNTSAKGVKCIGDVTFGPMLAHKAEEEGIAAVEILKTGHGHVNYDAIPSVVYTHPEVAWVGKNEEELKGAGVQYKIGKFPFAANSRAKTNQDSEGFVKFIVEKETDQVLGCHIIGPAAGELIASAVLAMEYKASAEDIARTCHAHPTLSEAFKEAALSSYDKPINF

SEQ ID NO: 17950 - protein, 211 aa, Staphylococcus aureus
PSADMLFEPSFVNDIDVNENDVVHFCSVDLIDSPMREAHYQLITKTLNSNGTVVFDPNVRLPLWDNAEDLRQTIHTFLPLAHIVKVSDEELEFIIGIHDENEAIQSLFTGNVTVVIYTKGADGAAVYLKNGNNHYHSGYKVKPVDTTGAGDAFIGAVISRILATDVLNLTQLFENEGEEILAFSNRVAAIVTTKYGAINSLPTLQEVEQAF

SEQ ID NO: 17951 - protein, 479 aa, Bacillus thuringiensis serovar konkukian str. 97-27
MTTSNTYKFYLNGEWRESSSGETIEIPSPYLHEVIGQVQAITRGEVDEAIASAKEAQKSWAEASLQDRAKYLYKWADELVNMQDEIAEIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVSLVKEQVAKLSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 17952 - protein, 427 aa, Rhodopseudomonas palustris CGA009
MTAIVDIIGREILDSRGNPTVEVDVVLEDGSVGRAAVPSGASTGAHEAVELRDGDKARYLGKGVQKAVEAVNGELFDALGGMDAEQQVQIDQTMIELDGTPNKGRIGANAILGVSLAAAKAAAASYDMPLYRYVGGTSARTLPVPMMNIVNGGVHADNPIDFQEFMIMPVGAPTFADALRCGSEIFHTLKGELKKAGHNTNVGDEGGFAPNLPSADAALDFVMAAIGKAGYKAGGDVMLALDCAATEFFKDGSYVYGGENKTRSRSEQAKYLADLVARYPIVSIEDGMSEDDMDGWKELTDLIGSKCQLVGDDLFVTNVTRLADGIKNGRANSILIKVNQIGTLTETLAAVEMAHKAGYTAVMSHRSGETEDSTIADLAVATNCGQIKTGSLARADRTAKYNQLLRIEQELGAHAHYAGKAALKALR

SEQ ID NO: 17953 - protein, 432 aa, Bifidobacterium animalis subsp. lactis
  misc_feature (8)..(8): Xaa can be any naturally occurring amino acid
  misc_feature (10)..(10): Xaa can be any naturally occurring amino acid
  misc_feature (12)..(12): Xaa can be any naturally occurring amino acid
  misc_feature (423)..(423): Xaa can be any naturally occurring amino acid
  unsure (1)..(432): unsure at all Xaa locations
MAVIESVXAXQXLDSRGNPTVQVVLDTEDGAQGLGLVPSGASTGEAEAWERRDGDKSVYGGKGVLNAVKAVNEVIAPKVIGMDAADQRALDDLMIELDGTPNKGKLGANAILGVSLAALYASAESAGLPLYRYIGGTNGHILPVPNMNIMNGGAHADFATDIQEYMISPYGFDTYSEALRAGVEVYHTLKNVLKKEGLNTGLGDEGGFAPKMKSNEDSLKYIMDAISAAGYEPGKQIGICLDVASSEFYNKETGKYRFDGEERDSAYMLDYYENLINEYPIVSIEDPFNEEGWEDWAAITARLGDRLQFVGDDLLVTNPARLQKAIDLGAANSLLVKLNQIGSVTETLDAIELATANGYTSMVSHRSGETPDTTISDLAVAKNTRQIKTGAPARGERVAKYNRLLEIEEELGSTAQYAGYSAXGTCKKYLAK

SEQ ID NO: 17954 - protein, 115 aa, Glycine max
  misc_feature (87)..(87): Xaa can be any naturally occurring amino acid
  misc_feature (99)..(99): Xaa can be any naturally occurring amino acid
  unsure (1)..(115): unsure at all Xaa locations
AAPIPTTSRVLAVIRLSKGNHSNYHATFKRLRKTKGYVEFHESPPDNFDPGQPYNDPVATQQITEPIVLDKLIQIEIARIIREKLQXCYRIYGVTHLHXCRHLVNHYHKSSLVIR

SEQ ID NO: 17955 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLATGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 17956 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 17957 - protein, 228 aa, uncultured cyanobacterium
HEVAGAGQHELGMKFAQLIEAADNVMTYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVPPSLNGALEALNADRAFLTEGGVFTD

SEQ ID NO: 17958 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGECRHCHSEESNMCDLLRINPERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 17959 - protein, 364 aa, Candida albicans SC5314
MSVIAGHHVPRSNDQRQYDTPSVPINIAPDSEGHIHEMSRLKDYEVIEKLGQGTFGVVQKAKSKKDGSLVAIKQLINHSAKEGFPITAMREITILKQLNHQNILTIQDMIFEEPKMSNRTDIITMRGSFYTVTPYMSSDLVGLLENPKIKLELGQIKCIMQQLLKGIQYVHNQKFLHRDIKAANILIGHDGVLKIADFGLARIYHGNVPRLGMGPGGGEKAYTGLVVTRWYRPPEILLGERKYTTAVDLWGIGCVFAELFTGKPILVGKSDSHQAQIVFELVGSPLTWTDAAKLPNKNEYSCGLACKRSLEAKFASIMPTEAIDLLSGLLTLDPFKRLNALDALNHKFFSTDPLPLLPTQMPKI

SEQ ID NO: 17960 - protein, 64 aa, Arabidopsis thaliana
MRSILIDWLVEVHVKFDLSPETLYLTVNIIDRFLSLKTVPRRELQLVGVSALLIASKYEEIWPP

SEQ ID NO: 17961 - protein, 490 aa, Brassica napus
GLGKLIAFYDANHISVDGDTEIAFTENVDQRFEALGWHVIWVKNGNTGYDEIRAAIKEAKAVTDKPTLIKVTTTIGYGSPNKANSYSVHGAALGEKEVEATRNNLGWPYEPFQVPDEVKSHWSRHTPEGKALESDWNATFAAYEKKYPEEAAELKSIITGELPAGWEKALPTYTPESPGDATRNLSQQCLNAIAKVVPGFLGGSADLASSNMTLLKASGDFQKATPEERNLRFGVREHGMGAICNGIALHSPGLIPYCATFFVFTDYMRGAMRISALSEAGVIYVMTHDSIGLGEDGPTHQPVEHLASFRAMPNTLMFRPADGNETAGAYKIAVTKRKTPSILALSRQKLPQLPGTSIEGVEKGGYTISDNSSGNKPDVILVGTGSELEIAAQAAEVLRKEGKTVRVVSFVCWELFDEQTDEYKESVLPSGVSARVSIEAASTFGWGKIVGGEGKSIGINSFGASAPAPLLYKEFGITVEAVVDAAKSFF

SEQ ID NO: 17962 - protein, 228 aa, uncultured cyanobacterium
HEVAGAGQHELGMKFAQLIEAADNVMTYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAGELQKIATVPPSLNGALEALNADRAFLTEGGVFTD

SEQ ID NO: 17963 - protein, 554 aa, Candida albicans SC5314
MGSSTNNTQSKATPSVLENEVNSSKSSVVSSTSSAKGLLRETTNHGTMETSSVQISESESRPSKMVLVLTLASSISGFMFGYDTGYISSALVQIGTDLSNKILTSGEKEFITSATSLGALLGAVVGGVLANLIGRRRVLLGSNIIFVVGTIIQLAARTVWTMIAGRFVLGWGVGIASLIAPLMISELAPAKYRGRLIVTNVIFITGGQLIAYFINWGLTRVSHGWRVSVGLCMVPPVLQFVLFWFLPDTPRFYVMNGNFEKARQVLRKVHVDPSDEFVNATIDEMIASDSTVPGNGPLQKAWKSIKIIHTTPGNFRALILACGLQGIQQFTGFNSLMYFSATIFETIGFHNATAVSIIIAATNFVFTGIAICIIDKVGRRRILLVGMPCMCISLIVCAVAFHYLNVDFSTGTVVSRGINGWGIVVIIGMILYVASYAIGIGNAAWVGVELFSDVNVRSIGAMYAACTNWAGSLVIASTFLTMLENITPTGTFSFFAGLCFIAFFFVYFLLPDTAGLELEETTDFLSNGFNVKQAAQLSKERKKHSKFAKSKPTV

SEQ ID NO: 17964 - protein, 196 aa, Oryza sativa (japonica cultivar-group)
MRPPRGGGGGRFGGGGGGRFGGGGGRGGRFGGGGRGGRGGGGGFRDEGPPAEVVEVSTFMHACEGDAVTKLTNEKVPYFNAPIYLQNKTQIGKVDEIFGPINESLFSIKMLEGIIATSYSEGDKFYIDPMKLLPLSRFLPQPKGQSQGGGRGGGRGGGRGGFRGRGGGGFRGRGAPRGRGGPPRGGGRGFRGRGRF

SEQ ID NO: 17965 - protein, 211 aa, Staphylococcus aureus
PSADMLFEPSFVNDIDVNENDIVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGISHYHSGYKVKSVDTTGAGDAFIGAVISRILANDVLNLTQLFENEGEEILAFSNRVAAIVTTKYGAINSLPTLQEVEQAF

SEQ ID NO: 17966 - protein, 860 aa, Arabidopsis thaliana
MRSEITRETKLLFDLPQDVIEEIFSKVPVTCLRRIRSTCKRLYALLKDRGFIRKHFAKSARQYHALMLKNFRFYSVSFNPNGTEMDVASLFNGERSLIDPYSSSEAIISQAFHCDGLLLCTTKENRLVVLNPFSGQTKWLQPQNRCKIDEAYVLGYDNSDLCHSYKILSFPDLYEQELETIKNAGRDLDVTPEGDLELKTDDFSSNSWRRNLGVTPHGGLGLKIYDFSSNSWKKLDVITPEGCLKSYGVSLKGNAYWVYMSKRRGVNDYSLLSFDFSTESFQHLCVPFHQEADCFGTMALSVVREEHLSLLYQSCETLKVEIWMTKEIDTTFVSWKKFLTVDLEPHLPHLLMFSCRMSFFIDEEKKVAVCCDRDNKVHVVGEDEYRVSSGQKPQDKQTRMFTDLPRDLETEILSRVPATSLQKLKPTCKRWYTLFKDPEFLKKHVGRAEREVISLMSLRVYSLSVNLSGIHSSVEMTGMLNSLKDSEDVKISDITECNGLLLCTTDDSRLVVWNPYTGETRWIPYKSNSPYEMYQKFVLGYDNTNKSRYSYKILRCYHGLIDFGYEFEIYEFNSHSWRRFYDNSPNCSFESKGVTLKGNTYWFASDTEGRHIILRFDFATERFGRLSLLYQSGGYVDNVVETGVLSAVREEKLALLYERFDELNDSSEMKIWVTNTKIVEAKDLSWSDFLVVDSSKFMVTRMTNVMSFLVDEEKKMVVVCDTDIDQHMNRFYIVGEDIYKEVYKDIAQGWFSYWPLLISYAPSLVQIQQVILRITIRYIEMGKSKKMSTLSVIRALLPCCSNSGDDWSDEGVIIRSRIMTSDEDGRLWIAEPGVDRRATSYIARFYENRVSDPNYKTLSP

SEQ ID NO: 17967 - protein, 506 aa, Ehrlichia ruminantium str. Gardel
MRNIYVTTPIYYVNDVPHIGHVYTTLISDIIARFKRLDGYNVKFITGTDEHGQKIEKAAAKANKSLVEFTDHASAIFQHLTGVMNFSHDDFIRTTEIRHKKAVTELWRRLYHYGKIYLGNYSGWYAVRDETFYQEKELIDGKAPTGAEVEWVEEPSYFFRLSHFQERLLDFYDKHPNFIIPRHRYNEVISFVKSGLKDISISRQNISWGISVPEDDNHIIYVWIDALTNYLTTLGFPEINSSEYKNYWVDENSTVVHVVGKDILRFHAVYWPAILMAAELPLPKQILAHGWWTNEGQKISKSLGNVINPFELIEEFGVDQVRYFLIKEMPVGNDGDYKRNSIISCINCDLANNIGNLVQRTVSLLHKECHGTIPNVASSLFQDEDALPNYQEILENVRICINQYNLNGVIHIVEELSSMANEYIAFRAPWKLSKTDPIVMQAVLYKLLEYIRCVGLLLQPIMPYLSSKILDQIALSEYKRSFNNFAVPIDTGIILPKPEPIFTKII

SEQ ID NO: 17968 - protein, 137 aa, Brassica napus
MGDVWTWIISFLILITLVGFIVYQLICLADLEFDYINPYDSASRINFVVLPEFFLQGFLCFFYLVTGHWFMALLGVPYLYYNFQLYSKRQHLVDVTEIFNLLDWEKKKRLFKLAYMILTLFLTIFWLIYSTLDDNED

SEQ ID NO: 17969 - protein, 228 aa, uncultured cyanobacterium
HEVAGAGQHELGMKFAQLIEAADNVMTYKYVVRNVAKKYGKTATFMPKPVFNDNGTGMHVHHSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKISTVPPSLNGALEALSADRAFLTEGGVFTD

SEQ ID NO: 17970 - protein, 228 aa, uncultured cyanobacterium
HEVAGAGQHELGMKFAQLIEAADNGMTYKYVVRNVAKKYGKTATFMPKPVFKDNGTGMHVHQSLWKGGEPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADQLAQIATVPASLNGALEALNADKHYLMEGGVFSE

SEQ ID NO: 17971 - protein, 476 aa, Silicibacter sp. TM1040
MSNLKEPSFRESVDLMFNRAVALMDLPPGLEEKIRVCNATYTVRFGVRLRGQIHTFTGYRSVHSEHMEPVKGGIRYAMGVNQDEVEALAALMTYKCALVEAPFGGSKGGLRIDPRQYDEHELELITRRFAYELAKRDLINPSQNVPAPDMGTGEREMAWMADQYARMNTTDINARACVTGKPLNAGGIAGRVEATGRGVQYALQEFFRYEEDKAKAGLSGTLDGKRVIVQGLGNVGYHAAKFLSEEDGCKIVAVIERDGGLYDENGLDIEDLRAWIEKHDGVDGYPSGRYIKNGAKYLEEDCDILIPAALEGVINLSNAENVKAKLIIEAANGPVTAGADEILRKKGTVIIPDMYANAGGVTVSYFEWVKNLSHIRFGRMQRRQEEARHQLVVDQLEMLSESMGKTWSLDPKFKEKYLRGAGELELVRSGLDDTMRIAYQSMRQVWHERDDVSDLRTAAYLVSIDKVASSYRAKGL

SEQ ID NO: 17972 - protein, 228 aa, uncultured cyanobacterium
HEVAGAGQHELGMKFAKLIQAADNVMTYKYVVRNVAKKYGKTATFMPKPVFNDNGTGMHVHQSFWKGGQPFFFSEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 17973 - protein, 228 aa, uncultured cyanobacterium
HEVAGAGQHELGMKFAELIQAADNVMTYKYVVRNVAKKYGKTATFMPKPVFNDNGTGMHVHQSFWKGGQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 17974 - protein, 774 aa, Methanosarcina barkeri str. Fusaro
MLGELYTDHKQNLKEYHYIIERGYPHPLGATPDENGVNFSIYSEHADYVELLLFDKCDDLNPALILYTNRVGELTHSENIENSVKVSEDIENIESSVKVSEDIENIESSVKVSENSETTEATSIALNKTFHFWHVYVRGLKPGVHYAYRIGGPFDPSRGCRFDGDKVLIDPYSKGNNKTLWNREKACMPGDNLAFSMRSVVIDMSHYKWGNNSHVTAEKIYEMPGMGEKLYGKKRLQELNETIIYELHVGGFTRSPTSGATASGTFSGVIDKIPYLKELGITAVELMPVFDFDDATSLDGRKQYWGYDPICFFAPHSGYCVNPEYGAHMEEFRDMVRALHKAGIEVVLDVVFNHTAEGDNLGPVFSFKGIDNSIYYLLEPDEQYYSNYSGCGNTVSCNHPISQKLIVDCLKYWAKEMHVDGFRFDEGSILSLDTNGKVMKYPPVIWQIELDDALGYIKVIAEAWDAAALNQVGYFPGPRWAEWNGYYRDEIRRFVRGDPGIVRRVASRIAGSPDLYQSESRLPINSVNFVTCHDGFTLNDLVSYNHKHNEANGENNRDGIENNLSWNCGVEGETEDPEVETLRERQIKNFAAILLLSIGVPMICMGDEVRRTQKGNNNAYCQDNETSWFDWDLVEKNHDMFRFWKLMIDFRKRHTTILRPRYFTGKENERGLKDISWHGCKLYSPGWDDPHARALSFTMGEPGDEEDIHVLMNMYWEPLEFEIPELKGISRSWYRAVDTFLPSPQEIAGAGEETQVNGNSYIVQGRSVVVLISK

SEQ ID NO: 17975 - protein, 228 aa, uncultured cyanobacterium
HEVAGAGQHELGMKFAKLIQAADNVMTYKYVVRNVAKKYGKTATFMPKPVFNDNGTGMHVHQSLWKGGQPLFFGEGTYANLSQTARWYIGGILKHAPSFLAFTNPTTNSYKRLVPGFEAPVNLVYSEGNCSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 17976 - protein, 304 aa, Debaryomyces hansenii CBS767
MPEDEDSMVVERPDDIEVPPPSEPYTLIEPFEFFNDSSGISKKCLIILNQSIRDMNLRRLWPNTRLHICADGGANQLYDYFEDEDERSKFVPDFITGDCDSVTNEIKQYYILKGTVVIPQYSQYSTDLTKSLMLTKIYFHSETLRLKLYEGIESDNGLSELGQSLEASGATPVYVYMLGGIGGRFDQTIHSINQLYKLNQSDPHLQIFFVSHSDMIFLIKKGLNYIQYERKSLFNTSRKAPICGLLPLSNTPITLNTHGLKYDVINWTSSMIGNVSSSNGICGTNGFIVNATDDIVMNASIDHY

SEQ ID NO: 17977 - protein, 335 aa, Xanthomonas campestris pv. campestris str. ATCC 33913
MTQTITVIRGDGIGPEIMDATLFVLDALQAGLTYEYADAGLVALEKHGDLLPESTLASITKNKVALKSPLTTPVGEGFSSINVAMRRKFDLYANVRPAKSFPNTKSRFADGVDLITVRENTEGAYLSEGQEVSADGEVAVSGARVTRKGSERIVRYAFDLARATGRKKVTAVHKANIIKSTSGLFLKVARDVATQYPEIEFQEMIVDNTCMQLVMRPEQFDIIVTTNLFGDIISDLCAGLVGGLGLAPGANIGVDAAIFEAVHGSAPDIAGQGKANPCALLLGAAQMLDHIGQPQNAERLREAIVATLEAKDSLTPDLGGTGNTMGFAKAIASRL

SEQ ID NO: 17978 - protein, 344 aa, Comamonas sp. CNB-1
MLPKVCIIGAGCSGFTTAKALADRGIPFDCFDMSDQIGGNWVFKNKNGRSACYQSLHIDTSKYRMQFEDLPIPSHFPDYPHHSQVLEYFNAYVDRFGLRKRITFNTEVTKAELMPDKTWRVTLSNGETRSYGALVVANGHHWDQYIPSFPGTFDGPSFHSHRYIDPFEPVDMRGKRILVVGMGNSAMDIASELSQKPIAKRLVVAARRGVWIFPKYINGKVPDKGHAFVDAPLPDPRAGEAHDHPCRRAHEGLRASRARASSCGCAPFGVRRVPDAGRMWRCCREAEYRGTARYQGQVRGRFCRNPTYKPSAFSASLKAHMLERASREVNRNGKILDANKTETA

SEQ ID NO: 17979 - protein, 371 aa, Oryza sativa
  misc_feature (131)..(131): Xaa can be any naturally occurring amino acid
  unsure (1)..(371): unsure at all Xaa locations
MTKQSVVVPEVAVPMPPNSAPLLPYPPPRAAPGVAVRKKYLQAQLDLGAGLPLINGWVESMRASSPTHAKAAAALAAAGAVDDERAAWMVRHPSALSKFEQIVAASKGKKIVMFLDYDGTLSPIVDDPDSXAFMSDTMRRAVRSVAKHFPTAIVSGGSRDKVVEFVKLAELYYAGSHGMDIKGPAKASRHNKAKAKGVLFQPASEFLPMIEQVHDSLIERTKCIPGAKVENTRSGGSVHFRCVDEKSWSTLADIVKAELKDYPKLKLTQGRMVFEIRPTIKWDKGKALEFLLESLGFADCTNVLPVYIGDDRTDEDAFKVLRKRGQGIGILVSKYPKDTNASYSLQEPAEVMEFLLRLVEWERLSRARPKW

SEQ ID NO: 17980 - protein, 278 aa, Rhodopseudomonas palustris CGA009
MSLAIGSASGTLQPFIARVLMPVPAVRPLIAGNWKMNGLKDSVAELDAMLKGAAELPQGIDLLVCPPATLVASFAARVAEAQAGKALPFSIGGQDCHANASGAHTGDIAAEMLADAGAAAIIVGHSERRADHAENDAIVRAKAQAVWRAGLVAIVCVGETQGERDAGHTLDVVAGMLAGSLPDGATAANLVVAYEPVWAIGTGRTPTAADVEEVHGFIRKTLSDRFGAAGETMRILYGGSVKPSNARELLAVPHVNGALIGGASLKASDFLAIAAGCP

SEQ ID NO: 17981 - protein, 131 aa, Capsicum annuum
SMMVAMAAAQSATNVRYNIPSYNPQNINWDLRTASANCATWDADKPLEWRQRYGWTAFCGPAGPTGQAACGRCLRVTNTGTGTQATVRIVDQCSNGGLDLDVYVFNQLDTDRRGYQQGHLIVNYEFVNCND

SEQ ID NO: 17982 - protein, 914 aa, Cryptococcus neoformans var. neoformans JEC21
MSDSPAATPLPKDPEGITEQIQSVSTPPPPPQAQKPARQKKIAVLTSGGDSAGMNAAVRAIVRQSIARGCQAYIIREGWEGLVRGNTSGPTPAPTAPQSPTLSASSKTVTFSSLPPSQQFDKLTSTLNKESLANEVSFSDPNEVTPLEDTPLSFGYGQLLRDGAGEGDVEELASHGMQGLAIADREDEKGRSLKNKYIVRVGWDDVRGWQGEGGTLIGSSRCPAFRTREGRLQAASNLIHSGIDCLAVCGGDGSLTGADKLRGEWPSLVEELYTENKITDDQREAYHHLNIVGLVGSIDNDMALTDLTIGALTALHRICESIDSISSTASSHSRAFVIEVMGRHCGWLALLAGIATGADFIFIPEDPPKCEDWETEMCDLLQAHRKVGKRKSIVIVAEGALDRNLKPIKPDYVKKILVERLGLDTRVTTLGHTQRGGKPCAFDRILPTLQGVEAVQTLLSATPETPSYMIGIQENKITKIPLLEAVARTQMVAEAIENRDFAKAMSFRDSEFREMLQAFQISSSLDVSQNAPVDKRLRIGIIHVGAPAGGMNAATRQAVRFCHNRGHVPVAIYNGFEGLLDDNVSELSWLRVDSWTTRGGSELGTNRSLPSIDIGSVAAGFQRYSLDALLVIGGFEAFHSVVLLSQNRTNYPAFQIPIVHLPATLSNNVPLTDFSLGSDTSLNALVEACDAIKQSASASRNRVFVVETQGGMSGYIATMGALAVGAVLVYTPENGISLKLLQEDVEFLIKRYKLDEKGKSEGRLVIKAEKSSSVYTTETLTKIFKEEGKDLFDARSASLGHTLQGGVPSPLDRTRAARLSLRCMQFLEEHASPNSQASHHKPKSAAHPHAGAKSIAKDTAAMIAIIGSKVVYATMDDVLKVTDMKLRRGTDEWWSDCKELAETMGGRTGLMAKH

SEQ ID NO: 17983 - protein, 211 aa, Staphylococcus aureus
PSADMLFEPSFVNDIDVNENDVVHFCSVDLVDSPMRDAHYQLITKTLNAYGTVVFDPNVRLPLWDNAEDLRQTIHTFLPLAHIVKVSDEELEFITGIHDENKAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 17984 - protein, 375 aa, Cryptococcus neoformans var. neoformans JEC21
MWTMEGEERDIPEPKADEVQIKVAMTGMCGSDLHYYLHGANGTFKIREPLVLGHESCGVITAVGSNVNSGFNLKVGDRVAMEVGVYCKTCKMCRRGRYNLCANMRFASSAKTYPHLDGTLREVMTWPAELVYKLPPNLELPLAALAEPLSVVLHAYRRAHLSPGSRILVIGAGAVGLLTCALARASGCTTVVAVDIEQGKLDFAAQQSWTTNTFCLPKGPRVSGAEALEVAGKQWDALKASDAVQSVEGLEDGFDAVFECTGVESCMQMAPMAAAIGTKVLFVGMGTKVLALPCGPSLLSEVDLIGVFRYCNTYPDALALLASGKLGDVSKMASHYYSLDQAAEAFEDLKRGKDKDGRTVIKPMVGNLEMCGIKK

SEQ ID NO: 17985 - protein, 228 aa, uncultured cyanobacterium
HEVVATAQHELGMKFAELIQAADNVMIYKYVVRNVAKKYGKTATFMPKPIFADNGSGMHVHQSLWKAGQPLFFAPGTYANLSDTARWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGAGVDVDLFELPADELAKIATVPASLNGALEALRADHHYLLEGGVFTD

SEQ ID NO: 17986 - protein, 335 aa, Chondrus crispus
MTAPKVGINGFGRIGRLVLRAAIEKGTCQVVAINDPFIDLDYMAYMLKYDSTHGRYAGDVSIKDGKLQVDGNSITVFAHRDPAEIPWATAAADYIVEATGVFTLKDKAAAHFKGGAKKVVISAPSKDAPMFVCGVNEAKYTPDLDIISNASCTTNCLAPLVKVIHEKYGIEEGLMTTVHATTATQKTVDGPSNKDWRGGRGRGRNIIPSSTGAAKAVGKVMPELNGKLTGMAFRVPTPDVSVVDLTVRLTSETTYEDIKATMKAAADDSMKGIMKYTEDAVVSTDFIHDDASCIFDASAGIMLNSKFCKLVAWYDNEWGYSNRVVDLIAHISKVQ

SEQ ID NO: 17987 - protein, 228 aa, uncultured cyanobacterium
HEVVATAQHELGMKFAELIQAADNVMIYKYVVRNVAKKYGKTATFMPKPIFADNGSGMHVHQSLWKAGQPLFFAPGTYANLSDTARWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGAGVDVDLFELPADELAKIATVPASLNGALEALRADHHYLLEGGVFTK

SEQ ID NO: 17988 - protein, 414 aa, Chondrus crispus
MAFVAPVATVRATTKSSVCQVQGRSSFAQFSGMKKVNQSSRLQPAQSGSAFGGYSDANDAFYTRVSGIVAATFGPTMKVRVAINGFGRIGRNFIRCWAGRSDSNMEVVCINDTSGVKTASHLLKYDSILGTFDADVSAGEDTISVNGKTIKIVSNRNPLQLPWKEMNIDIVVEATGVFVDAPGAGKHIEAGAKKVLITAPGKGDGIGTFVVGVNEKDYSHDKYDIVSNASCTTNCMAPFMKVLDDEFGVVRGMMTTTHSYTGDQRLLDAGHRDLRRARSAALNIVPTTTGAAKAVALVVPSLKGKLNGIALRVPTPNVSVCDVVMQVNKKTFKEEVNGALLKASEGAMKGIIKYSDEPLVSCDHRGTDESTIIDSSLTMVMGDDMIKVVAWYDNEWGYSQRVVDLGEVMARQWK

SEQ ID NO: 17989 - protein, 70 aa, Glycine max
MGFSVTTLIFAVVGIVASLCTRICFNRGPSANLFHLTLVLTATTCCWMMWAIVYLAQMKPLIVPILSEGE

SEQ ID NO: 17990 - protein, 336 aa, Leifsonia xyli subsp. xyli str. CTCB07
MSVKIGINGFGRIGRNYLRAALAKGSGVEIVAVNDLTDNKTLAHLLTYDSTTGPLDTTVHLDGDSIVVNGKPIKVLEERDPANLGWGDLGVDIVVESTGRFTKAADARKHLEAGAKKVIISAPASGEDGTFVLGVNEESYDPANHHIISNASCTTNCLAPLAKVFNDAFGIERGFMMTAHAYTADQNLQDGPHSDLRRARAAAVNIVPASTGAAKAIGLVLPDLQGKLSGSSYRVPVPVGSIVDLTLITGRDDLTVQEINAAYAAAAAEGRLAGILQYTEDPIVSSDIQGNAHSSIFDSELTNVSGNLVKVSSWYDNEWGYSNRLVDLTEYVAERL

SEQ ID NO: 17991 - protein, 403 aa, Leifsonia xyli subsp. xyli str. CTCB07
MALRTLDSLGSLAGKRVVVRCDLNVPLKDGKITDDGRVRASIPTLHALIAQGAKVAIVSHLGRPEGAPDAQYSLAPVAQRLSELLGKPVTFASDTVGAGAAEAVSGLEDGDVALLENLRFNPGETSKDEGEREAFAAELAAFGDAFVSDGFGVVHRKQASVYELAKALPSAAGALIATELDVLDRLTENPERPYTVLLGGSKVSDKLGVIGHLLPRVDSLLIGGGMLFTFLAALGHRVGSSLLEADQIGTVKGYLEQAKQLGVEIVLPRDVVVASRFGVDAEHLVRPVDRIEDTGWGTSGLGLDIGPETAEVFSERIRAARTVFWNGPMGVFELAPFAAGTKAVAQALTEVDGLGVVGGGDSAAAVHALGFSDDQFGHISTGGGASLEFLEGKRLPGLEVLGW

SEQ ID NO: 17992 - protein, 512 aa, Fusobacterium nucleatum subsp. nucleatum ATCC 25586
MKKGGIVILDFGSQYNQLIARRVREMGVYAEVVPFHEDVDKILAREPKGIILSGGPASVYAEGAPSLDIKLFQNNIPILGLCYGMQLITHLHGGKVARADKQEFGKAELELDDKNHILYKNIPNKTTVWMSHGDHVTEMAPDFKIIAHTDSSIAAIENSDKNIYAFQYHPEVTHSQHGFDMLKNFIFGIAKAEKNWSMENYIESTVKQIKERVGNKQVILGLSGGVDSSVAAALINKAIGRQLTCIFVDTGLLRKDEAKQVMEVYAKNFDMNIKCINAEERFLTKLAGVTDPETKRKIIGKEFVEVFNEEAKKIEGAEFLAQGTIYPDVIESVSVKGPSVTIKSHHNVGGLPEDLKFELLEPLRELFKDEVRKVGRELGIPDYMVDRHPFPGPGLGIRILGEVTKEKADILREADAIFIEELRKADLYNKVSQAFVVLLPVKSVGVMGDERTYEYTAVLRSANTIDFMTATWSHLPYEFLEKVSNRILNEVKGINRLTYDISSKPPATIEWE

SEQ ID NO: 17993 - protein, 267 aa, Leifsonia xyli subsp. xyli str. CTCB07
MNEAGTSSVRRVPLIAGNWKMNLDHLQSIAVVQKLAWTLKDAGHDFGAVEVAVFPPFTDLRSVQTLVAADKLPIAFGGQDVSEHDSGAYTGEIAASFLAALEARYVIIGHSERRTLHNETDEQVAAKTAQAVKNGISPIVCVGETAEDLEKHGASAVPVAQLRAALAGIDSAADFVVAYEPVWAIGSGQAATPEQAEQVAAALRAVIAEALGDEVAAKTRILYGGSVKSGNIAGFMRETNVDGALVGGASLDVAEFAAIIRYQKHVI

SEQ ID NO: 17994 - protein, 849 aa, Fusobacterium nucleatum subsp. nucleatum ATCC 25586
MYHISKEGQDFFNITTIYEFKGKDKSYWHICFDDNSEKDYCQSDLHIIESCLNQSLSANVFEYIKQIASLNDIKNEETGEKLLVKKYENISFVSDDVALAKYLNPSDKNTDKKGDNYIPIFPFGCNNSQYKAVRNAMEKQISIIQGPPGTGKTQTILNIIANILMQGKTVQIVSNNNSATENVYEKLSSTKYNLGFIAATLGSSKNKKNFIEHQDTNYPDFSSWKIEENPNDLQKKIAEQSNQLKIVFDKQEKLACLRQELSQLLTEKEYFNQYIEKLKISIENIKFKKKLSSKHWINLWQECQSILENKKVIGFWFKIKAFFKYGVTDWNIYKQKNLNIIITLQNIYYRVKQEELLSDIADTEKYLDGVNKNLLEDLCNQSMIILKDKLARRYKKNNVRKVFTKEDLWKDPYSVLAEYPVILSTTFSSRNSLNSDVVYDYLIMDEASQVDIATGALALSSARNAVIVGDTKQLPNIVTNDIKNKAKGIFDTFNMSEGYQYTKSFLQSILDVIPNVTQVLLREHYRCHPKIINFCNQKFYRGELIIMTTDKGEKDVLSVVKTRVGNHERNHYSQRQIDVIKNEIIPKYILNSKECGIITPYKNQVEALNKEITNIDASTVHKFQGKEKENIIISTVDDEISDFADDPYLINVAVSRAKKKLILVVTGNEQTKEYNITDLMDYIQYNNFDVVESKIYSIFDYLYKQYTEKRIAYLQKHKKISEYDSENLMYSLIEDIISDNKYASLDVVCHFQLNMLIKNPELLNDQEYQYMMNPATHVDFLIYNRISKKPVLAIEVDGYKYHKKESKQASRDLLKNRILELYEIPLLRFKTNGSGEKEKIIELLEKLRM

SEQ ID NO: 17995 - protein, 296 aa, Cryptococcus neoformans var. neoformans JEC21
MSLQGQLTTIPCGPFFYPVFTSGDLTATRAVVFIGGLTNGLGAVPFTYPLSDALGKAGWKLIQFHWSSAYGGYGTGSLDRDREEMQALVKYLKTTGGLSKVIIMGHSTGSQNVMHYLSSSINNDPAYHVDGGIMQAPVSDREVCAKDKPYCDYLSLAEEMVKKGRGHEIMPDEFCKKAGFGGVEMKMTAYRLWSLMGVGGDDDYFSADIPLEPTQPYVHSLSTSFGALTAPALALFSEKDAEWIVARPEDLLPKWADAANGKLEWRIIKGASHDVNEKEAQAVLCEDVLSWLRKFE

SEQ ID NO: 17996 - protein, 449 aa, Bacillus anthracis str. Sterne
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKREIYEAFKGKGEYEFFRHINTFGGNPAACALALKNLEIIENENLIERSAQMGSLLLEQLKEEIGEHPLVGDIRGKGLLVGIELVNDKETKEPIDNDKIASVVNACKEKGLIIGRNGMTTAGYNNILTLAPPLVISSEEIAFVIGTLKTAMERI

SEQ ID NO: 17997 - protein, 312 aa, Arabidopsis thaliana
MVMYKEDYVSNSRGIQLFTCSWKQEEQQEPKALIFLCHGYAMESSITMSSTAVRLANAGFSVYGMDYEGHGKSGGLNGYVKKFDDLVQDVSSHYSSICELEENKGKMRFLMGESMGGAVVLLLERKKPNFWDGAVLVAPMCKLAEDIKPHPMVISFLTKLTRFIPTWKIVPSNDIIDVAFKETHIRKQVRDNEYCYKGRPRLKTAHQLLMVSLDLEKNLDQVSMPFIVLHGEDDKVTDKNVSKLLYEVASSSDKTFKLYPNMWHGLLYGESPENLEIVFSDIISWLKERASVTNQKLETELKHVDDGFSMQK

SEQ ID NO: 17998 - protein, 645 aa, Pseudomonas syringae pv. tomato str. DC3000
MGQTRFATGRQLDLICLGRLGVDLYAQQVGARLEDVSSFAKYLGGSSANIAFGTARLGLRSAMLSRVGDDHMGRFLLESLAREGCDVSAVKRDPERLTAMVLLGLKDRETFPLVFYRENCADMALRAEDIDEQHIASSKALLITGTHFSTDQVFKASSQALDYAEKHNVKRVLDIDYRPVLWGLAGKADGETRFVADQKVSQHVQRILPRFDLIVGTEEEFLIAGGSTDLLGALRTVRELTAATLVVKLGPQGCTVIHGAIPARLEDGAIYPGVRVEVLNVLGAGDAFMSGFLSGWLTEASDERCCQLANACGGLVVSRHACAPAMPTPAELDYLFNSPEPITRPDQDVILQRLHQVSVPRKQWKQLFIFAFDHRGQLVELAQQAGRDLNSISQLKQLFVQAVERVEADLHQRGIEADVGLLADQRFGQDSLNTATGRGWWLARPVEVQGSRPLAFEHGRSIGSNLINWPQEQIVKCLVQYHPDDEPMLRLEQEAQIKALYDASKVSGHELLLEIIPPKDHPSAHPDVMLRALKRLYNLGIYPAWWKIEAQSTEVWQQLDELIQQRDPYCRGVVLLGLNAPVEELAAGFAQARDSHVCKGFAVGRTIFREPSRAWMAGEIDDATLVSQVQSTFSGLIESWRESRA

SEQ ID NO: 17999 - protein, 415 aa, Vibrio angustum S14
MTEDFRQQALDYHSLPTPGKIAVALTKPANTVEDLALAYSPGVAEPVREIAQDPDNVYKYTAKGNMVAVITNGTAILGLGNLGPLASKPVMEGKSLLFKRFAGIDSIDIEVKHRTIDEFVDTVANIADTFGGINLEDIKAPDCFEIEQRLIERCNVPVFHDDQHGTAIVTAAGMLNALELQGKAIDEAVIVCLGAGAAAIACMELLIKCGAQREKIYMLDRKGVIHTRRDDINEYKQLFANNTDKRTLEDVIAGADIFVGVSGPDLLPPDALALMAENPIVFACSNPDPEIKPELAHQVRNDLIMGTGRSDYPNQVNNVLCFPFIFRGALDVRASQINDEMKLAAVHAIRELAKEPVPQSVLEASGVSHLEFGREYIIPKPMDPRLLPRVAKAVAQAAIDSGVARIEMPMGYMEV

SEQ ID NO: 18000 - protein, 211 aa, Staphylococcus aureus
PSADMLFEPSFVNDIDVNENDVVHFCSVDLVDSPMRDTHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 18001 - protein, 96 aa, Triticum aestivum
NQGYVFRGRWIEWGKGHPLPTLGEVRDLKGSYYQGRCHQSTVACPGFMGAQAVLLLQIRKNLSFSGQGVAPATVVNRMFGGANRVNLFRGILRRKI

SEQ ID NO: 18002 - protein, 476 aa, Arabidopsis thaliana
MQISSSSFITKFTNLHMVRSTSDHHQWRHNYNLKQLFIPNLSVSNSQHLPLNQSVAAIVFGGGSDSELYPLTKTRSKGAIPIAANYRLIDAVISNCINSGITKIYAITQFNSTSLNSHLSKAYSGFGLGKDRFVEVIAAYQSLEDQGWFQGTADAIRRCLWVFEEFPVTEFLVLPGHHLYKMDYKMLIEDHRRSRADITIVGLSSVTDHDFGFGFMEVDSTKAVTRFTIKGQQDLISVANRTATRSDGTSSCSVPSAGIYVIGREQMVKLLRECLIKSKDLASEIIPGAISEGMKVKAHMFDGYWEDVRSIGAYYRANMESIKSYRFYDRQCPLYTMPRCLPPSSMSVAVITNSIIGDGCILDKCVIRGSVVGMRTRIADEVIVEDSIIVGSDIYEMEEDVRRKGKEKKIEIRIGIGEKSRIRRAIVDKNARIGKNVMIINRDNVEEGNREAQGYVIREGIIIILRNAVIPNDSIL

SEQ ID NO: 18003 - protein, 103 aa, Glycine max
  misc_feature (28)..(28): Xaa can be any naturally occurring amino acid
  unsure (1)..(103): unsure at all Xaa locations
LTLQFNTLPLSLLIITLKNNTHRTYINXRNNITLLTLIISYHNHFNITLQNIINIFTYFPNTDKRNKKAHTFNNYILINKIFLRLNSIIIALTNPKSYTIINL

SEQ ID NO: 18004 - protein, 275 aa, Arabidopsis thaliana
MASHDHPHHHHDHEHDHEKSDGGEGKASWVGKDGKVYHSHDGLAPHSHEPIYSPGYFSRRAPPLHDRNFSERAFTVGIGGPVGTGKTALMLALCRFLRDKYSLAAVTNDIFTKEDGEFLVKNGAPPEERIRAVETGGCPHAAIREDISINLGPLEELSNLFKADLLLCESGGDNLAANFSRELADYIIYIIDVSAGDKIPRKGGPGITQADLLVINKTDLAAAVGADLSVMERDSLRMRDGGPFVFAQVKHGLGVEEIVNHVMHSWEHATGKKRQ

SEQ ID NO: 18005 - protein, 167 aa, Zea mays
MMMAEVVANHSKRSHTDGYFSAKAAVAAAAAASPPEELGSMPMSSKKPRPRNSNSPRTAPVSPKEKKDRIGERVAALQQLVSPFGKTDTASVLQEASGYIRFLHQQLPVFSSPYMRAPPAAGAAPEDPEHYSLRSRGLCLVPVDQTLQLTQSNGADLWAPANTTRRR

SEQ ID NO: 18006 - protein, 726 aa, Leifsonia xyli subsp. xyli str. CTCB07
MTSTARTTLNRCGHRSTTPPPPLRRVSSPVAALQWDPIDNKAVDTARVLAADAVEKVGNGHPGTAMSLAPAAYLLFQKVMRRDPRDQHWLGRDRFILSAGHSSLTQYIQLYLGGYGLELADLEALRTWGSLTPGHPEYGHTDGVEITTGPLGQGISSSVGFAYAQRYERGLFDPEAGPGASPFDHFTYVIASDGDLEEGISSEASSLAGHQQLGNLIAIYDDNQISIEDDTTIAFTEDVKARYEAYNWHVQVVDWKKTGVYAEDVHELYQAIQNAQAVTDKPSLIVLKTIIGWPAPKKQNTGKIHGSALGADELRAVKEVLGFDPEKTFEVAAEVIEHTRRAVGSGAEQRAAWQKGFDAWAAAHPERKELLDRLLSGAAPAGIADALPVFAAGAEMSTRAASGKVINAIAPVMPELWGGSADLAESNNTTIEGAASFVPSEHSTHEWTGNPYGRMLHFGIREHAMAAIINGIVLHGPTRPFGGTFLIFSDYMRPAVRLAALMRVPSIFVWTHDSVALGEDGPTHQPIEQLATLRAIPHLDVVRPGDANEVTHAWKTILTRRNGPAGIALTRQNIPVFERGDGEAAGDTLASAENVAKGAYILAEAPGGTPDVLFIATGSEVQIALEARDVLRGEGIKARVVSAPCLEWFAEQDAAYREKVLPAALKARVSIEAGLALSWSTIVGDHGRSVSIEHFGASADYKTLFREFGMTTEHAVAAAKESLASL

SEQ ID NO: 18007 - protein, 205 aa, Brassica napus
  misc_feature (191)..(191): Xaa can be any naturally occurring amino acid
  unsure (1)..(205): unsure at all Xaa locations
MRRNKRPDLSLPLPNRNVALAVPLPLPPPPSSSSALASSSAISTNISAAKRLSELERVNRIGSGAGGTVYKVIHLPTSRPFALKVIYGNHDDNVRRQICREIEILRSVDHPNVVKCHDMFDHNGEVQVLLEFMNKGSLEGRHVSREDELADLTRQILSGLAYIHRRHIVHRDIKPSNLLINSANNVKIADXGVSRILAQTMDPCN

SEQ ID NO: 18008 - protein, 439 aa, Schizosaccharomyces pombe
MAIQKVFARQIYALGGNPTVEVDLTTETGIHRAIVPSGASTGIWEALEMRDGDKTKWGGKGVLKAVGNVNNIIAPAVVKANLDVTDQKAADEFLLKLDGTENKSKLGANAILGVSMAICRAGAAQKKLPLWKYIAENFGTKGPYVLPVPSFNVLNGGSHAGGDLAFQEFMILPTGAPSFSEAMRWGAETYQTLKSIAKKRYGSSAGNVGDEGGIAPDLQTPQEALDLIVEAINKAGYEGKIKIGLDVTSSEFYVDGKYDLDIKAAKPKPENKLTYQQLTDLYVELSKKYPIVSIEDPFDQDDWSAWTHMKAETDFQIVGDDLTVTNVKRLRTAIDKKCANALLLKVNQIGSVTESLNVVRMSYEAGWGVMVSHRSGGTADTFISHLTVGIGAGQLKSGAPCRSERLAKYNELLRIEEELGSRGVYAGAHAGKYIKAAKF

SEQ ID NO: 18009 - protein, 536 aa, Oryza sativa (japonica cultivar-group)
MAAAAAAMATATSATAAPPLRIRDAARRTRRRGHVRCAVASGAAEAPAAPGARVSADCVVVGGGISGLCTAQALATKHGVGDVLVTEARARPGGNITTAERAGEGYLWEEGPNSFQPSDPVLTMAVDSGLKDDLVFGDPNAPRFVLWEGKLRPVPSKPGDLPFFDLMSIPGKLRAGLGALGVRAPPPGREESVEDFVRRNLGAEVFERLIEPFCSGVYAGDPSKLSMKAAFGKVWRLEDTGGSIIGGTIKTIQERGKNPKPPRDPRLPTPKGQTVASFRKGLTMLPDAITSRLGSKVKLSWKLTSITKSDNKGYALVYETPEGVVSVQAKTVVMTIPSYVASDILRPLSSDAADALSIFYYPPVAAVTVSYPKEAIRKECLIDGELQGFGQLHPRSQGVETLGTIYSSSLFPNRAPAGRVLLLNYIGGSTNTGIVSKTESELVEAVDRDLRKMLINPKAVDPLVLGVRVWPQAIPQFLIGHLDHLEAAKSALGKGGYDGLFLGGNYVAGVALGRCVEGAYESASQISDYLTKYAYK

SEQ ID NO: 18010 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 18011 - protein, 563 aa, Cryptococcus neoformans var. neoformans JEC21
MSIERADCSLPYEKSSAEKDSGPHVYQGEAIVYPNDGSENVIPREEETHRALSPRQLSMIALGGAIGTGLVIGSGTSLARSGPASLFISYVVMGTVCCGVMMALGEMSTKYPSKKGFAGHATRCVDPAFGFCTALVYLCKYLIISPNQIVAGSLVIRYWNDSINGAAWVTIFIVFVIAINCLGVKWFGEIEFWLSFTKIITLTGLILLALIIDLGGVPGQERIGFRYWEHGRAFKAYKATGDLGKFLGFVNALVLALFAYIGTELIGVTVGEAKNPRKTVPSAIRKTFLRIIFFYVLSSLLVGMIVDSSSPLLAQAAKKGTSGGASASPFVVAIESAGIKVLPAIINACILIFTISAANSDQYIASRTLYGMAKDGSMPRIFTKCTSRGVPWVAFIFTAMFMGLAYLVASSDALSVFNYFVNSVTIFGGLTWISILSSHVAFMRGMKAQGISRDSLPYKSPFQPYFTYCSLFLTCLVCFFKGFDGFMPWDYKSFITNYIGIPIYVFAYIGFKVIRKTKAVKMWEMDLTTGAREFHDLNEETEEEQQYKSMSFKQKVIYQIKNW

SEQ ID NO: 18012 - protein, 110 aa, Oryza sativa (indica cultivar-group)
MDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILYSP

SEQ ID NO: 18013 - protein, 133 aa, Triticum aestivum
MGRASGKSISSPTTKTIQSNPTVERGEARRMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 18014 - protein, 495 aa, Artemisia annua
MKSILKAMALSLTTSIALATILLFVYKFATRSKSTKKSLPEPWRLPIIGHMHHLIGTTPHRGVRDLARKYGSLMHLQLGEVPTIVVSSPKWAKEILTTYDITFANRPETLTGEIVLYHNTDVVLAPYGEYWRQLRKICTLELLSVKKVKSFQSLREEECWNLVQEIKASGSGRPVNLSENVFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKTELLLVPSF

SEQ ID NO: 18015 - protein, 384 aa, Triticum aestivum
MPRRCPCSPIPSRQVRCTSRPRGALAVTSPAAAMTSPASTSSWFSGIVRTASGNPPSSAMPPAGGVTSAPVSLPDTPAAVSGKGGVVAPVATTGVGARRKQLQGTLFKYGPKSAQVAFRTGDFTRQVIFIGGLADGLLATDYLEPLSLALEVEKWSLVQPLLSSSYTGYGISTLEQDALELDQLIGYLINKDNSEGVILLGHSTGCQDIIHYMRTNFACSKAVSGVILQAPVSDREYRATLPETGEMIDLAAKMISAGRGMDLMPREANSDAPITAYRFHSLCAYMGDDDMFSSDLSEDQLKQRLGHMSTTQCLVVFSMADEYVPEYVDKKALVDRLSRALGDSEKVEIKWGNHALSNRVQEAVEVIVDFVKREGPKGWDDPWS

SEQ ID NO: 18016 - protein, 434 aa, Rhodopseudomonas palustris CGA009
MDATTNNKTATLTVGNKNFDLPVLTGTVGPDVIDIGKLYAQTGMFTYDPGFTSTASCQSKITYIDGDAGVLEYRGYPIEQLAEKGDFLETCYLLLYGELPTKAQKEDFDYRVTRHNMVHEQMARFFQGFRRDAHPMAVMVASVGALAAFYHDSTDINDPTQRMVASIRMIAKVPTLAAMAYKYSVGQPFIYPKNTLSYAANFLRMCFATPCEEYVVNPVLANALDKIFTLHADHEQNASTSTVRIAGSSGANPFACIAAGIACLWGPAHGGANEAALAMLKEIGTVENIPDFIAKVKDKSSSVRLMGFGHRVYKNYDPRAKIMQQVCHEVLAETGHHGDPLLKVAMELEKIALSDQYFIDRKLYPNVDFYSGITLKAMGFPTDMFTVLFAVARTVGWISQWSEMIEDPQQKIGRPRQLFTGATTRNYVEIGKRG

SEQ ID NO: 18017 - protein, 342 aa, Glycine max
  misc_feature (113)..(113): Xaa can be any naturally occurring amino acid
  misc_feature (135)..(135): Xaa can be any naturally occurring amino acid
  unsure (1)..(342): unsure at all Xaa locations
MAPELVPTVVKSSAAFTKPATLPRRAYVTFLAGNGDYVKGVVGLAKGLRKVKTAYPLVVAVLPDVPEEHRKILESQGCIVREIEPVYPPENQTQFAMAYYVINYSKLRIWEFXVEYSKMIYLDGDIEVYENIDHXLFDLPDGNFYAVMDCFCEKTWSHTPQYKVGYCQQCPEKVRWPTELGQPPSLYFNAGMFVFEPNIATYHDLLKTVQVTTPTSFAEQDFLNMYFKDIYKPIPLNYNLVLAMLWRHPENVKLDQVKVVHYCAAGSKPWRYTGKEENMQREDIKMLVKKWWDIYNDASLDYKPLMNASEAPAADGVDNIEPFVQALSEVGHVQYVTAPSAA

SEQ ID NO: 18018 - protein, 594 aa, Cryptococcus neoformans var. neoformans JEC21
MSAAVPPMTPPLEKEESELVHRRPSPVDQLDPAFTPPHTPEQNPCKSTKGKGIDPIDPTLLASDRHIPDNYVSYTIANQKYLPPITWKNLIYNIQWISFLALTVTPSLAIYGVFTTAWNTKTAIWSVIYYFITGLGITAGYHRLWAHRAYNASVPLQFALAIAGTGAVEGSIKWWCRGHRAHHRYTDTELDPYSAEKGFFWSHVGWMLVKPRGKIGVADVSDLSRNRVVKWQHRHYIPLILGMGFVLPTVVAGLGWGDWRGGFFFAGAARLCFVHHSTFCVNSLAHWLGEQPFDNKHSPRDHIITALCTIGEGYHNFHHQFPQDFRNAIKWFQYDPTKWFIWTMSQLGLASHLKRFPDNEVKKGQYTMKLRLLKEQADQLEWPKSSNDLPVISWDDFKAEAKERSLVAIHGFIHDCSSFVEDHPGGAHLIKRAIGTDATTAFFGGVYDHSNAAHNLLAMMRVGILDGGMEVEHLKRRPAESAASSVTNSPVSSASASSVDIQSLADDDFRLDQTQLNSQGPKPKAPFGQPQAQVADRWTLSVPPSEKLRIVQTVPEIRPGLLTHRSTGKLNKVTKADVGGEINEFIGEKPVAAA

SEQ ID NO: 18019 - protein, 333 aa, Arabidopsis thaliana
MESLGKLQLHQQPNHLSFTHFSSSFPKKPSSFSLRSLPRSTSSFKCISIKASSSKSQDSKLSILKSTCVSFTAAAALFLVNLQLKPSPAIAAPVAATPLMESLKQSNGNVSFEEEERSLEEYLASHPDDVEALRSLMEVRIKSRKLLEAIELIDRLIELEPEEKEWPMLKANIFSYSGDLESAKTGFEEILVKDPLRVEAYHGLVMAYSDSGDDLNAVEQRIEEAMVRCKKEKNRKDLRDFKLLVAQIRVIEGKHNEALKLYEELVKEEPRDFRPYLCQGIIYTVLKKENEAEKQFEKFRRLVPKNHPYREYFMDNMVASKLFAEKVQREMAE

SEQ ID NO: 18020 - protein, 490 aa, Aspergillus nidulans FGSC A4
MHGRPPVQHAWPLNHILSKVDISDPYTFLNVKRGILQYTWLKPVLAIVSIVMKATDTYKEGYLGLSSGYLWTGILYNISVTISLYSLALFWVCLHHDLAPFRPVPKFLCVKLIIFASYWQGFFLSILQWLGALPNGTGDYTPDNLAAAIQDSLTCFEMPVFAVAHWYAFSWHDYADSTISAARLPVKYALRDAFGAKDLIEDTKMTMRGENYAYRLFDSGDHIIPHAESNSRVRRVMHGMRYERGGKAKYWIPQPGEVNSRTPLLGGFDGSSGSRRNSTLDRYRSHSESEETTLDDSDERLFSQARELEFGDFNYPVITANLVPRDQRLASPAPSRSTQQPTLVKKARKNRKSHASSSGRKTSEGHASRSSRQERSETSKLQRRGTDSPKSPGSHRSQLVDLVVEDREAEEEERAQIQRAFGSVAVEDEPKHFQRPSGDPVDGGATKDAEGNAESTIKQQRLGELEDEGTSPKTPAWDYRDLEEDNVWSR

SEQ ID NO: 18021 - protein, 733 aa, Ajellomyces capsulatus
MNMNHAGHGGGGAPSTGDAPSYFYMQKMYWAVVGSTIAVATVGNVLNKIIAAQRRVDRLADSGPTPSKPKSLFFTSYATITAMTRELSNYPLGPVIVGGTKLHLPPLGPVILMLANLIVVLVLCSYKLNLMDQWSWENVGYRTGFVTISQLPLVILLSNKTNIIGLLVGSSYERLNWLHRWVARTMWLTATIHMGFWFRSWGRYDYILVKLTTDPITQRGFASWCILTFIVLVSVAPVRKLSYEIFVLVHLLTFAGFLAAVWYHAQDEVKEWVWISIGLVVFGRLARLSVVLYSNLSIFHGLRGAKTSRPLWANKATFTPLPGNVTRIVVPNPVISWKPGQHMFLSCHGLVPLQSHPFSIASIPADEKLEFLVRAQNGGTKNFFKHASKDLDLLSGGGAILQNAKLVGVEGPYGTIRPLRQFDSLVLFAGGIGATFTMPLMRDVLEGWKREWFGNIPQRGAFFPSPNRAVTNRIRFIWVIRSRSLLSWFSEQLESALQDIDACRQSNAAFKGELEFSVYVTCDEEMSSTATSQPQLLQPAQQELTNRTPQVNEGAKEEIEEKTIETLSINSTSTAEESSPPKRPTTCQPDGGCCCTRKVTDENSSLTPCNCSGPSSPPTPLTASEEPSIQEKPTPTSVPALSNEPPTTTSITTQRPKSDVDPRIRILSGRPDSRGIIRKVLELAEGESAVVVCGPRGLNADVRRSVVSLSDERAVHKGTGAQGIYLHVESFEF

SEQ ID NO: 18022 - protein, 1126 aa, Candida albicans SC5314
MVLNDFDLKTEALNERTTLHTSQNASSKNGSNKESVLAKYEETNQNDEIEGFENLNDLSFSKYSKFSKASIIVGSDPKSRTTTLDSPFAKKLKEDLNVEFTSDNTKPYYPTVYPIYEFDNNDENSDSPFLDYQNEKGNIPQKLSGQKLRKQQQQQQQQSEAEENFKQSNQYARLQSTPKHQRTSSVKVSLTPAQKFEKRTSTRSHNALDNFELTTLVGNGAFASVYRAVNLKTNQVIAIKQIRIEKDQDVGVLMGEIDLLKILKHRNIVKYHGFVKTATSLNVLLEYCEGGSLRQLYKKLKKGLPEYQIINYVRQILEGLNYLHEQGVVHRDVKAANVLLTDKGDVKLADFGVATKVTSQHLTVVGTPNWMAPETVLGGEGICTASDIWSLGATIIELFTTNPPYHDLNAMATLHAIGTDEHPPLPKNMSTLAKDFLLECFQKQANLRISAKLLLKHKWLNQTATAKTSMATLLRQPSRELRSIKIYSESNDENWDEDFEEIKVSKFQNSTSSIIELKPDNTEKQFKLTEYSKKDLLTLFADEKEDTSGNFEFETIGPNKLAVVAESMDESDPFLNIDIENFDTNELEVQSKMEYLVVRLSRKLEQVHLGYEDAVPALVKVTGRMLHLVKKYPVSHDTLIRDHGVLSLLELLESFQDIPSQQQLWYHCLSILNHVFESDLGTLENFCFLGGIPTVAHFRSATYEVQVRLQVAKFIGILNLSEKALSMFVSCGGLRLVSKFVEEDFDTTPTFPLIAIESIHNILAKDLSRSKSDLCRILSKHGVIFWLVVLLNRLVKYDQKPSIKNVSKEQVEITIERIIDIIKYFSQSETKVRISIGSIDLFKLIFKLFDNLKLSHQLTLLKFVKSMSCISEVLKNLYHAEILEFLVKLLKSYIPSKGNYKEIINVLAPILYNSLALNHRRESEFVNLGGLPYLKTLSIINLPFRQFILPIICEFVHCDASVVNELKKNDIVKIYYNLLLDPYWQSNALDSLHCWYKLEPSYIDLNSPMAVDCLVGGFLLPKVSNLESTLEIYFKLLTNNLPLTRDMSNMNVINSILIKLSLHDKKNPVIQLSYLKVLKCLINYLVDSKSSLPFAKPVVNTLQSLKSRQSSLLIEEVTTELLSVLK

SEQ ID NO: 18023 - protein, 280 aa, Fusobacterium nucleatum subsp. nucleatum ATCC 25586
MDTRFNGGVIMDVTTKEQAIIAEEAGAVAVMALERIPADIRAAGGVSRMSDPKLIKEIMSAVKIPVMAKVRIGHFVEAEILQAIGIDFIDESEVLSPADSVHHVNKRDFSTPFVCGARNLGEALRRISEGAKMIRTKGEAGTGDVVQAVSHMRQIIKEINLVKALREDELYVMAKDLQVPYDLVKYVHDNGRLPVPNFSAGGVATPADAALMRRLGADGVFVGSGIFKSGDPKKRAKAIVEAVKNYNNPEIIAKVSEDLGEAMVGINENEIKIIMAERGV

SEQ ID NO: 18024 - protein, 116 aa, Xanthomonas campestris pv. campestris str. ATCC 33913
MTDTIFGKIIRREIPATIVYEDDEVLGFEDIAPQAPVHVLFIPKLHAIPTLDDVPPEQALLVGKLALAAAAYAREKGLAQDGYRIVMNCREHAGQTVFHIHLHLLAGAPLGRFGTP

SEQ ID NO: 18025 - protein, 887 aa, Oryza sativa (indica cultivar-group)
MAPAAHRDGAAEAVGQRVFHFGKGRSDGNKTMKDLLGGKGANLAEMASIGLSVPPGFTVSTEACQQYQAQKAMPAGLWDEILAALTWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESQSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVML

SEQ ID NO: 18026 - protein, 164 aa, Escherichia coli
AAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYK

SEQ ID NO: 18027 - protein, 149 aa, Thermosynechococcus elongatus BP-1
MMDGLRELLANHVLWVAFAASAIAQMLKLLIDIAKHRKLNFRVLVETGGMPSSHSALVTALATGVGLQRGWDSIEFAIAVVFACIVMYDAAGVRQAAGKQARILNQIVDEFFQEGHELAEAHLKELLGHTPIQVIVGSALGVAIAWLAV

SEQ ID NO: 18028 - protein, 468 aa, Oryza sativa (japonica cultivar-group)
MEPKPSTPTAAATPRFKLGKQSSMAPDRGGAGESSEEGSSEAVGVMGFQLMYMAHEGDVEGIQELLDAGADPNFRDSDGRTAMHIAACEGQAEVVELLLQRGADAVAEDQWGSTPLADALHYQNHDVIKILEKHGSKLKIAPMHVKNVREVPEYEISPNELDFTNGNGISKGTFRKATWRGILVAVKKLDDDLIMDENKVQAFRDELDVLQLIRHPNVVQFLGAVTQSSPMMIVMEFMPKGDLRKHLSRKGALEPSYAVKLALDIARGMNYLHEHKPQAIIHRDLEPSNILRDDTGHLKVADFDLCKMLKWRRKVREEKAVTSPGNACRYVAPEVLRNEEYDTKVDVFSFALILQEMIEGCLPFYDKKNNEIEKAHNSKERPPFRAPPKHYAYGLRELIEQCWSENPASRPDFRTIIEQLSYIQNEISQRNRWKVKPLKCFLSFEGMWKKDRNEGSTTRSSRSSRSYF

SEQ ID NO: 18029 - protein, 302 aa, Prochlorococcus marinus subsp. pastoris str. CCMP1986
MIPNNTKFSNPLFGRILTAMVTPFKKNGAVDYELAIKLSNYLCENGSDGIVLCGTTGESPTLTWAEQHNLFVAVKGSLNSRSKVIVGTGSNCTSEAIEATQKAYEFGADGALVVVPYYNKPPQEGLYKHFSSIANAASDLPLMLYNIPGRTGCNLLPTTVNKLMNFPNILSIKAASGRIEEVTELRAACGSKLSIYSGDDSLLLPMLSVGAVGVVSVASHIVGLQLKTMIESFQKGEISIALDIHEKLQPLFKALFETTNPIPIKAALELRGWQVGSPRNPLTPLIKEKRESLLQIIQNLSL

SEQ ID NO: 18030 - protein, 256 aa, Vibrio angustum S14
MRHPVVMGNWKLNGSKEMVSGLIKGLDAALNGVEGVDVAIAPPVMYLDLAEQLLSKANSKIILGSQNVDLHNNGAFTGDISPAMLKEFGASHIIIGHSERREYHNESDEFVAQKFAFLKENGLTPVLCIGESEAQNEAGETVAVCARQLDAVINTQGVEALNGAIIAYEPIWAIGTGKAATADDAQRIHAAIRAHIAEKSEEVAKNVVIQYGGSVKPENAAAYFAQPDIDGALVGGAALVAESFAAIAKAAAEAKN

SEQ ID NO: 18031 - protein, 229 aa, Brassica napus
MAGGAFVSEGSGGGSYEGGVTGFVIMTCIVAAMGGLLFGYDLGISGGVTSMEEFLSKFFPEVDRQMHNARRETAYCKFDNQLLQLFTSSLYLAALVSSFAASAVTRKYGRKISMFVGGVAFLIGSLFNAFATNVAMLIIGRLLLGVGVGFANQSTPVYLSEMAPAKIRGALNIGFQMAITIGILIANLINYGTSQMARNGWRVSLGLAAVPAVVMVIGSFVLPDTPNSM

SEQ ID NO: 18032 - protein, 333 aa, Triticum aestivum
RPRVRVRISIADESGREKCPPSFYYMPTNAVSQNALVSMFLAKIGSEDCCPECFDNCLSSPAPCACARETGGEYAYTLDGLVRPAFIDECVSMNRFPEEHHRVYCKTCPLERSRNKASPEPCRGHLVRKFIKECWSKCGCNMQCGNRVVQRGIRCNLQVFFTEEGRGWGLRTLDDLPKGTFVCEYAGEILTHTELHERAIQNMQNARYTHPILLDAGWCSGGEPKDEEALCLDGTFYGNVGRFINHRCCDANLAMIPIEVETPDHQYYHVAFFTSKKVEAFEELTWDYGIDFDDERQPVKAFECLCGSRYCRGGRRHLLRKERRRSRVTGTAG

SEQ ID NO: 18033 - protein, 320 aa, Vibrio angustum S14
MIKKIGVLTSGGDAPGMNAAVRGVVRAALTEGLEVYGIYDGYQGLYNNCIEKLDRKSVSDVINKGGTFLGSARFPEFREVEVREKAIENLKLHGIDALVVVGGDGSYMGAKKLTEMGYPCIGLPGTIDNDVAGTDYTIGYMTAMNTVIDAIDRLRDTSSSHQRISIVEVMGRHCGDLTLMSAIAGGCEYIITPETGLDKEKLLQHIREGIAKGKKHAIIAITELMTDVNELAKFIEAETGRETRATVLGHIQRGGQPTAFDRVLASRMGAYAVDLLQQGEGGRCVGIQCEQLVHHDIIDAIENMRRPVRNDLYELAEKLF

SEQ ID NO: 18034 - protein, 375 aa, Oryza sativa (japonica cultivar-group)
MDYDELDSMERETTATPMARSLFLPSHHVAVTPYKLPDAATSTLITAVPRTERGFVVELLGELWVLVGPISSLEQEGFQDRFGFLRYGEDGRIEGELERILGPQCLISDSWEVHSPDWCDPGVNFGEFLGSRIWPTVPARNRGNWGPIWCQLGSNLEVEAIDPAGEMIAAVGRGPEGWGEDEMSVLPRHTKVVVTGNNRTKSVLVGLHGVVKKAVGLGGWHWLVLTNGIEVKLQRNALSVIEPPTGNEDDDKFDCENMQWNSSDLASDDAQSPKPQRSRSRQHRGFQTKSFSRSMSCDSHSKASFSSSSRAHTKVDLSKLEMTALWRYWRHFNLDASPNPSREQLVDAVQRHFVSQVIVGFVQAAKRLKTNVKVA

SEQ ID NO: 18035 - protein, 211 aa, Staphylococcus aureus
PSADMLFEPRFVNDIDVNENDVVHFCSVDLVDSPMRVAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYNVKPVDTTGAGDAFIGAVISRILATDVLNLTQLFENEGEEILAFSNRVAAIVTTKYGAINSLPTLQEVEQAF

SEQ ID NO: 18036 - protein, 468 aa, Burkholderia mallei ATCC 23344
MQKGHSETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIAFGIGNHGVPMGISNLWAHGGFFPNGAQGVLMSMQMVMFAYLGVEMIGLTAGEAANPQKTIPGTINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAILVSMAALLVGVLLNYLVPEKVFVWVTSISTFGAIWTWGVILVTQMKFRASLAPAEERALRFRMPFWPYASWVALAFLVLVIGLMAYFPDTRIALYVGPAWLVLLVVLYFVLKLEPEGGKATGLERRYGRG

SEQ ID NO: 18037 - protein, 492 aa, Oryza sativa (japonica cultivar-group)
MGEEKQNDERKNKYAVGCSIIGSIISVLMGYDTGVMSGAMLFIKEDLKTNDTQVQVLAGILNVCALVGSLTAGRVSDCVGRRLTISLAACIFLVGSVLMGLAPNFATLLAGRCVAGVGVGYALMIAPVYAAEIASADIRGSLTSLPEICISFGILIGYVANYLLAKLPLVYGWRAMLGLGALPSAALALGVLAMPESPRWLVVQGRAEEALSVLRRIKAAAGLADDDGAAANAGSGGKGVWRELFLHPTPPVRRIVIAALGIHFFQHLTGIEAVVLYSPRIFKAAGIASRNSVLAATIGVGVTKTAFILTAILLVDRIGRRPLYLSSLAGIIASLACLGMGLTVIERSPPHHSPAWAVVLAIATVFTFVASFSIGVGPITWAYSSEVYPLRLRAQGASVGVAINRVMNAGVSMTFVSLYKAITIGGAFFLFAGLAVAAATFFYLLCPETQGKPLEEIEEVFSQGWRARRRASAAAVVMPASGGGGGGGAPMA

SEQ ID NO: 18038 - protein, 227 aa, Brassica napus
  misc_feature (11)..(12): Xaa can be any naturally occurring amino acid
  misc_feature (144)..(144): Xaa can be any naturally occurring amino acid
  misc_feature (146)..(146): Xaa can be any naturally occurring amino acid
  misc_feature (151)..(151): Xaa can be any naturally occurring amino acid
  misc_feature (159)..(160): Xaa can be any naturally occurring amino acid
  misc_feature (177)..(177): Xaa can be any naturally occurring amino acid
  misc_feature (197)..(197): Xaa can be any naturally occurring amino acid
  misc_feature (201)..(201): Xaa can be any naturally occurring amino acid
  misc_feature (207)..(207): Xaa can be any naturally occurring amino acid
  misc_feature (215)..(215): Xaa can be any naturally occurring amino acid
  misc_feature (218)..(218): Xaa can be any naturally occurring amino acid
  misc_feature (220)..(220): Xaa can be any naturally occurring amino acid
  unsure (1)..(227): unsure at all Xaa locations
MAVVGQWTLCXXSPRLTPAICSSTSSPTTVNLRAELAAFRPQFRLFSRTSPSRRRLRASTSSAESGIFLPHLVASMEQVEETYIMVKPDGIQRGLVGEIISRFEKKGFKLIGLKMFQCPRELAEEHYKDLSSKSFFSSLIEYIXSXPVVCXPWEGVGVXXSARKLIGKTDPLQAEPXTIRGDLAVQTGRNIVHGSDXPENXKREIAXWLKEGELXGWXSXLAKWLRE

SEQ ID NO: 18039 - protein, 414 aa, Leifsonia xyli subsp. xyli str. CTCB07
MGAGKKIFGIVLAGGEGKRLMPLTTDRAKPAVPFGGQYRLIDFALSNLINSQLRQIVVLTQYKSHSLDRHISQTWRPDGMLNSYIASVPAQQRLGKRWFSGSADAILQSINLLRDEKPDIVVVVGADHVYRMDFGQMIRSHLDSGSSVTVAAIRQPVSLADQFGVIEVDPASPERIAAFREKPSDPVALPESPGEVLASMGNYVFTADALIAAVRRDADRPDSNHDMGGDIIPDFVARGEAGVYDFTNNEVPGSTDRDRYYWRDVGTIDSFFEAHQDLISALPVFNLYNRQWPIFSQVLNSPPAKIVRDGRGALGTTIDSIVSLGSVISGAHLERSVLGPWATVDSGAKVIDSVVFERALIEPNAFVGRAILDKDVVVAAGASIGVDPDRDRARGFTVTESGITVVGKGVHVVP

SEQ ID NO: 18040 - protein, 425 aa, Corynebacterium diphtheriae NCTC 13129
MADIMHVFAREILDSRGNPTVEAEVFLDDGSHGVAGVPSGASTGVHEAHELRDGGERYLGKGVLNAVNNVNEEIADAIAGAEADDQRLIDQAMIALDGTENKSRLGANAILGVSIAVAKAAAESAGLPLYRYIGGPNAHVLPVPMMNIVNGGAHADSGVDVQEFMIAPIGAESFSEALRMGAEVYHSLKSVIKSKGLSTGLGDEGGFAPSVESTKAALDLIVEAIEKAGFKPGADIALALDVASSEFYKDGKYHFEGGEHTAEEMAKVYEQLIAEYPIVSIEDPLQEDDWEGYTALTAAIGDKVQIVGDDFFVTNPARLKEGIEKKAANALLVKVNQIGTLTETFDAVDLAHRNGYRTMMSHRSGETEDTTIADLAVALGCGQIKTGAPARSERVAKYNQLLRIEQQLDDAAVYAGRSAFPRFQG

SEQ ID NO: 18041 - protein, 294 aa, Aspergillus oryzae
MSPSIPSRAFKFIEDLSTSVQGTDSMDYHRGKLLNYVAFQWSHIVTNYSPESIELLGTFAVHFIFYWFGSLVFALADLYAPSSILKKYKIQSISKQPSRQVMLQCIPSALQNQLITSALHALKLLALRSITGRFAGYRIERTLPSLLEIITDAPLCFIGRDFVCYYDHRILHLPWFYRRFHKEHHKFTAPVAVAAEHTHPVDHILINVLPVVIPATLFRVHLVTFWLLMSSTILQGSLGHSGWHVRSIFDRKTTSHDAHHELFDVEYGTLGLMDWLHGTNYMGKHKSKGKGKVH

SEQ ID NO: 18042 - protein, 595 aa, Oryza sativa (japonica cultivar-group)
MSKVTQANGIDSRGETREVVEGKVDWRGRPAIRGSHGGVANSFFILVNFGLENLASLSLAVNLIIYFMTVMHIGLTDGSNLLTNYMGTSYMVAVLISVFADTFIGRYKTVIISSVIELVGLLILTLQAHSNKLKPPYCVFPFDPKCETVSGDGRTHLYVGLYLVAIGSAGIKAALPAHCADQFDEKHPTEKLQMSSFFNWLLLSLCTGGAISVTVFVWIQSYKGWDKGFGAATGVMGLALLVFIAGLPGYRISVVQGSTALLEILQVYVAAIRNRNMKLPENPDELYEISKSKAPPDTDFMAHRDKPFRFLDKAAIVQAPTDEAPSPWRQCRVTQVEHAKTVLAMVPIFCSAIIMSTCLAQLQTFSIQQGVTMDRTIGTFKMPPASLPIIPLIVLVFAVPIYERGFVPFARRITGHPNGIPHLQRVGVGLVLSIVSMAIAAVVEVRRKRVAARHGMLDANPILGKQLPISCFWLAPQFTVFGVADMFTFIGLLEFFYSQAPPALKSMSSSFLWCPMSLGYFLSTIIVKAVNAATRGATASGGWLAGNNINRNHLDLFFWLLAVLSFLNFLNYLFWASWYKYKPQQSAHVPAEHKV

SEQ ID NO: 18043 - protein, 294 aa, Triticum aestivum
  misc_feature (101)..(101): Xaa can be any naturally occurring amino acid
  misc_feature (154)..(154): Xaa can be any naturally occurring amino acid
  misc_feature (201)..(201): Xaa can be any naturally occurring amino acid
  misc_feature (233)..(233): Xaa can be any naturally occurring amino acid
  misc_feature (253)..(253): Xaa can be any naturally occurring amino acid
  misc_feature (278)..(278): Xaa can be any naturally occurring amino acid
  unsure (1)..(294): unsure at all Xaa locations
MEAAAELAQRLRAAANERLAGQEPLLLVAAPLLALLAARAVHAAAADVADRGLRTVLITLAMAAVKLVPGVSGYIAAEKSKVVEKLQSGSASSKKNLRTEXLPAVGIPDRVIGDLQALKDKDVRWQGKCSGTVYIAGSESEGHFSLINKAYSMXSHTNPLHQDVFKSVAQLEAEVVAMTAALLGSKEIASGGQICGNMTSXGGTESILWAGKTSSDYMQSKRGITKREMIIAXESVHLALTKVANYSTIKVRXVPVNKEFFANVKGLQGRLNGKPPLXLDPARGFPRGVVPPIG

SEQ ID NO: 18044 - protein, 250 aa, Salix discolor
MGRGRVQLKRIENKINRQVTFSKRRTGLLKKAHEISVLCDAEVALIVFSHKGKLFEYSTDDCMEKILERYERYSYEERQLAATDFDSPGNWTLEYNRLKAKVELLQRNHRNYLGEDLDSMSLKELQNLEQQIDTALKHIRARKNHLMSQSISELQRKEKAIQVQNNMLVKQIKEKEKKDKAVAQPALWDDQQNQGPHASSFLLSQPAGLPLPCLNIGGCYQEETDPEVRRNELDHALEPTYSFHLGGYGA

SEQ ID NO: 18045 - protein, 375 aa, Cryptococcus neoformans var. neoformans B-3501A
MPSRGRSTTPKSLTPDRSPARSYLSRSRSPSRSRSRSPLPRKASLRDADMDAPGDGLYKVIVVSGLSKNVMKGHLDEIFSEYGRITGIDLPLFKVSGLNKGKAAIEFDTPAAASKAVKCMDGGQLDGSFLNVQISEHPLPPPQAPSPRRRSPSRSRSRSPPPARRRRSLSRSRSPSPRKGDRVPSYGRRRSYSRSRSPPRHRGGRDSFPGRNGNGYGPGPSGGRGGGGGRGGFSRGGGPPPPGGRDNGWRRERSPPVPVRKWGERGAPRRPSPEYGRGARSASRSVSPRGPRGGVRSRSPVRRRASVSRSRSPVRRRSRSRARSYSRGRSVSMSRSRSRSPLPRKRYSLSRSRSRSSTRSMSIDRSRSGTRSPRK

SEQ ID NO: 18046 - protein, 238 aa, Salmonella enterica subsp. enterica serovar Paratyphi A str.
MPKIIVSLMGRDINSVKAEALAYREATFDILEWRVDHFMDIASTQSVLTAARVIRDAMPDIPLLFTFRSAKEGGEQTITTQHYLSLNRAAIDSGLVDMIDLELFTGDADVKATVDYAHAHNVYVVMSNHDFHQTPSAEEMVLRLRKMQALGADIPKIAVMPQSKHDVLTLLTATLEMQQHYADRPVITMSMAKEGVISRLAGEVFGSAATFGAVKQASAPGQIAVNDLRSVLMILHNA

SEQ ID NO: 18047 - protein, 325 aa, Zea mays
DAWAYLFSLFSHLSQNLSVSRLSRAPFSHARPAPPPVAPPRPRPALEEPTPAATAAASPAPDRAPPRPRGGGGRGGRGGGMKGGSKAVVVAHKHAGVFISKSKEDALCTKNMVPGESVYGEKRVSVQNEDGTKVEYRVWNPFRSKLAAAVLGGVDNIWIAPGTRVLYLGAASGTTVSHVSDIVGPDGLVYAVEFSHRSGRDLVNMAKKRTNVIPIIEDARHPARYRMLVGMVDVIFSDVAQPDQARILALNASYFLKNGGHFVISIKANCIDSTLPAEAVFAAEVEKLKADQFKPAEQVTLEPYERDHACVVGGYRVPKKQKATS

SEQ ID NO: 18048 - protein, 211 aa, Staphylococcus aureus
PSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKSVDTTGAGDAFIGAVISRILATDVLNLTQLFENEGEEILAFSNRVAAIVTTKYGAINSLPTLQEVEQAF

SEQ ID NO: 18049 - protein, 436 aa, Zea mays
NILGWAFPSGEGVARCTSITTIGPAYHARGGGVIVSPRSPLVPPSSPHQFKIQSLLLPLGDPIVLEQGRWPLARCRHHLLLLSVLLALAAAAARQAQSHGKASAVFIDASSHRYLRDQQADHQDASMSLNEVSAVVSVLLGFAPSTSLPAISSSKLNKVLLPNPFDRPRAVFLVQIDGFNVPSFVSEGSNIFKTRIEGANIADTGLTDKDDLIVIHSDESLDLSRSDYLDNELSSLANWLEGSYQKSTGKLVIPLENGNSLTLQLDKEADKEFMSSLASLLKTIERAIQVHEDFSGVVNPAELLECHFTGLKALENEYGSGEIVKQGTEIVQRAVTKSFQSLHEAYKGKIVGLVISTNEAPSSLGSIIDAPSSLHISRRLEEASKTTDIASVVLVRKSLAWITGIILLVSTLIGVCLLMNMPLTRDTLLYSNVKID

SEQ ID NO: 18050 - protein, 140 aa, Aspergillus oryzae
MWKPNRTPVRTQDAPLPPSFLSQAIVAGEQIYCSGQVGVSPSTGKMVEGPIQERTKQILRNLSAVLVAGGSSLQDVVKVNIFLADMGDFAAVNEVYESFFQDPKPARTCVAVKTLPLGTDVEIECTGLVTKRRTQGNSRL

SEQ ID NO: 18051 - protein, 450 aa, Leifsonia xyli subsp. xyli str. CTCB07
MTPVLSTLLDDVLRRNAGEPEFHQATREVFGSLGPVIAAQPRYTQAAVLERLTEPERQLIFRVPWTDDEGNVRVNRGFRVEFNSALGPFKGGLRFHPSVTLGTVKFLGFEQIFKNALTGLPIGGGKGGSDFDPKGRSDAEVMRFCQSFMTELYRHLGEYTDVPAGDIGVGGREIGYLFGQYKRITNRYESGVLTSKGIGWGGSLVRTEATGYGSVFFAERMLATRGRDFTGVRVLVSGSGNVALYAIEKVHQLGGTVVACSDSSGVVYDRGGLDLDLLRQIKENERGRLSDYAARRAAGSEYRANGDIWAIAAQTPIDVALLAATQNELDATAAATLAQNGVIAVVEGANMPCTPEAVHLLRTAGVLFAPGKAANAGGVATSALEMQQNASRDAWSFEYAEGRLADIMANIHDSCAETAEKYGAPGDYVLGANIAGFVRVADAMLALGVI

SEQ ID NO: 18052 - protein, 292 aa, Escherichia coli
MFTGSIVAIVTPMDEKGNVCRASLKKLIDYHVASGTSAIVSVGVTGESATLNHDEHADVVMMTLDLADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 18053 - protein, 1171 aa, Oryza sativa (indica cultivar-group)
MASGSRATPTRSPSSARPAAPRHQHHHSQSSGGSTSRAGGGGGGGGGGGGGAAAAESVSKAVAQYTLDARLHAVFEQSGASGRSFDYTQSLRASPTPSSEQQIAAYLSRIQRGGHIQPFGCTLAVADDSSFRLLAYSENTADLLDLSPHHSVPSLDSSAVPPPVSLGADARLLFAPSSAVLLERAFAAREISLLNPLWIHSRVSSNPFYAILHRIDVGVVIDLEPARTEDPALSIAGAVQSQKLVVRAISRLQALPGGDVKLLCDTVVEHVRELTGYDRVMVYRFHEDEHGEVVAESRRSNLEPYIGLHYPATDIPQASRFLFRQNRVRMIADCHAAPVRVIQDPALTQPLCLVGSTLRSPHGCHGQYMANMGSIASLVMAVIISSGGDDDHNIARGSIPSAMKLWGLVVCHHTSPRCIPFPLRYACEFLMQAFGLQLNMELQLAHQLSEKHILRTGTLLCDMLLRDSPTGIVTQSPSIMDLVKCDGAALYYHGKYYPLGVTPTEVQIKDIIEWLTMCHGDSTGLSTDSLADAGYSGAADLGDAVSGMAVAYITPSDYLFWFRSHTAKEIKWGGAKHHPEDKDDGQRMHPRSSFKAFLEVVKSRSLPWENAEMDAIHSLQLILRDSFRDSAEGTSNSKAIVNGQVQLGELELRGIDELSSVAREMVRLIETATVPIFAVDTDGCINGWNAKVAELTGLSVEEAMGKSLVNDLIFKESEETVNKLLSRALRGDEDKNVEIKLKTFGPEQSKGPIFVIVNACSTRDYTKNIVGVCFVGQDVTGQKVVMDKFINIQGDYKAIVHNPNPLIPPIFASDENTCCSEWNTAMEKLTGWSRGEVVGKLLVGEVFGNCCRLKGPDALTKFMIVLHNAIGGQDCEKFPFSFFDKNGKYVQALLTANTRSRMDGEAIGAFCFLQIASPELQQAFEIQRHHEKKCYARMKELAYIYQEIKNPLNGIRFTNSLLEMTDLKDDQRQFLETSTACEKQMSKIVKDASLQSIEDGSLVLEKGEFSLGSVMNAVVSQVMIQLRERDLQLIRDIPDEIKEASAYGDQYRIQQVLCDFLLSMVRFAPAENGWVEIQVRPNIKQNSDGTDTMLFPFRFACPGEGLPPEIVQDMFSNSRWTTQEGIGLSICRKILKLMGGEVQYIRESERSFFHIVLELPQPQQAASRGTS

SEQ ID NO: 18054 - protein, 827 aa, Blastopirellula marina DSM 3645
MQVLIWFLVLLAALAALAQAYVFFMQMLRSDPGNERMQEIAGFVREGANAYLTQQYRIVAYFFIVIFALLSLLSYVFQAQSVWVPFAFVTGGFFSGLAGWIGMKTATAASSRTSAGARISLNQGLQVAFRSGAVMGLTVVGLGLLDITIWFAVLRWVFQLNLVDVTVTMLCFGMGASCQALFARVGGGIFTKAADVGADLVGKVEQGIPEDDPRNPASIADNVGDNVGDVAGMGADLYESYCGSLLATAALGVAAFSSPTLAAAAHLDVPTAQFYALFLPLALAAAGIVLSIAGVYMVRTEEGATQKNLLAALGRGINFSTGMVALAAILLSMWLMPKVDGAVYWYVPGVALSIFTGLAAGWLIGKWTEYSTSDEFEPTKKLADQALTGPATIIIGGIADGMMSVWAPVLVIAVATLVAFGAANGWRFSDPDYFSLGLYGVGIAAVGMLSTLGITLATDAYGPIADNAGGNAEMSGLEAIVRERTDALDSLGNTTAATGKGFAIGSAALTALALLAAYVEEVRIGFERWGDNLAHVIDSDQPYRVSSGFIIYKTVEDEQEHVHGFLSLPGDRRDKRVVEAWDKLDFSRGPVKIPVDMIQAETTDGHLHLNMVGRDIELLPIHTATLIDFTNYYEANLMNPKVLGGLFVGAMATFVFCALTMKAVGRAAKGMVEEVRRQFREKPGIMDGSELPDYASPVEISTKAAQWEMVLPSVLGLATPIVIGFLLGVGGVLGLLVGTLTTGFCLAIFMANSGGAWDNAKKYIEAGAHGGKGSDAHKAAVVGDTVGDPFKDTSGPSLNILIKLMSMVSVVGAGFVVRYSLLALGVF

SEQ ID NO: 18055 - protein, 250 aa, Salix discolor
MGRGRVQLKRIENKINRQVTFSKRRTGLLKKAHEISVLCDAEVALIVFSHKGKLFEYSTDDCMEKILERYERYSYEERQLATTDFDSQGNWTLEYNRLKAKVELLQRNHRNYLGEDLDSMSLKELQNLEQQIDTALKHIRARKNHLMSQSISELQRKEKAIQVQNNMLVKQIKEKEKKDKAVAQPAPIWDDQQNQGPHASSFLLSQPAGLPLPCLNIGGCYQEEAPEVRRNELDHALEPTYSFHLGGYGA

SEQ ID NO: 18056 - protein, 289 aa, Blastopirellula marina DSM 3645
MKVQLVQRLAMTLALIASLTFSVRAIAADDATGRFADAEEVNMFQGIKDGVLDVKFIPMNAEKGTFIITNKTAKKLKVEMPSAFAGVPLAQFGGGGGGFGGGQGGGGGGGFGGGQGGGGGNQGAGGGGGGFGGGQGGGGGGFGGGQGGGGGGGFFNLMPEKTQKVKYEGVCLDHGLEDPNPKIPYEVVPIEQYTTKPGVGTLLHMLGSGKIDQRVAQATAWHLNNDMSWEELAAKSIKHLDGRVEPYFSRKEIVTAMQATQFVEKYEAEMKQKAKTAPSSGESFSTSVE

SEQ ID NO: 18057 - protein, 328 aa, Prochlorococcus marinus subsp. pastoris str. CCMP1986
MIILHIGLFENSFSNIMKSVIFQETANLKKPVPAEKVIELSDKLLEPSSHSKRYPPRLHKTWGTIFFMIAIHLLSLLALQPQFWSMPAVTALFFFYWLTACLGVTLGYHRLLSHRSFVVPKWLERFFATCGAISCQHGPIDWVGLHRHHHSFSDTEVDHHNSKRGFWWSHMGWMFKDVEALKAVPKLSADLIKDPYYRFLNKYFLFLQIPIGLCLYAIGQKLGVGGWALVLWGIPLRLVVVYHITWLVNSATHCWGKAPFESGDGSKNNAWVAALTFGEGWHNNHHAFPNSARQGLFRGQIDLTWEHIKILAKLGFAKKVKLPSRSYY

SEQ ID NO: 18058 - protein, 291 aa, Blastopirellula marina DSM 3645
MKVRLFQRLAASLALLATLAFSFPAAADDNASGRFADAEEVNMFKAIEDGVIDVKFIPMNSEKGTFIITNKTTKKLRVEMPAAFAGVPLAQFGGGGFGGNGGGGGFGGNQGGGGFGGGGGGGNQGFGGGGGGFGGNQGGGGGGGFGGGNNGGGGGFFNVMPEKTQKVKVDGVCLDHGLEDPNPKIPYDVKPIDQYTTKPGVATLLHMLGSGKIDQRVAQATAWHLNNDMSWEELAGKTIHHLDGRSESYFSRKEINTAMQASAFVVKYETEMKQQPEPSDSLSSRVSTDAR

SEQ ID NO: 18059 - protein, 465 aa, Bradyrhizobium japonicum USDA 110
MSSEVHPVDEVLPVPRLLALGLQHVLVMYAGAVAVPLIIGRALKLPPEDVAFLISADLFACGLATLVQCLGFPGVGIRLPVMMGVTFASVGPMLSMAAAPDIGLLGIYGSVIAAGLFGIVAAPFVSRLLPLFPPVVTGSIILVIGISLMRVGINWAGGGLPTLTKVVDGVAGSFPNPAYGQLQGLGISLFVLLFILGLIKWGTGFLANVSVLLGIVAGAVLATILSVMHFDKVSAASWGALVIPFRFGMPQFHLVPVVTMCVVMIVVMIESLGMFLALGDITGKTVDREALSRGLRADGVGTLLGGIFNTFPYTSFSQNVGLVSVTGVRSRWVTVTGGCIMLGLGLLPKLAALVEAVPLVVLGGAGLVMFGMVAATGARILTSVDFRTNRYNLFIVAISIGFGLIPLAAPGFFRNLPHDLQPLLESGILLCAVVSVLLNAFFNGLGGGAAAEADAAAVASSAQHV

SEQ ID NO: 18060 - protein, 296 aa, Bradyrhizobium japonicum USDA 110
MMSQISLADLNAADKADFVAALANVVEYSPWIAEKLAGQRPFTGINQLHAALMAAIQSAEPDVQLALIRAHPDLANKTQRAAGLTAESTDEQNSAGLDRLSDAEYAAFERVNNAYREKFGFPYIVCVRRHTKDSVLRDFETRLLNIAKTETRRAIEEIGRISALRLDQLVVADDKLKVHGRLSTHVLDNHAGKPAPGIPVELIELASLGESRVIARTVTNADGRTDQPLIGGRPLPIGRYELRFRVAKYYAERNVPLSEPPFLDEIPLRFAISEPENHYHVPLLVTPWSYATYRGS

SEQ ID NO: 18061 - protein, 340 aa, Thermosynechococcus elongatus BP-1
MTLRVGINGFGRIGRLVLRAGLACDNLQFVGINDLVPADNLAYLFKYDSTHGMYPGTVKATAEGIEIDGQFIPCTAVRNPAELPWGAVGADYVVESTGLFTSYEGAAQHLQAGAKRVVISAPTKDADKVKTIVVGVNHDTFDPSSDRIVSNASCTTNCLAPVAKVLHASFGLAEGLMTTVHAVTATQPTVDGPSKKDWRGGRGAGQNIIPASTGAAKAVTLVLPELKGKLTGMAFRVPTPDVSVVDLTFKTEKATTYGDICAAMKAAAEGELKGILGYTEEAVVSSDFIGDGRSSIFDATAGIQLNANFFKVVAWYDNEWGYSCRVVDLLKLMAAKEGLL

SEQ ID NO: 18062 - protein, 347 aa, Pyrococcus horikoshii
  misc_feature (4)..(4): Xaa can be any naturally occurring amino acid
  misc_feature (8)..(8): Xaa can be any naturally occurring amino acid
  misc_feature (64)..(64): Xaa can be any naturally occurring amino acid
  misc_feature (228)..(228): Xaa can be any naturally occurring amino acid
  misc_feature (334)..(334): Xaa can be any naturally occurring amino acid
  misc_feature (345)..(345): Xaa can be any naturally occurring amino acid
  unsure (1)..(347): unsure at all Xaa locations
SEKXVAIXKTKPGYGAELVEVDVPKPGPGEVLIKVLATSICGTDLHIYEWNEWAQSRIKPPQIXGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVXDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELXRAGKTGKVVFXLK

SEQ ID NO: 18063 - protein, 347 aa, Agrobacterium tumefaciens str. C58
MRGVVIHAAKDLRVEDVAGQPLAADEVRVAVAVGGICGSDLHYYNHGGFGTVRVREPMALGHEFAGTVVEVGSSVSHLVPGMRVAVNPSLPCGTCRYCAQGRQNQCLDMRFMGSAMRSPHVQGGFREVVTVHSTQPVQIADGLSMGEAAMAEPLAVCLHAARQAGSLLGKTVLITGAGPIGMLSLLVARLAGAAHIVVTDVADAPLDLARRIGADEAVNILRDADMLEKYRFEKGVFDVLFEASGNQAALLPALDLLRPGGIIVQLGLGGDFTIPMNLIVAKELQLRGTFRFHEEFAQAVNMMGRGLIDVKPLISATLPFDQAREAFDLAGDRAKSMKVQLAFSGAA

SEQ ID NO: 18064 - protein, 211 aa, Staphylococcus aureus
PSADMLFESSFVNDIDVNENDIVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 18065 - protein, 1072 aa, Pseudoalteromonas tunicata D2
MPKRTDIKSILILGAGPIVIGQACEFDYSGAQACKALREEGYRVILVNSNPATIMTDPEMADATYIEPIHWEVVEKIIEKEKPDAVLPTMGGQTALNCALDLDRRGVLAKHGVELIGATADAIDKAEDRSRFDVAMKAIGLETPRAEIARSMESARDIVTRIGFPCIIRPSFTMGGTGGGVAYNQEEFEEICERGLDLSPTKELLIDESLIGWKEYEMEVVRDKNDNCIIVCSIENFDPMGVHTGDSITVAPAQTLTDKEYQIMRNASMAVLREIGVETGGSNVQFGICPDTGRMVIIEMNPRVSRSSALASKATGFPIAKIAAKLAVGYTLDELQNDITGGKTPASFEPSIDYVVTKIPRFNFEKFAGANDRLTTQMKSVGEVMAIGRNQQESLQKALRGLEVGATGFNPIVALDDPSAREKIIHELREPGAERIWYVADAMRHGMSVDDVFEYTKIDRWFLVQIEDILKDEAKIASSGMAGLNKDFLRRLKRKGFADARIAEIAGVSEAEIRKKRHNFNIFPVYKRVDTCAAEFSSDTAYMYSTYDEECEANPSNRDKIMVIGGGPNRIGQGIEFDYCCVHAALALREDGYETIMVNCNPETVSTDYDTSDRLYFEPITLEDVLEIVRVEKPKGVIVQYGGQTPLKLARALEANGVPVIGTSPDAIDRAEDRERFQQLVERLGLLQPHNATVTSTEEAMAKSAEIGFPLVVRPSYVLGGRAMEIVYDEDDLRRYMTEAVQASNEAPVLLDHFLDDAIEVDVDAICDGEQVIIGGIMEHIEQAGVHSGDSACSLPPYTLSAEIQDRMRDQVTRMALELGVVGLMNTQFAVKDGDVYLIEVNPRAARTVPFVSKATSVPIAKIAARCMAGQSLASQGITKETIPPYYSVKEVVLPFAKFQGVDPIRGPEMRSTGEVMGVGDNFAEAFAKAQLGAGNVLPRGGRALLSVRNGDKKRIVELARIMTELGFELDATGGTAAALETAGIAVRRVNKVFEGRPHILDRIKNGEYSYIVNTTEGRQAIEDSKVLRRGALQHKTNYTTTLNAAFANCKANAADDRSKVNSLQELHRRVK

SEQ ID NO: 18066 - protein, 127 aa, Azotobacter vinelandii
MSKSVINTDKAPAAIGTYSQAIRAGDTVYLSGQIPLDPGTMELVEGDFEAQTVRVFENLKAVVEAAGGSFADIVKLNIFLTDLAHFANGNECMGRYFAQPYPARAAIACASLPRGAQVEMDGILVLG

SEQ ID NO: 18067 - protein, 479 aa, Medicago truncatula
MDPHAAEDLPQYIHINQNDFFMRRHKKQKEEDIAICECRYDEDDPDSACGDGCLNVLTSTECTPGFCPCDIHCKNQKFQKCEYAKTKLFKTEGRGWGLLADEEIKAGQFVIEYCGEVISCKEAKRRSHTYEIQGLKDAFIISLNASESIDATRKGSLARFINHSCQPNCETRKWNVMGEIRVGIFALENIPIGTELAYDYNFEWFGGAKVRCLCGALKCSEFLGAKSRGFQEDTYLWEDDDDRYSIEKIPLYDSAEDELTSNVGGQSEQSMAIILKVEEPSESTVLNIQPLNSIGINGLGIQKMKTEIESEDMRLYSQDTKQDLPQKNAMISRIRSNTAGGKSISTKRSKGAKLKNRIQKKIDAKYAAGLLASKEAQEEILDYEKRKDDAREALDSLYNEIRPAIEEHEKDTQDSVSTTVAEKWIQASCLKLKAEFDLYSSIIKNVACTPQRAPSQAKGTEVDNEDKMKLLTFSPSSNP

SEQ ID NO: 18068 - protein, 126 aa, Yersinia pestis CO92
MKSVIETKNAPSAIGPYSQAICFNGILYASGQIPINPDTGDLVENDIEKQTRQVLKNIDAVLLQAGTTKDKIVKTTIFITNINNSSQVNDIYADYFKGTIFPARSTVEVSALPKGALVEIEVIAGV

SEQ ID NO: 18069 - protein, 537 aa, Azoarcus sp. BH72
MTTELTFASLGLAEPLLRAISDTGYTTPTPIQAKAIPLVLAGGDLLAAAQTGTGKTAGFTLPVLHKLAATHVHPHPAGKPRCLILTPTRELAAQVEESVQTYGKHLALTSMVMFGGVNINPQISALKKRVDILVATPGRLLDHVGQKTLDLSGVEILVLDEADRMLDMGFIRDIRKVLALLPKQRQNLLFSATFSDEIRDLANGLLHNPGCVEVAPRNTASERVEQTVYMIGQKQKRELLAWLIKEKQWFQALVFTRTKHGANKLAEYLTKHDIPAAAIHGNKSQSARTRALSQFKDGSLPVLVATDIAARGLDIDQLPQVVNFELPNVPEDYVHRIGRTGRAGADGNAISLVDGEEVKLLTAIERLIRRKIDRATAEGFVPSAVPDTSADDDRDERRGQDRGRGRQGQGRDGNRSQGQPQGQARRGGEGGNGGGRGQGGRPGAPARQGNGGQRRDQPRGEVNGNRAQTTQQREVDGNRMPAPRPDVDGNRMPAPSRRGEVNGNRAQPAPRQGQNNRGGRPAQQRAALFSAKPGGNR

SEQ ID NO: 18070 - protein, 292 aa, Escherichia coli
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYFNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 18071 - protein, 470 aa, Leifsonia xyli subsp. xyli str. CTCB07
MTTAETSGEPALSGEAVLQAKAKDHLWMHFARQSVMEDGHGVPIITRGEGHHIWDSRGKRYIDALSGLFVVNAGHGRKRLAEVAAKQAEQLAFFPIWSYAHPNAIELADRLASYAPGDLNRVFFSTSGGEAVETAFKLAKHYWKLQGRPAKHKVLSRAVAYHGTPQGALAITGIPAMKEMFEPLTPGGFRVPNTNFYRAGEMGAPADDIEEFAVWAANRIEEMIQFEGPETVAAIFLEPVQNSGGCFPPPPSYFQRVREICDKYDVLMVSDEVICAFGRIGHMFACDEYGYVPDMITCAKGMTSGYSPIGATIISDKIYEPFKHGNTSFYHGYTFGGHPVSSAVALENLDIFEEERLNERVRENSPLFRAELEKLLALPLVGDVRGDGYFFGIELVKDKAAKETFDDDESERLLRGFLSKALFDAGLYCRADDRGDPVVQLAPPLTIGTDEFVEIRQILESVLTEAGNRL

SEQ ID NO: 18072 - protein, 292 aa, Escherichia coli
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILFNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 18073 - protein, 193 aa, Zea mays
  misc_feature (133)..(133): Xaa can be any naturally occurring amino acid
  unsure (1)..(193): unsure at all Xaa locations
ATERFEVAYRTIKELALAGSPGSKTVKQASQQLLPLCAKAMQENNAELTREAVDVFIWCLTQNAESYKQWERIYPENTEASVAVLSKIVIDWKDVSPKLSSEALKATVKNLKAKNEAALESATDAGKQASIKXADKHCKVILGKLARGSTCLKSSLVGIALAVAASLVLSSPDMDLPLEWEKIQAMVSSHLSF

SEQ ID NO: 18074 - protein, 378 aa, Leifsonia xyli subsp. xyli str. CTCB07
MDDEILLSVDQIRFFAGAARNLEGRSAGEYLKGHTSFVRREPIGVVGQVTPWNYPLNMAVWKFAPALAAGNTTVLKPSDTTPLSTLLLAEIASEFLPAGVLNVILGDRTTGVAMTGHPIPQLISITGSVRAGREVARGASYDLKRVHLELGGKAPVIVFDDADVEKAVAGIVAAGYFNAGQDCTAATRLLVQEGVHDEFVAALAQYAGENAKMGGPREDGILYGALNSANQLARVNGFVDRLPDHANIELGGRRQGDRGYFWEATIVSGLRQDDEAVQNEIFGPVQTVQKFAGEAEAMASANDVQYGLASSVWTKDHGRALRFAKGLDAGCVWINTHIPIVAEMPHGGFRHSGYGKDLSAYGFDDYTRIKHVMSYIGE

SEQ ID NO: 18075 - protein, 198 aa, Escherichia coli CFT073
MNNTDLIHLIKHFMHNELKAVEEVIDSPLSEFANLIKVLQSCQGKVVFIGVGKSGIIARKLAATFASTGTPSFFVHGTEAVHGDLGMVAKDDVVILISNSGETAEILATLPSLKKMGNYLISFTRSHHSSLAISCDLSVEIPVKSEADNLGLAPSCSSTVVLVVGDAVALALSELKKFTRADFGLYHPGGALGIKANS

SEQ ID NO: 18076 - protein, 478 aa, Leifsonia xyli subsp. xyli str. CTCB07
MSTHALRNFVGGEYVDSTATERLDITDPATEEVFATAPISTERDVALACRAAAGAFETWGETTPGERQRALLRFADALEARAEELADVEVKDTGKPRAGIVADEVEVMIDQVRFFAAAARNLEGRSAGEYLKDHTSFIRREPIGVIGQVTPWNYPMMMAIWKLAPALAAGNAVVLKPSDSTPSSSLLLAEIASEFLPAGTVNVVTGNRETGRALIADRTPQMVSITGSVRAGVEVAGSAALDLKRVHLELGGKAPVVVFDDADIEQAVEGISAAGFYNAGQDCTAATRLLVQEGIHDEFVAALVEYSRDNAKTGAPLEEGILFGALSSADQLACVQGFIERLPDHAQLVLGGKRQGDRGYFHQATIVSGLRQEDEAVQNEIFGPVITAQTFSDESDALRRANGVPYGLASSVWTQNHGTAMRMAKRLDFGCVWINTHLPLVAEMPHGGFKHSGYGKDLSAYGFEDYTRIKHVMSYIGE

SEQ ID NO: 18077 - protein, 384 aa, Xanthomonas campestris pv. campestris str. ATCC 33913
MNDTVIPGFKPKKSVALSGTAAGNTALCTVGRSGNDLHYRGYDILDLATSSEFEEIAYLLVHGKLPNSGELRGYKAKLRSLRGVPAAVKTALEQLPPSAHPMDVMRTGVSVLGCLQPEKDDHNHPGARDIADKLMASLGSMLLYWYHYSHNGKRIEVETDDDSIGGHFLHLLHGFAPKESWVRAMHTSLILYAEHEFNASTFASRVIAGTGSDMYSAIAGGIGALRGPKHGGANEVAFEVQKRYDTPDEAEADIKARVERKEVVIGFGHPVYTVSDPRNKVIKDVARELSDEQGSRKMYDIAERLETVMWDIKKMFPNLDWFSAVSYHMMGVPTAMFTPLFVLARTAGWSAHIIEQRVDGKIIRPSANYTGPEDQAFVPLDQRA

SEQ ID NO: 18078 - protein, 151 aa, Brassica napus
MDQIESVEYNGFEISNGHVDHGWKKVVYPKRNRKQKPADQTATNGGKNAANGDNVFRSLEEQAEDRRRRILAAKMAVSDSDEDESRSKRRSNGYGFDDSEDEIAARKEAEEENVKAAEEAKKKKAKAKKEKKPKVSLPEAAAKIDPSNLEA

SEQ ID NO: 18079 - protein, 369 aa, Zea mays
MKLTVKTLKGTHFEIRVQPNDTIMAVKKNIEEIQGKDSYPWGQQLLIFNGKVLKDESTLEENKVNEDGFLVVMLSKGKTSGSTGTSSSQHSNTPATRQAPPLEAPQQAPQPPVAPITTSQPEGLPAQAPNTHDNAASNLLSGRNVDTIINQLMEMGGGSWDKDKVQRALRAAYNNPERAVEYLYSGIPVTAEIAVPIGGQGANTTDRAPTGEAGLSGIPNTAPLDLFPQQGASNAGSGAGGGPLDFLRNNPQFQAVREMVHTNPQILQPMLVELSKQNPQILRLIEENHDEFLQLLNEPFEGGEGDFLDQPEEDEMPHAISVTPEEQEAIGRLESMGFDRARVIEAFLACDRNEELAANYLLEHAGEED

SEQ ID NO: 18080 - protein, 372 aa, Oryza sativa (indica cultivar-group)
MIDREPAGSSRHGSNMDPSINIPVNRDAITEEVAAAFAESEVIPERYCRPDEVHDGIVVGHDDDEAYELPVVDMEKLLDPELAEAEIAKLGSACQDWGFFQLVNHGVDEQVVNEMKDSTVKFFSLPLESKRTVEIQDNGFEGFGHHYRRASGKLDWAESVILLTQPIQERNPEMWPTNPSSFRDALDKYSAEMTKLAMRIASIMATDLGVDQEALVGAFRDKQQSMAIHHYPPCRHPDKVIGITPHSDGLGLTLLLQLDDTPGLQIRKDGRWLPVRPRPGTFIINVADILEVLTNGAYKSVEHRVLADAEKGRTTIVTFHEAYVDGMVKPIPEVLKLNGAEARYKSIERLEYIKGNFVALSEGTRFLESLKI

SEQ ID NO: 18081 - protein, 526 aa, Bradyrhizobium japonicum USDA 110
MSRPGRRNSASDLPQSSLLKPPATGHCAAAPASSRGQHHMSDKVSRRQFAALAGLSAAAIANPLDGADAKPAAAASRDSGFPEGFLWGTATSSYQVEGAVNEGGRGASIWDRFVRIPGKIEDGSTGDRANEHYHRYKEDIALIKELGCKAYRFSIAWPRVFPDGDGKPNPGGLDFYNRLVDELLKNGIEPWMTLYHWDLPQSLQDRFGGWRSTETCKIFGDYAAYVAERLTDRVKNVFTLNESGRFVQFGYGLGIDAPGVTLPQGEVNQVRHNSALAHGLAVQAVRAHGRRGTRVGPAENIDVCVPAIDTPEHVRAAEIALREMNAGYLNVIMTGSYTEAFLKYAGANAPKYTDAELKIISSPVDFLGLNIYAPQNYVVPSDQGAGFMPLPIPKSFPHMNSDWLRVAPETIYWVPKLAAKIWKTDAIYISENGTSGDDVVTPDGKIYDTDRIMYLRNYLAQLQRATAEGVPVRGYFLWSLMDNFEWVFGLSKRFGLYHVNFDTQVRTPKLSASYYRNVIARNAAGV

SEQ ID NO: 18082 - protein, 642 aa, Coprinopsis cinerea okayama7#130
MTDCFESPDVAAKTYTYSADGRLYAYALPTLVRIFQAEGAQLLQELPLPNIIEMSFSPRGTYLSTWERPVKLEDGAQHKNLRVFSVSTGEELISFSQKSIEGWQIQYTISESHAVRLVSSEIQVYRPSEWSKGIADKLKVEGATNIALSPGLNPSVAVFVAEKKGAPASIKVYGLLSLNAPPTCQKTFFKADRAQMKWNVLGTQVLLLTQTEVDNTNKSYYGETGLYLLSAAGNFDCRVTLDKEGPIHDFAWSPNSKEFGVVYGYMPAKTMLFDHRVRSVHDFGLAPYNFISFNPQGRLIALAGFGNLAGKMDIFDRRTVKKLCTIDAPNTSHCEWSPDGRFILTATLSPRLRVDNGVKIWHCTGPLVHIQATEELYQASWRPTPVEGVPPFPQAIPPAPAPAPSVKAYNESNEGKKSATPAKPAGAYRPPGARGLATPAIFKREDEGGIRLDGTSTPPRYGRGPVPGAPGYGSQSNGYGNGNGQRRVVPGAPPPGSGPSEEKKGGRRKKGKKDGEGQDGGAGTPPAVDVGAANGQQGGGGGKKGKNRAQPGSGNGSAAPTPPAPSTPAALEPQTPVTPGGDGLDAVAKKIRNLNKKLKAIDELKEKQKRGERLEATQLKKIEGEADIRKELAGLNAQAGSS

SEQ ID NO: 18083 - protein, 150 aa, Oryza sativa (japonica cultivar-group)
MAMAMRRVVLVAAVLCAVVAMVTAQEASNVRATYHYYRPAQNNWDLGAPAVSAYCATWDANKPLSWRQKYGWTAFCGPVGPRGQAACGKCLLVTNTATGAQITARIVDQCANGGLDLDWDTVFTKIDTDGQGYQKGHLIVNYKFVDCGDN

SEQ ID NO: 18084 - protein, 398 aa, Zea mays
RQPAVFFIFISLFSVFRELRGKGSYSLAFEKEHHPQPNAQQSGPTSLPIPQSVQAMVAAGRHAPVPPRYLRPDLAADVVVADDATTIPIIDFQRLLLVDPEESARLHAACQDWGFFQLINHGVPDDVMEAMKASIQSFFALPAEAKQQYRQQAGQLEGYGQLFVVSEDQKLDWADVLYLNTQPPEHRNLSFWPAGESFRQTLDTYSAAVKHVADRLLGAMYMNLGLQLSIMDMDPERGAGIQSVRMNYYPPCAEAADKVLGFSPHSDSDLLTLVLQVNQLQGLQIKRPPDGGGAWAWLPVTPLQGAFVVNVGDVLEIFTNGRYRSVEHRALVNAHTERLSIAAFHSPSIHATIGPLPELLGDQEVPKYKTLDHQSFITLFFSAKLQGKSFLERMKKLS

SEQ ID NO: 18085 - protein, 192 aa, Blumeria graminis
MAEIRRKLVIVGDGACGKTCLLIVFSKGTFPEVYVPTVFENYVADVEVDGKHVELALWDTAGQEDYDRLRPLSYPDSHVILICFAVDSPDSLDNVQEKWISEVLHFCCGLPIILVGCKKDLRHEQKTLEELHKTSQKPVTPEQGEEVRKKIGAYKYLECSAKTNEGVREVFEHATRAALLTKKKKEKRCIIL

SEQ ID NO: 18086 - protein, 476 aa, Burkholderia xenovorans LB400
MLHAAQFYIDGGWVEPTSPVWFDIVDPSTETPFEKLALGNAQDVDRAVAAARRAFASWSATSVADRVALLKRIVTIYERRYDEFAELMRREMGAPITFARNGQAARGPAHLNALIDVLERFEFEEQRGSTRIVLEPIGVCGLITPWNWPVNQIVVKIAPALAAGCTMVLKPSEYSPLSALLFADVLDEAGVPAGVFNLVNGDGPGVGSAIASHPDIDMVSFTGSTRAGVLVAQSAAETVKRVAQELGGKSANILLDDVDLDQAVTRGVAACFTNSGQSCSIPTRMLVPRHLMNDAAQIAKRAAQAYRLGPTDDPATQLGPLVNANQFKRVQALIQIGIDEGARLVTGGTGRPDGIDTGYYARPTVFADVTPQMTIAREEIFGPVLSMIPYDSEEQAIDIANGTDYGLAAYVQSADLARARKVGRALRAGGVHLNYPPADFGAPFGGYKRSGNGREWGEAGLREYLETKALAGYGVD

SEQ ID NO: 18087 - protein, 324 aa, Oryza sativa (japonica cultivar-group)
MAKKQSLLLAMMLVVAGLAVSAMADRKLMSLVKPQPNQLTYHNGAVLSGDIPVSILWYGRFTPAQKAVVTDFVLSLAAPLQAAPAPSVSQWWGSIHRLYLSKAVAVGKNGGAHGGGGGGRAKNARVVLSGQVSDEGCSLGKSLKLSQLPTLAARARPGKGGVALVLTAQDVAVEGFCMSRCGTHGPVSRAGAAYAWVGNSATQCPGQCAWPFHQPVYGPQAAPLVPPSGDVGMDGMVINVASMVAGAVTNPFGDGFYQGERGAALEAATACTGVYGKGAYPGYAGALLVDKATGASYNAHGAHGRKYLLPALFDPDTSACSTLV

SEQ ID NO: 18088 - protein, 393 aa, Glycine max
MASSNKIHVVIDNKLYDLTKFGKTHPGGSLILENFHDCDVTDYFYAIHSKQAQKMLKNMPSSDIAEEDKVPQTDYLKLLFQLEKTDLFKADYVVEFVQIFHTIVLFFLATWYGQTYPVFSAICLGFGTLIGGWVGHQCDHQRDNIMRDVNLVYATVCDGLSPHWWSTKHNRHHLSTNETEHDGDIQLFPFIYLWTPKKDQDSWNRAIQHIYFTALYTILQIKWQIDSVQWAISQRNYKEMVGLAIHWAWYIFFLPWQVWTLGVLIAGTISAFVVTASHQAEHKYEGKKEFEGEAANVRRSKYQIHDYFTHQVVTTRNIDLHNWFLNYICGGMQYQIEHHVFPRIPLYKLPLVKGVVQEYCQKHGVEYRDEGFMDIMMRNYYHIETIAKVKAQA

SEQ ID NO: 18089 - protein, 718 aa, Coccidioides immitis RS
MERRHAHGAHTPSSPDGVPSHFDLQRMYWAVLGAFIGAATLANIMNMIIAAQRFSDRTSSPAKPKSFLFRAYATATALIREASQAGLAPLRAWGITVHMPTLGRLSMVLANLAVLMVLCFYKLNTMDEWSWETIGYRTGFMAIAQLPLIILLAGKTNIIGFLTGSGYERLNWLHRWIARTLWLTATVHMAFWFRSWGRYNYIIVKLSTDTLTQRGFAAWCILTYIVIVSAGPVRRLSYEFFVLSHIVTFSGFIAAVWLHSPDEVKAWSWVPIGLLVFDRAVRYVAMAFTNVRLSSSSRGAASTGQRSKWANWATFTPLPGNVTRITIHDAAVSWKPGQHVLLSCHSILPFQSHPFTIASIPSDRKLELLVRAERGGTKKLFDYALKHSKFLGRRNDQPIPQKPKAVVIEGPYGRIRPLRQFDSVVLIASGMGATFTMPLMRDIVEGWKTQYLDPQFAQSKDPLHSNFALTKRIRFIWIVRARAHLAWFIDELHKLKRDLDDCAATSSSFNETRSLEVTIYVTCDEQLSSGGPTSFLPLEWASASQSSFVSQDSVMLEKERVLPAETPLPPETITAPSKATSCLRQSGCCCTRKVTDETISMPPCMCSGAASAHPSLLPVTALEEAKESTAENRCPTSPQSPQSLLGPCITIRSGRPDTRTIIRSILEQAEGESGVVACGPKGLNADVRRSVVSLSDERAVHKGTGAQGIYLHVEEYGF

SEQ ID NO: 18090 - protein, 312 aa, Arabidopsis thaliana; identical to SEQ ID NO: 1014

SEQ ID NO: 18091 - protein, 298 aa, Campylobacter jejuni RM1221
MDKNIIIGAMTALITPFKNGKVDEQSYARLIKRQIENGIDAVVPVGTTGESATLTHEEHRTCIEIAVETCKGTKVKVLAGAGSNATHEAVGLAKFAKEHGADGILSVVPYYNKPTQQGLYEHYKAIAQSVDIPVLLYNVPGRTGCEISTDTIIKLFRDCENIYGVKEASGNIDKCVDLLAHEPRMMLISGEDAINYPILSNGGKGVISVTSNLLPDMISALTHFALDENYKEAKKINDELYNINKILFCESNPIPIKTAMYLAGLIESLEFRLPLCSPSKENFAKIEEVMKKYKIKGF

SEQ ID NO: 18092 - protein, 283 aa, Prochlorococcus marinus subsp. pastoris str. CCMP1986
MKDMPTWIDEYHKGSRFGLNGKVLLKKNSKYQEILIIETDFYGKALMLDGCWMTSVRDEKYYHECLVHPALSSIDKKSHILIIGGGDGGTARECLKYSQVSKIDLVEIDEEVIKVSKTFLKEIGGGAWSDKRLAIHIDDGVKWVETTKDNSYDVIFIDCSDPSEFSNLLFTDSFYKECKRILTKKGILATQSESPESFENIHIHILKSLNKIFKLSETMYSFVPIYPSGIWSWTFASDEELNLSKVNYKEVMEIENNCDVWNLNFQNAAFKMMPNKIVKKLNS

SEQ ID NO: 18093 - protein, 361 aa, Thermococcus kodakarensis KOD1
MEIVIIGNGPGGVELAKELSGEHEVLIFEREEVPFYSKPMLSHYIAGLIEKEKLFIYPLDWYERKGINLKLGEEAKLIDRVRKVLVTDKGEYPYDILVIATGARAREPTVDGKEHLLTLRSIEDAEGIKALLEEHGEAVIIGGGFIGLELAGNLAKAGYGVKLIHRRDTFLGLDEELSSLIREKLEESGVEFHLGAELLKADENGLLTTRGYIEGKVKICAIGITPNVEIARRSGIHTGRGILIDDHFRTSAKDVYAIGDCAEYSGIICGTAKAAAGHAKVLANLLRGKEDRYPFELRSSVFKFGDLPIAIIGKTRGEGEWLDEHTKAFFQDGKLVGAVVIGDIRKAFSIEKELKKELYGA

SEQ ID NO: 18094 - protein, 304 aa, Kluyveromyces lactis NRRL Y-1140
MSASYWDSSQRHKWKYTRESLAKEKQKLWLLECQLFPQGLNVTIHDSKANKQVTTNIPVTQRDLHYDRDYNLRIYCYFLIMKLGRRLNIRQCALVTAHVYLSRFLLRASVREVNLYLLITTCIYLACKVEECPQHIRTLVNEARSLWPEFIPPDVTKVTEFEFYLIEELQSYLIVHHPYRSLEQIEKALSSEKYNYKLSDDELQKIWSLINDSYTTDVHLLYSPHVIAISCLFAVSCIIHKPEDSTKRANINMFIAETQVNLEQVMFILQELISLYDHWDKYNELRIRALLHELYLRQQTPAIQ

SEQ ID NO: 18095 - protein, 748 aa, Escherichia coli CFT073
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARVKYLLRRIDFAEAENLAQRSLEAQLATEVRHQVAAFMERRGMGGLIRGGL

SEQ ID NO: 18096 - protein, 446 aa, Phanerochaete chrysosporium
RSLRFASTGKQQNLKERLAELIPVELEHVKAVRAEHGKKAFGPVVVDQLYGGMRGLPALIWEGSVLDPEEGIRFRGKSIPECQELLPKAPGGNEPLPEALFWLLVTGEVPTQEQVTALSKDWAARAAIPEFVEELLDRCPPTLHPMSQFSLAVTALNHDSNFAKAYQQGISKKDYWGPVFEDCMDLIAKLPNIAGRIFRNVYGKGKLPAIDANKDYSWNLATLLGFGENPAFVELMRLYITIHSDHEGGNVSAHTGKLVGSALSDPFLAFAASLNGLAGPLHGLANQEVLIWLRRMQSKIGENASDEAVREYVWSTLKSGQVVPGYGHAVLRKTDPRYTAQREFALKHLPNDPMFKLVGQIYNIVPGILLEAGKAKNPWPNVDAHSGVLLTHYGLTQMNFYTVLFGVSRAFGVAAQLIWDRALGAPLERPKSYSTGAIEKMFKDKN

SEQ ID NO: 18097 - protein, 332 aa, Idiomarina loihiensis L2TR
MTTYKAIKLVKRPEPGPVSANIFEVTEKELPKAGSGEILIKQRQMSLDPAMFGWMSPDTESYIPPVELNTVMRSSGVGEVVESNHPEFEVGDRVMGMMGWQEYALSDGKGINKVQADVPDETVLSVFALPGLTATQGLLNVGKPKNGETIVVTGAAGSVGSIVGQIAKAEGLKVIGVVGSDEKANWIVNELGFDGAINYKTDDLRDQLTKLTPDGVDLYFENTGGPIQNLVVERMNAHGRVVVCGMIADYDKEVPSPGPSWVPVIKKRLTIQGFTMPDHFDQIPSLLQQLTPYVMSGKIKHRSHILEGLESAIEGLNMFFTGDNKGKLIVKL

SEQ ID NO: 18098 - protein, 281 aa, Xanthobacter autotrophicus Py2
MKHRRPTEEPDNGPRAGERNDPETHPMDFRVSLDGRSALVTGASGGLGAFFAERLAAAGARVAVAARRRDACADLCARIEATGGTALPIALDVSDEASAAAAVAEVAAAFGGLDILVNNAGVTGTTPLLDETAEAWDRILDTNLKGGFLVGREAARAMAKTGRGGRIVNVASILGLRIAGQVAAYAASKAALVQLTRSMALEWARYSIQANALCPGYVETDLNRDFFASPAGEALIKRIPSRRLGRLEDLEGPLLFLCSDAARYVTGTTLVVDGGHLVSSL

SEQ ID NO: 18099 - protein, 232 aa, Cryptococcus neoformans var. neoformans B-3501A
MSCADDLTTDDLTGSVTTEVLERASAGEGATTNLWSHIDRDNVTGLNLENPSSAPSVIKTWDDRLDQEQYVESGVDDDLIIHIPFVTSVRLRTLCILPPAPDHPHRSTRLRLYANQPHCPDFGDLELMTPIMDIDTSQPPAGIRRLPDGRRDVEEWPLKVQKLANVFSVTLLFTEASTSQRSQVYFIGLKGVPPKHTMDMSKLGTVPTEKSADQSVDGVAQKQTNHNTTTTR

SEQ ID NO: 18100 - protein, 199 aa, delta proteobacterium MLMS-1
MATELNCHRVHFVDSVFDLAKLPAGELPEIAFAGRSNVGKSSLINCLLGRKNLVKVSAKPGKTRSLNFYLVDERLHLVDLPGYGYAKVDKRMQEQWRQLVGGYLEKRDNLRCVVVIIDLRHELKELDRLLAQWLRDIGVAFLLVYTKMDKLSRNQQQRQARLLDGGLGISPEQRLLFSAKSGEGRPELLAKLAAFVDQP

SEQ ID NO: 18101 - protein, 245 aa, Triticum aestivum
  misc_feature (73)..(74): Xaa can be any naturally occurring amino acid
  misc_feature (76)..(76): Xaa can be any naturally occurring amino acid
  misc_feature (78)..(78): Xaa can be any naturally occurring amino acid
  unsure (1)..(245): unsure at all Xaa locations
IEQVCTKKQAGTGPEFPGYRRPTRPGGAKGGIGCSPGDLSISELERLTRVFTQKIHDLIGIHTDVPAPDMGTXXAXQXGIWILDEYSKFHGYSPAVVTGKPVDLGGSLGRDAATGKGVLFATEALLAEHGKGIAGQRFVIQGFGNVGSWAAQLITEAGGKVIAISDVTGAVKNSNGIDIAKLMKHSAENRGIKGFDGGDAVDPTSLLTEECDVLIPAALGGVINKDNADAHQAKYIIEAANHPTD

SEQ ID NO: 18102 - protein, 114 aa, Pseudoalteromonas tunicata D2
METIDKIKQQISENSILLYMKGSPKLPNCGFSSQASQALMSCGEPFAYVDILLNPDIRAELPHYANWPTFPQLWIEGELIGGCDIIIEMFQRGELQPLIAEAAARNKPAEEAAE

SEQ ID NO: 18103 - protein, 520 aa, Arabidopsis thaliana
MDFFHSREKRHGKRAGLFGHKSASKSNPSSPPHLAEGRSQPTTHFGMKRSESEYAFPISDEQTTHWKPQQQASERIPNSHQRPPVYRYSTPERPREPDEDVTPRSNGSGSPFRSARTRTPDRRKRSSEITKELYERMYEADANVSPFHPFRSRSPAPYNTHERGRDYSRERYEAEGNVTSRNRPSSPFHPSQSRSPPPHARTQRYNNGKDHFEGMYEADADITPRNSPPMSPVHQHTSYSPPPPFYSSSDDEDDNNSTYLFPEIATGRRSRGVSGSSTPVHYKYQITSVETYEQERQFEPPELPDESQSFTMQEIARMRGLQSYGKEEIQLAISETYVSVANYKVRMSIAATLEAIIDKHGDIAASSKLQSTSTRSFYLESLAAAVMELKSTALRDLTKTRVAEIAAVVKDMDSVKIDVSWLKTAVTELAEAVEYYGKYDTAKIVREECDREMTAGKKEMEEMREELRRREKETKECRERVTELAGRLGQLEMKDVRVKKNLELYESKVLKFDGHSVLVD

SEQ ID NO: 18104 - protein, 113 aa, Synechococcus sp. RS9917
MAEDTIFARILRGEIPCDEVYGDDHCLAFRDIAPQAPVHVLVIPRQPIESLREATESDAALLGHLLLVAAKVAKQEGLEDWRTVINSGAEAGQTVFHLHVHVIGGRPLAWPPG

SEQ ID NO: 18105 - protein, 118 aa, Oryza sativa (japonica cultivar-group)
MASLSMATTLPSLAGAAPAARKRSGVTYVEGMNAYSGLKALNKVTLLGVRKTADYSFAKVVAKLSPAGGKSRGGAFGAQCNAAGEIFRIAVIMNGLVLVGVAVGFVLLRVEAAVEESE

SEQ ID NO: 18106 - protein, 393 aa, Agrobacterium tumefaciens str. C58
MGRAAVPSGASTGAHEAVELRDGGKRYLGKGVEKAVEAVNTEIFDAIGGFDAENQIQIDQMMIALDGTPNKSRLGANAILGVSLAIAKAAAEASGLPLYRYVGGPNAHLLPVPMMNIINGGAHADNPIDFQEFMILPVGAENIREAVRMGSEVFHTLKKELSAQGHNTNVGDEGGFAPGLESAPAALDFIMKSIEKAGYRPGEDMYVGLDCASTEFFKDGKYVLEGEGRTLEPGAMAEYLAELVNKYPIISVEDGMAEDDWEGWKTLTDLVGNKCQLVGDDLFVTNSARLRDGIKMGVANSILVKVNQIGSLSETLDAVETAHKAGYTAVMSHRSGETEDSTIADLAVATNCGQIKTGSLARSDRLAKYNQLIRIEEMLGPQAAYAGRSILRG

SEQ ID NO: 18107 - protein, 344 aa, Glycine max
VLNLTTVFFFSNNTNNNKNNDDDADISPLLAKADDPKMAEDPGVLEVVKQLDKACTEAGFFYVKGHGFPETLLKEVRDVTRRFFELSYEEKAKIKMTPAAGFRGYQRLGENITKGVPDMHEAIDCYREVTKDMYGDLGKVMEGSNQWPQNPPTFKVLMEEYVSLCRDLARKIMRGIALALGGSPNEFEGQRAGDPFWVMRLIGYPGVSSVNGTNVHKNDIGCGAHTDYGLLTLLNQDDDVNALQVRNLSGEWITAPPVPGTFVCNIGDMLKIYSNGLYESTLHRVINNNSKYRVSVVYFYETNFDTAVEPLDTHKTRANGNKEFKRAVYGEHLTGKVLTNFVDL

SEQ ID NO: 18108 - protein, 770 aa, Methanopyrus kandleri AV19
MKYVRWFEEISKDDVDVAGGKGANLGEMTQAGLPVPPGFVVLSTAYDEFLERTGLKEKIKEILSSHDLSDNDELQEAAEEIQRLIVEVEMPEEIREEIVKAYRELCEKVGKEEEFVAVRSSATAEDLPEASFAGQQETFLNVQGEEDVVKYVQKCWASLFTPRAVAYREEQGFEHLDVSIAVVVQKMVDSEKSGVMFTVHPYTGERDKMVIEAVWGLGEAVVSGEVTPDTYIVDKNTFEVIEEQISEQEWMYTKDPETGETVKAEVPEDKRDARKLTDEEIKELAEIGVAVEEHYGFPQDIEWAIEDDEVYVLQSRPVTTIPEEKGGEEEIEAEELEGKILVRGLGASPGIGTGEVKIVMDVDEIDKVEEGDVLVTKMTTPDMVPAMRKASAIVTDEGGITCHAAIVSRELGIPCVVGTGNATEVLEEGQVVTVDGERGVVYEGDVRKALRAEEEEEEREEKEIVVERPAAEPVTATEIKVNVSMPEAAERAAKTGADGVGLLRIEHMILGVGVHPRKLIEEGEREKLVQVLMDGIRKVADAFYPKPVWVRTLDAPTDEFRELEGGEREPEETNPMLGWRGIRRDLEERETLECQFEAIRRLHQEGYDNIGVMIPLVQHPEELRRAKRIAKEVGLKPHRQVEFGMMVETPAAAVLIDEFIEVGLDFVSLGTNDLTQYTLAVDRNNDKVAYLYDEKHPAVLRLIKHVINECKEAGVKTSICGQAGSDPKMAEILVKAGIDSISANIDAVPQIRRIVARVERKILLDKMREF

SEQ ID NO: 18109 - protein, 337 aa, Phanerochaete chrysosporium
MPVKAGINGFGRIGRIVLRNALLHGDIDVVAVNDPFIDLEYMVYMFKYDSVHGRFKGSVEAKDGKLYVEGKPIHVFAEKDPANIPWGSVGAEYIVESTGVFTTTEKASAHLKGGAKKVIISAPSADAPMFVCGVNLDAYDSKYKVISNASCTTNCLAPLAKVIHDKFGIVEGLMTTVHATTATQKTVDGPSNKDWRGGRSVGNNIIPSSTGAAKAVGKVIPSLNGKLTGLAFRVPTVDVSVVDLVVRLEKPASYDEIKQAIKEASETTHKGILGYTEEKVVSTDFTGNDNSSIFDADAGIALNKNFVKLISWYDNEWGYSRRVCDLLAYAAKVDGAL

SEQ ID NO: 18110 - protein, 203 aa, Aspergillus oryzae
MASEMQNSNPTILNAADLPKRLRPAPSRKPGIFGNGLFASALPFVYASKLPPEGFTSSSESESDDDDLLEEPIDEQEIYDLVSTISDPEHPISLGALAVVSLPDISITPTLPYVPASPLRTVTVLITPTITHCSLATVIGLGVRVRLEQSLPPRFRVDVRIKEGTHSTADEVNKQLADKERVAAALENGTLMGVIAKMLETCQ

SEQ ID NO: 18111 - protein, 997 aa, Arabidopsis thaliana
MMKFKFQYEEEYIKNSRDVELFACRWLPSSSPRALVFLCHGYGMECSSFMRECGIRLASAGYAVFGMDYEGHGRSKGARCYIKKFSNIVNDCFDYYTSISAQEEYKEKGRFLYGESMGGAVALLLHKKDPSFWNGALLVAPMCKISEKVKPHPVVINLLTRVEDIIPKWKIVPTKDVIDAAFKDPVKREEIRNNKLIYQDKPRLKTALEMLRTSMDLEDTLHEITLPFFVLHGEADIVTDPEISKALFEKASTRDKTIKLYPGMWHGLTSGEPDANVDLVFADIVNWLDARTGDSASLTVTPVHDFTSNVQKVVDGVSNGQGKSKRPQASLLCGLNGGGRRLIRFPKSNHHRVQTKIHRLLVERMYTPGAAKPEYARAKIAVWWDMKDCPIPEGYDARLVRPSIEAAFNELGYSGPISITGYGDQRETPCQILRGLSSTGVAVAQIIPESRCSLMYSSMLEWRDLNPPPATMMLVSDQWQHVFAWDLSRLQQHTKYNLFLAYSTEPFAGSALRPCGEWIWRNLLETKREFVQDKCSSSCEVSPMFYCKSCSYQGQSVEGFRRHVSSGKHAVKEVTNRIHPELDYLTRTWAKNYTAKPEYATAPIVVWWDMKDCPIPEGYDARQVRPSLEGAFKKLGYSGPVSITGCGDHNKTPDHILRELSSTGVDLAHSIDEVIYSRMFINMKQWKARNPPPATIMLISDGVVMMFENLIADLLQETKYNLFLAYSYRPYKMSVLLTSAEWLWKSLLVAETRNHVLRKCSQSQRGEPSTKMFSCMLCLCDCKSLEDLRTHLSSEDHAVCTQVLEDFRKSKRMRKAYRTDRPQFSPLKPPLSLFTLDFSSTPHHSSSCERDLFGKRKRDLAYSSFHRFAEFHRASSEHEIFSNTFFFLDFSKPMEEDTNGKTEEEEFNTGPLSVLMMSVKNNTQVLINCRNNRKLLGRVRAFDRHCNMVLENVREMWTEVPKTGKGKKKALPVNRDRFISKMFLRGDSVIIVLRNPK

SEQ ID NO: 18112 - protein, 369 aa, Kluyveromyces lactis NRRL Y-1140
MMRTRFIQLSRRAYASNAKNLTIGLIPGDGIGKEVIPAGKKILESLNPKYGLSFKFIDLQAGWETFQNTGKALPDETIDILKNQCEGALFGAVQSPTTKVEGYSSPIVALRKNLGLFANVRPVKSVDGTKDRKVDLVIVRENTEDLYIKLEKSYIDEATGTRVADATKRITEIATKNIATIALQIAQQRLEQNGHATLTVTHKSNVLSQSDGLFREVCRETYEANKDKYGGVQYNEQIVDSMVYRMFREPECFDVVVAPNLYGDILSDGAAALVGSLGVVPSANVGPNIVIGEPCHGSAPDIAGKGISNPIATIRSTALMLEFLGYPEPAKDIHKAVDANIREGKYLTPDLGGNSTTQQVLEDVLSKLD

SEQ ID NO: 18113 - protein, 408 aa, Blastopirellula marina DSM 3645
MSTTQDRSNVGQLSSADTAELFKQYVVPNYGRYPVSLVRGEGSRVWDAEGKEYLDFFPGWGCNLLGHCPDTIVAAVQEQIATLIHVPNSWLIEAQGQWAKLLSERSFGGQAFFCNSGTEANEAAIKLARLHTPPQRYKIITFQGGFHGRTFGATSATAQPKYHEGIGPLLAGFSYAPFGDLEAVAQLIDDQTAAIMVEPIQGEGGVRIPPEGFLAGLRKLADEHELLLIFDEVQTGCGRTGHWFGYQHFDVTPDILTLAKSLCGGVAGGALLTTKEIAPSLRPGMHAATFGGNPIAARAGIAAIEMIERDNLLENVAVLSEIFRERMTALQAECDLIQEVRVIGMMIGVELAIEGAPAVKACLEKGLLINCTQGNVIRLLPAMNLTPEEVHQGCDILVDVIKNMAPAS

SEQ ID NO: 18114 - protein, 491 aa, Kluyveromyces lactis NRRL Y-1140
MEFYRDATWVLEFVEQELSKDKRVAGSLQTLVLTSCKRYKLKTNPRHIYAIVSSTWQYREYLDKIIKKSGILEDVPKKKGKPLFNKDTIRLLVHDLLLSKSKRIQMGKHPIKTFILKHQTRLKAELTKLKVKLKVTSLSQLIKTDDGEDVTPVRWIRINPILVKERYDDVLAELNKKFPQRVNSWKQIVPGSIYYDEYIPNLFGIHPGDKITSHEQYKRGKIIIQDRASCFPAHILNPNSTDVVIDACAAPGNKTTHVAAHIFGDVDTKVDSVKIHAFEKDPERAKTLQMMVATAGCAKGVKIHVGDFTKLGKPELFQNVTGFIVDPSCSGSGIFGRKAIDKVNLSKTGSSNTDEDQTSVEPVEQEKELFEKEQDLKNRLAKLSSFQYQIVKHAMSFPSAKKICYSTCSIHAEENERVVIDLLLDSKVKEWGWKVRKRTGVIPTWPRRGWTSEFEEVFPKEEAKELAEGCIRALPKEDGGIGFFAVCFERD

SEQ ID NO: 18115 - protein, 506 aa, Idiomarina loihiensis L2TR
MTDTDGSRFSNCLYRVEQVQQGEQKAAEACSMNMTQLMSAAGKAVFHQLQSYFPAPARIAVCCGEGNNGGDGYIVARLAQKAGYQVQVFALKPNVELPEPMESDAHKARAAWREQGGSEKPLLDCSPEQFDVLVDALFGVGLNRALEGDPVSWVQRVNGSTTPVVSVDVPSGLNADTGHVPGAAVRAHLTVCLVALKRGLLTGKAQEHTGELKLEDLGIGSTFKQQNEANWFRVNAGRVGGWLAPRSRCTHKGEQGHVLIVGGQPGMSGAVILAMQSALRAGAGKVSAACHPQVQAIVAAAQPEAMVHGIKETDSLEPLLREASAVALGPGLGQGSWSQEIFSQVMETDVLKVIDADGLNLLASNPVRSPKLLLTPHPGEAARLLQMTTDEIASDRFAAATKLREKYGAQVLLKGAGSLLVTDRGRCLIDRGSPAMASGGMGDLLTGLIAGLLAQRMAPAQALIAGSLWHAIAGEEAGKDGERGTLASDLLPHIRQLVNGYGRDDG

SEQ ID NO: 18116 - protein, 405 aa, Agrobacterium tumefaciens str. C58
MEAVDEGTVAKLVVPAGTEAVKVNALIAILAAEGEDVAEAAKGGDAVPAKAEAPKPEAAKAEAPKEEAAPVKAEKPVADQAAASSTPAPVAKSGERIFASPLARRLAKEAGLDLSAVSGSGPHGRIVKTDVEKAAASGGAKAAPAAAASAGAPAPALAKGQSDEAVLKLFEQGSYELVPHDGMRKVIAKRLVESKQTVPHFYVSVDCELDTLLALRAQLNAAAPEKDGKPVYKLSVNDMVIKALALALRDVPDANVSWTESAMVKHKHADVGVAVSIPGGLITPIIRKAEEKSLSTISNEMKDYGKRAKERKLKPEEYQGGTTAVSNMGMMGVKSFSAVINPPHATILAVGAGEQRAVVKNGEIKIANVMTVTLSTDHRCVDGALGAELIGAFKRYIENPMGMLV

SEQ ID NO: 18117 - protein, 636 aa, Sorghum bicolor
MISARAATVAAASPASPWKRGGGRSEGAGSCDGCSTYRKTVRRRAAAAKVRALPPKRVEAVAIGSAAETETEEVVVEVAAANEELPVMPWATSVASGYTLLRDPRHNKGLAFTEKERDAHYLRGLLPPAVVSQELQIKKFMNNLRQYQLPIQCYMAMMNLQETDERLFYKLLIENVVELLPYVYTPTVGEACQKYGSIFGRPQGLYVSLKDKGRVLEVLRNWPHRNVQVICVTDGERILGLGDLGCQGMGIPVGKLALYTALGGVDPSACLPITIDVGTNNEKLLNDEFYIGLRQKRARGEEYDELMEEFMAAVKTFYGEKVLIQFEDFANHNAFDLLEKYSKTHLVFNDDIQGTASVVLAGLLAALKMVGGTLAEQTYLFLGAGEAGTGIAELIALEMSKQTKAPIEECRKKVWLVDSKGLIVDSRKSSLAPFKKPWAHEHEPLTTLYDAVQSIKPTVLIGTSGVGRTFTKEIVEAMASINERPIIFSLSNPTSHSECTAEQAYTWTQGRAVFASGSPFAPVEYDGKTFVPGQSNNAYIFPGLGLGLVISGAVRVHEDMLLAASAALADQATEENFVTGSIFPPFTNIRKISAYIAAAVAAKAYELGLATRLPPPKDLVAYAESCMYSPVYRNYQ

SEQ ID NO: 18118 - protein, 428 aa, Chlamydophila caviae GPIC
MISLLKMPKLSPTMEVGTIVKWHKSNGDKIEFGDVLIEISTDKAVLEHTASEEGWFRECLIKEGTKVQIGTPIAVISSEKDESFNLEELLPKSPISQPSIENVEQGDVAASDVSHQNASMMVAFGFRPEPPLSEPLSLKQDSSKVPVSPLAKRLAKEKNLDISGIKGSGPGGRIVEKDLEKAPAKGIAGFGYPEAPEVHPGAYHEEALSPVREIIAQRLQAAKTFVPHFYVRQKVYTSPLLALLKELQAQGIKLSINDCIVRACALALKEFPEVNSGFNSIDNKIVRFETIDISIAVAIPDGVITPIVRCADRKNVGMISAEIKSLASKARSQSLKEEEYKGGSFCVSNLGMTGITEFTAIINPPQAAILAVGSVQEEPVVMNGEIVAGSTCILTLSIDHRVIDGYPAAMFMKRLQKILEAPSVLLLN

SEQ ID NO: 18119 - protein, 328 aa, Chlamydophila caviae GPIC
MPKHVTLEIREAIREAIDEEMARDPNVCILGEEVAEYNGAYKVTKGLLDKWSSSRVIDTPISEAAFAGIGVGAALTGLRPIIEFMSWNFSLVAADQIISHAAKMHYMTGGKFSVPIVFRGPNGAAAQVSCQHSHCVEALYANIPGLIVISPSNPYDAKGLLKSAIRNDNPVLFLENELEYSLKGEVPVEEYLVPIGKSRVIEEGKDLTIITYGRMVSVVKEAVKIAKQRYGLSIEILDLRTIKPLDISGIFSSVKKTGNCIVVEEGHYFAGISAEIITRITEHVFDYLDSPPLRVCQKETPMPYNKTLEQATLPNVNRILDTIEKIMR

SEQ ID NO: 18120 - protein, 341 aa, Chlamydophila caviae GPIC
MPNSSHYNIASKESDEATIKNIVDIYGVSRCLEFIKNMLLIREFETRGEEAYLEGLVGGFYHSYSGQEAVATATLANTGLDQWFFSSYRCHALAILLNIPLRSLAAELLGRETGCALGRGGSMHMCGPNFPGGFGIVGGQIPLAAGAAFAMKYRGEDKIALGFIGDGAVAQGVFHETLNFASLHSLPLMLVIENNGWGMGTALNRAIAKQPIGESQGSSYNIRSFTLNGFDLFNCLLGFKEAYEYMQKTRLPVIVECLCSRFRGHSISDPNLYRSKEEMQCLIKKDPIIFAKNWLIQLGVLSEEKFQELRQECRSEVLKAFTEAKSDPEPAIATLEEGVYA

SEQ ID NO: 18121 - protein, 181 aa, Pseudoalteromonas tunicata D2
MTQSTLDYIKASIATVPNYPKAGIMFRDVTSLIADPVAFKAVIDAFVAAYQAQGFDKIIGTESRGFIFGAPLAIALGIPFIPVRKPGKLPREVISQAYQLEYGEDVLEIHTDAISQGDKVLLVDDLLATGGTIEATIKLVERLGGHASDAAFVVSLPELGGEQRLEKLGINILKLVEFEGE

SEQ ID NO: 18122 - protein, 404 aa, Cryptococcus neoformans var. neoformans B-3501A
MNSTPTPTPQPDTDNPHSNDANHADDRRPLAAHIPDYAGKSPFPAPPSRFTPRTPLQFLSNSPTNTDASAISCPSYILPTLPSSAASLPSLDPPSSNDRLAMINRIKSLGSYTNSPATVKIPLPTPSPSVSLSLSSRGPATPSSSIIRNKPHMPSPLNKLDYLYDIPPSPPISADADPGQLLVMPRMPNPDVESPIASPFVNLNLQTSTSSNRKPGVGVVIFDSPPRRRISGNSHGPRRGSALANEWGHTLLARHSGADASLLRSLLTQHASPSAPLSTSSAQPQAPAAAQRPRTEAEIVARCHELMNKHKVVLFMKGNPTAPKCGFSRQTVGLLREQGVEFAWFDIFSDEDVRQGLKKVNDWPTFPQIIVNGELVGGLDILREMIENGEWQELMDSIEEGKAE

SEQ ID NO: 18123 - protein, 486 aa, Oryza sativa (japonica cultivar-group)
MAELPLAAGLLDLRPCKLAPPPPPPLPVSPSPRHHRRPHSTATACRAAPDLHSSTELADGSIVFRFARPRDDDDEEQQQRRADAVAPEAAAVVESGLDGDAAAAAEPEARDGGGEGEVTATATGLDAEEVVASGGAEATATSGLEDAGEEASDGSTARDSDTDVDTESSASTAADDDQPAEFAVPPPPAEEVCNKVDWEKDTSEVKNTDRMVPVASSTLVLASGAAILPHPSKLIIASTFYILFFGTPFDNTITAATGGEDAYFIACDGWFGVADGVGQWSFEGINAGLYARELMDGCKKFIMENQGAADIKPEQVLSKAADEAHSPGSSTVLVAHFDGQFLNASNIGDSGFLVIRNGEVYQKSKPMVYGFNFPLQIEKGDNPLKLVQNYTIELEDGDVIVTASDGLFDNVYEQEVATMVSKSLQADLKPTEIAEHLAAKAQEVGRSAAGSTPFSDAALAVGYLGFSGGKLDDIAVVVSIVRKSEI

SEQ ID NO: 18124 - protein, 362 aa, Corynebacterium glutamicum ATCC 13032
MTLTDNSKNVDAVILVGGKGTRLRPLTVNTPKPMLPTAGHPFLTHLLARIKAAGITHVVLGTSFKAEVFEEYFGDGSEMGLEIEYVVEDQPLGTGGGIRNVYDKLRHDTAIVFNGDVLSGADLNSILDTHREKDADLTMHLVRVANPRAFGCVPTDEDGRVSEFLEKTEDPPTDQINAGCYVFKKELIEQIPAGRAVSVERETFPQLLEEGKRVFGHVDASYWRDMGTPSDFVRGSADLVRGIAYSPLLEGKTGESLVDASAGVRDGVLLLGGTVVGRGTEIGAGCRVDNTVIFDGVTIEPGAVIENSIISSGARIGANAHISGCIIGEGAQVGARCELNAGMRVFPGVVIPDSGIRFSSDQ

SEQ ID NO: 18125 - protein, 464 aa, Roseovarius nubinhibens ISM
MNMITNHMPTAELQALDAAHHMHPFTSGTELAAKGARVITRASGVTLTDSEGNEMLDAMAGLWCVNLGYGRDELAEAAARQMKELPYYNTFFQTTHVPAIALSSKLAELTPHDLNNVFFAGSGSEANDTNIRLVRTYWAEKGQPEKKIIISRKNAYHGSSVGSASLGGMQPMHAHGGLPIEDIHHIDEPNWYAQGGDMSPAEFGLERARQLEAAIEEYGAHRVAAFIGEPIQGAGGVIIPPETYWPEIQRICDKHNILLIADEVITGFGRTGKWFGCETLGIRPHIMTIAKGLSSGYAPIGGSLLCDEVAQVMNDCDFAHGYTYSGHPVACAVALENLRILQEEKIVDRAGSEVAPYLKEKWDTLNDHPLVGETALCGLMGSLALSPDPSSRAMFAADKGTAGLICREHCFANGLVMRHVGDRMVISPPLVITHAEIDTLVERARKALDLTHAELKDKGLMVAA

SEQ ID NO: 18126 - protein, 138 aa, Glycine max
  misc_feature (44)..(47): Xaa can be any naturally occurring amino acid
  misc_feature (52)..(53): Xaa can be any naturally occurring amino acid
  misc_feature (61)..(61): Xaa can be any naturally occurring amino acid
  misc_feature (68)..(68): Xaa can be any naturally occurring amino acid
  misc_feature (70)..(70): Xaa can be any naturally occurring amino acid
  misc_feature (72)..(72): Xaa can be any naturally occurring amino acid
  misc_feature (74)..(75): Xaa can be any naturally occurring amino acid
  misc_feature (79)..(79): Xaa can be any naturally occurring amino acid
  misc_feature (83)..(83): Xaa can be any naturally occurring amino acid
  misc_feature (89)..(89): Xaa can be any naturally occurring amino acid
  misc_feature (93)..(94): Xaa can be any naturally occurring amino acid
  misc_feature (96)..(97): Xaa can be any naturally occurring amino acid
  misc_feature (108)..(108): Xaa can be any naturally occurring amino acid
  misc_feature (110)..(110): Xaa can be any naturally occurring amino acid
  misc_feature (112)..(112): Xaa can be any naturally occurring amino acid
  misc_feature (116)..(116): Xaa can be any naturally occurring amino acid
  misc_feature (118)..(118): Xaa can be any naturally occurring amino acid
  misc_feature (120)..(120): Xaa can be any naturally occurring amino acid
  misc_feature (124)..(127): Xaa can be any naturally occurring amino acid
  misc_feature (131)..(134): Xaa can be any naturally occurring amino acid
  unsure (1)..(138): unsure at all Xaa locations
GPKPPKRKKGSPRGAGGGDRGPPGWRKRHEARPVSVRRPGAQGXXXXMSDPXXIKDSKRAXTRGGGGXAXIXHXXEAQXLEAXGIDYGXESEXXTXXGDAHHSSQHNXRXPXGGGXRXLXEALXXXXEGAXXXXPARP

SEQ ID NO: 18127 - protein, 420 aa, Escherichia coli CFT073
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVLEFGQDLQAISAGGGLSIPYQQGEEAVDTEHYYGLWNAAREQIARHLGHPVKLEIEPGRFLVAQAGVLITQVRSVKQMGSRHFVLVDAGFNDLMRPAMYGSYHHISALAAEGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 18128 - protein, 515 aa, Escherichia coli CFT073
MEYPSHNDMSQQFNPYLCYFRPDTCVSCSRIFSLCLTLCWQEKMVTINTESALTPRPLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 18129 - protein, 636 aa, Corynebacterium diphtheriae NCTC 13129
MTRPEFRNVAIVAHVDHGKTTLVDAMLRQSGAFDEHAELVDRVMDSGDLEKEKGITILAKNTAVRRRGAGKDGNDVVINVIDTPGHADFGGEVERALSMVDGVVLLVDASEGPLPQTRFVLGKALAAKMPVVILVNKTDRPDARIDEVVEESQDLLLELASALDDPEAAEAAEQLLDLPVLYASGREGKASTVNPGNGNVPDAEDLQALFDVIYEVMPEPTVNVDGPLQAHVTNLDSSSFLGRIGLIRVHSGSLKKGQQVAWIHYDEEGNQHTKTAKIAELLRTVGVTRVPADEVVAGDIAAISGIDSIMIGDTLADLEHPVALPRITVDEPAISMTIGVNTSPLAGRGGGDKLTARVVKARLEQELIGNVSLRVLPTERPDAWEVQGRGEMALSVLVETMRREGFELTVGKPQVVTQTVDGKLFEPYEHMVIDIPSEYQGNVTQLMAARKGQMLSMDNISDEWVRMEYKVPARGLISFRTMFMTETRGTGIANSYSEGLDEWAGEIKGRATGSLVADRSGQITAYALQQLADRGNFFVEPGTEAYEGMVVGANNRDEDMDVNITREKKLTNMRSATADATVTLAKARSLSLDEAMEFCGQDECVEVTPDVLRVRKVILNATERGRARAREKARNK

SEQ ID NO: 18130 - protein, 285 aa, Prochlorococcus marinus subsp. pastoris str. CCMP1986
MITSKTSFLALIGNPVSHSLSPIMQNAAIQYLGLDLIYMAIPCKNEDLEIVVNSIKKMNCKGLNITIPFKQKVFDMCSEISPVAKKVKAINTLKLNDNKNWIGTNTDIDGFIYPLKNLNLIKKSSLILGSGGAARSVIQGLIELKLSKITIISRKRNSLNELITNFKNDIEIKGLLSTNNEIKNLIQETDLIINTTPVGMSNTTNTDELPFGQGFWDSINSKTIVYDLIYNPSPTPFLKFCDKKGCMTIDGTQMLIAQGAKSLSFWTNGLEVPYEVMHDALKEYL

SEQ ID NO: 18131 - protein, 628 aa, Campylobacter jejuni RM1221
MRYITTPIYYVNDVPHLGHAYTTIIADTLARFYRLQGHETRFLTGTDEHGQKIEEAAKLRNSTPQEYADKISFEFKKLWDEFEITYDIYARTTDTRHIEFVKAMFLKMWQKGDIYKDEYEGHYCISCESFFTQSQLINDCSCPDCGKQTRILKEESYFFKLSKYQDKILQWYEEKDPILPKNKKNELINFVQNGLKDLSITRTSFDWGIKLPQEINDDKHIVYVWLDALFIYVSSLDFQSKGENTKFWPAHVHLVGKDILRFHAIYWPAFLMSVDLPLPKFIGAHGWWTKEGEKMSKSKGNVVKPKEVVDAYGSEAFRYFLLREVPFGNDGDFSENMLINRINAELSNEFGNLLNRIIGMSTKYSQGNISKEGVLKFYNAELNQAKEHLNLAVEFLENLQCNRYLEELFKALSVANLAISKYEPWNLIKENKHEQANALVALCANILAKTSLLLSPTLPKSCQKVALALNFEISSTNYAKMILDNKLLDFKANPCEALFPKVEKALLKQEIKEEPKKEESPKIKIDDFAKIEIKVAKVLDCQNIKGSEKLLKFQLELDDKEIRQVLSGIAKHYKASDLIGKQVCIISNLKKAKIFGHESDGMILSAKSGDKLVLITPEQLVQNGSLVG

SEQ ID NO: 18132 - protein, 143 aa, Xanthobacter autotrophicus Py2
MTVSVILSRKGNDICTIGPDATVGDAVARLAGRRIGAIVVVDDAMSVEGIISERDVVRLIGEQGVNVLAEPLSSVMTRAVVTCTPDETVPVIMERMTRGRFRHVPVVSGDKLVGIISIGDVVKFRVEEMERESAQLRDYIMSA

SEQ ID NO: 18133 - protein, 274 aa, Zea mays
MKMAAENGSQSNLKRIKPPDFAVLLHYQSMRVAATRAAAAAHPPSAFLLLLVLLCCASLAIGGAAMAGHVLGGVKENPAAANSAESDGLGRFAVDEHNRRENALLEFVRVVEAKEQVVAGTMHHLTLEAVEAGRKKLYEAKVWVKPWLDFKELQEFSHKGDATAFTNADLGAKEGGHEPGWREVPVEDPVVKDAAHHAVKSIQERSNSLFPYELLEILRAHAQVVEDFAKFDILMKLKRGSKEEKIKAEVHKSLEGAFVLNQHQPAEHAESSSQ

SEQ ID NO: 18134 - protein, 300 aa, Bartonella sp. af156up
PIDQLAEKGDFLESCYLLLYGELPTQQEKNEFDRCIMQHTMVHEQFARFFHGFRRDSHPMAVMVACLGAMSAFYHDSIDITDPHQRMIASVRLISKVPTLAAMAYKYSIGQAFVYPRNDLSYAANFLRMCFAVPCEEYKTNPVLARAMDQIFILHADHEQNASTSTVRLAGSSGANPFACIAAGVACLWGPAHGGANEACLKMLQEIGSIERIPEFIARAKDKNDPFRLMGFGHRVYKNYDPRAKIMQKTCHEVLKELNIQDDPLLDIAIELEKIALSDEYFIEKKLYPNVDFYSGITLK

SEQ ID NO: 18135 - protein, 300 aa, Bartonella sp. sa192up
PIDQLAEKGDFLEICYLLLYGELPTKQEKNDFDNCIMQHTMVHEQLARFFHGFRRDSHPMAVMVACLGAMSAFYHDSIDITDSQQRMIASVRLISKVPTLAAMAYKYSIGQAFVYPRNDLSYAANFLRMCFCVPCEEYKINPVLTRAMDRIFILHADHEQNASTSTVRLAGSSGANPFACIAAGVACLWGPAHGGANEACLKMLQEIGSVERIPEFIARAKDKNDPFRLMGFGHRVYKNYDPRAKIMQKTCHEVLKELNIQDDPLLDIAIELEKIALSDEYFVEKKLYPNVDFYSGITLK

SEQ ID NO: 18136 - protein, 300 aa, Bartonella sp. af82up
SIDQLAEKGDFLESCYLLLYGELPTKQEKIDFDQRIMQHTMVHEQFARFFHGFRRDSHPMAVMVACLGAMSAFYHDSIDITDSQQRMIASIRLISKVPTLAAMAYKYSIGQPFVYPRNDLSYAANFLHMCFSVPCEEYKINPVLARAMDRIFTLHADHEQNASTSTVRLAGSSGANPFACIAAGVACLWGPAHGGANETCLKMLQEIGAVQKIPEFIARAKNKNDRFRLMGFGHRVYKNYDPRAKIMQQTCHEVLKELNIQDDPLLDIAMELEKIALNDEYFIEKKLYPNVDFYSGITLK

SEQ ID NO: 18137 - protein, 300 aa, Bartonella sp. ma106up
PIEQLAEKGDFLESCYLLLYGELPTQQEKNDFDRRIMQHTMVHEQFSRFFQGFRRDSHPMAVMVACLGAMSAFYHDSIDITDPQQRMIASIRLISKVPTLAAMAYKYSIGQAFVYPHNSLSYAANFLRMCFAVPCEEYQVNPVLTRAMDRIFILHADHEQNASTSTVRLAGSSGANPFACIAAGVACLWGPAHGGANEACLKMLKEIGSVKKIPEFIARAKDKNDPFRLMGFGHRVYKNYDPRAKIMQKTCHEVLKELNRQDDPLLDIAIELEHIALNDEYFIEKKLYPNVDFYSGITLK

SEQ ID NO: 18138 - protein, 300 aa, Bartonella sp. af170up
PIDQLAEKGDFLESCYLLLYGELPTKQEKHDFDRCIMQHTMVHEQFARFFHGFRRDSHPMAVMVACLGAMSAFYHDSIDITDPQQRMIASVRLISKVPTLAAMAYKYSIGQAFVYPRNDLSYAANFLRMCFCVPCEEYKVNPVLTRAMDRIFILHADHEQNASTSTVRLAGSSGANPFACIAAGVACLWGPAHGGANEACLKMLQEIGSVERIPEFIARAKDKNDPFRLMGFGHRVYKNYDPRAKIMQKTCHEVLKELNIQDDPLLDIAIELETIALNDEYFVEKKLYPNVDFYSGITLK

SEQ ID NO: 18139 - protein, 389 aa, Oryza sativa (japonica cultivar-group)
MVAEAEVMHQPVPVLEVPYHRCVAKGVEEVAAAAAVAPPPVVEVEVAVQVPHMGLESAAGAPSISVDALQFVPSIRSGSFADIGPRRYMEDEHIRIDDLSAHLGSLLVCPLPSAFYGVFDGHGGLDAAAYMKRHAMRFLFEDSEFPQASQVDETYVQSVENSVRRAFLQADLALADDLDISRSSGTTALTALVFGRQLLVANAGDCRAVLCRRGVAMEMSRDHRANYAEECERVAASGGYIEDGYLNGVLSVTRALGDWDMKMPDGSISPLIAEPEFRQTMLTEDDEFLIMGCDGIWDVMTSQHAVSIVRRGLRQHDDPERCARELVMEAKRLETADNLTVIVVCFVSELGSPRQEQVGGQAGVARPRSCKSLSAEALCNLRSWLETDR

SEQ ID NO: 18140 - protein, 331 aa, Rhizobium leguminosarum bv. viciae 3841
MNIQTDTLAELAKEATIGGMGTTVDREIPVIDLSDFDNRKHEIADALWQASVDIGFFQVYNHGIAQDDIDAAFETAWTFFALPAEVKAKTPMPKGINAGWEFKAQVRPSTGTPDNKESFQLTRPDMIRLNLWPSEDDLPGFREKMLRFERQNWELGMRILSCFALKMGFAEDFFTKAHDPSSDQYQSTLRLIHYMSMEGAKPEDFSSWRAGAHSDFDCLTILHQKEGEGGLQVCPGKDAALKEWTDVPPRKGYITCNIGDMLMRWSDDQLQSTLHRVRMPRENEYMGRRLSLPFFCQANRDAVMQGPLGKYEAITAGEYLTRRINANFAKK

SEQ ID NO: 18141 - protein, 122 aa, Pseudomonas syringae pv. phaseolicola 1448A
MPTTTPAPYLKPDECVVLFDGVCKLCNGVVKFLIRHDPHQRLRLAAVQSEQGQALLKWAGLPLDDFHTIAVIVNNRVFVRSDAFLHIMGLLPAPWPLLKVLGIFPRFLRGCRQNKLNFHSLV

SEQ ID NO: 18142 - protein, 497 aa, Burkholderia xenovorans LB400
MDKKSLAFWQDKAATLSIEGRAFIDGEYRDAEGGRTFDCLSPIDGKLLAKVADSGAADVDAAVSAARRAFDSGVWSGLNPRQRKAILLRWAASIREHMDELALLETLDAGKPIADTTSVDVPGAAYCVEWFAEAIDKVGGEVAPADHHLVGLVTREPIGVVAAVVPWNFPILMASWKFGPALAAGNSVVLKPSEKSPLTAIRLAQLALDAGIPAGVFNVVPGAGEPGKLLALHQDVDCLAFTGSTNVGKLIMQYAGQSNLKRVWLELGGKSPNIVMPDCPDMDRAANAAAGAIFYNMGEMCTAGSRLLVHRDIKDVFLDKLIAAARSYTPGNPLDPNTSMGAIVDKVQLERVLGYIEAGRAEAKLLLGGARVKEETGGFYIEPTIFEIPASGAKVAREEIFGPVLSVITFDTVEEAIRIANDSEYGLAAAVWTSNLTIAHEVSRKLRAGTVWVNCYDEGGDMNFPFGGYKQSGNGRDKSLHALEKYTELKSTLVRLR

SEQ ID NO: 18143 - protein, 725 aa, Mycobacterium tuberculosis CDC1551
MRHCKRRDSRTRVRTDHLADSRTEFVTTLEEISALTRPRHPDDWTEIDSAAVDTIRVLAADAVQKVGNGHPGTAMSLAPLAYTLFQRTMRHDPSDTHWLGRDRFVLSAGHSSLTLYIQLYLGGFGLELSDIESLRTWGSKTPGHPEFRHTPGVEITTGPLGQGLASAVGMAMASRYERGLFDPDAEPGASPFDHYIYVIASDGDIEEGVTSEASSLAAVQQLGNLIVFYDRNQISIEDDTNIALCEDTAARYRAYGWHVQEVEGGENVVGIEEAIANAQAVTDRPSFIALRTVIGYPAPNLMDTGKAHGAALGDDEVAAVKKIVGFDPDKTFQVREDVLTHTRGLVARGKQAHERWQLEFDAWARREPERKALLDRLLAQKLPDGWDADLPHWEPGSKALATRAASGAVLSALGPKLPELWGGSADLAGSNNTTIKGADSFGPPSISTKEYTAHWYGRTLHFGVREHAMGAILSGIVLHGPTRAYGGTFLQFSDYMRPAVRLAALMDIDTIYVWTHDSIGLGEDGPTHQPIEHLSALRAIPRLSVVRPADANETAYAWRTILARRNGSGPVGLILTRQGVPVLDGTDAEGVARGGYVLSDAGGLQPGEEPDVILIATGSEVQLAVAAQTLLADNDILARVVSMPCLEWFEAQPYEYRDAVLPPTVSARVAVEAGVAQCWHQLVGDTGEIVSIEHYGESADHKTLFREYGFTAEAVAAAAERALDN

SEQ ID NO: 18144 - protein, 481 aa, Burkholderia xenovorans LB400
MSYRTEEVAYVQPAQPAASAQAAQATQQRSTAEYRALDAAHHIHPFSDMGALNRTGSRVIVKAQGVYLWDSDGNKVIDGMAGLWCVNVGYGRKELADAAYRQMMELPYYNTFFKTTHPPVIELSALLAELAPEPFNHFFYCNSGSEGNDTVLRIVHHYWATQGKHAKKFVISRKNGYHGSTIAGGTLGGMGYMHEQMPSKVENIVHIDQPYFFGEAQGNLTPEEFALARAQQLEAKILEIGADNVAAFIGEPFQGAGGVIFPASTYWPEIQRICRKYDILLVADEVIGGFGRTGEWFAHQYFGFEPDLITLAKGLTSGYIPMGAVGLHDRVAKAIIENGDFNHGLTYSGHPVAAAVAVANLKLLRDEKIVERVKTDTGPYFQKKLRDTLGNHPIIGEISGAGLVAGLQLAQDPKTRKRFANGGDVGTICRDFCFNGNLIMRATGDRMLLSPPLVINKLEIDEIVSKAKKAIDATAQQLGIS

SEQ ID NO: 18145 - protein, 280 aa, Campylobacter jejuni RM1221
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKANAKNLRAALYSMYGARLELVICKDQPKLYRLNANNEFIFIKDLKMNEKGKINATGGTQKFWEEKHAKFIKNLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 18146 - protein, 120 aa, Triticum aestivum
  misc_feature (59)..(59): Xaa can be any naturally occurring amino acid
  unsure (1)..(120): unsure at all Xaa locations
MAGSDPLRPDPGTGVAIVIMGVSDCGKSTVAAMLADALGCGFVEADHHHSHANKDEQGXPLTDADRAPWLESLRDAIRERLGRGEDVAVSCSALRLNYREVLREGDQNYKPGSYGTCRVK

SEQ ID NO: 18147 - protein, 2146 aa, Oryza sativa
  misc_feature (2042)..(2042): Xaa can be any naturally occurring amino acid
  misc_feature (2078)..(2078): Xaa can be any naturally occurring amino acid
  unsure (1)..(2146): unsure at all Xaa locations
MADRLELQGRHGKSRVRVSRVWRRPAAAGGHVIVEWNVAVSVVSDCLPSYTSDDNSAIVATDSIKNTVYVKAKECTEIVSMEEFAVILGRHFTSLYPQVSEATVTIAERPWERVVVDGKPHSHGFKLGVEKHVTEVIVKKSGNLLINSGIQGYSLLKTTQSGFEKFVRDRYTLLPDTRERIVATEVTAWWRYPFEHVSQIPSKSFCFTQRYQDVKKVLADTFFGPPDVGVYSPSVQNTLYLMAKEVLNRFPDIASVQLRMPNLHFIPVNLGNKENPGLVKFADDVYLPTDEPHGTIEATVVVSTTAGADRGELRAKPLRANATEEGREGEGYKAEGKRRRSRHGRRGGSRAFGARSRRWRRTICFHICAITTAFGPSHLCASAERGRCGEGDCGGKGTPDQGGDPADKPTVGAPSRTVAAGSGPNRLAAVQAQVSPDPETQAEANMEAMRQNMTWLQDMLRQMQEQQQAYEGNASQGTPNWLPSNQPGLGASPWNQGPQFDFVNAAQAPTVRQQAPTPGFGANQAPIQAAMTWSQPTFDPSMAAQQVPPIGAGQPNAIAQPHAQAVISPFATPYPQQGAVNRAGGEKGLPLSGGIKTRPIPPQIKFPPVPRYSGETDPKEFLSIYESAIEAAHGDENTKAKAGRVDKGVHASLLASPVPSSRITEASVINAASAGLLEGELTRKIANKEPQTLEHLLRIIDRFARGEEDSKRRQAIQAEYDKASVAAAQAQAQVQVAEPPPLSVRQSQPTIQGQPPRQGQAPMTWRKFRTDRAGKAVMTVEEVQALRKEFDAQQASNHQQPARKKVRKDLYCTFHGHSSHTTEQCRNIKQRGNAQDPRPQQGATVEAPREVVQEQTPPAEQHQDAQRRVIQVITRADPPGQLSKRQEKMQIRMVHNITSAGEGAPQYLNQLICFGPEDAEGVMFPHQDPLVISAEIAGFEVQRILVDGGSSADVIFAEAYAKLGLPIQALTPAPASLRGFGGEAVQVLGQALLLIAFGSGENRREEHVLFDVVDIPYNYNAIFGRATLNKFEAVSHHNYLKLKMPGPTGVIVVKGLQPSAASKGDLAIINRAVHNVEAELHDRPKHAPKHTPHGKITKVQIDDADPTKLVSLGGDMGKEEVESILEVLKKNIDIFAWSPDEVGGVPADLIMHHLAVKPDTKLRKQKLRKMSANRQEAAKAEVQKLLRARVIQEIDHPEWLANPVLVQKSNGKWRMCIDFTDLNKACPKDDFPLPRIDQLVDSTAGNRFMSFLDAYSGYHQIHMNPLDIPKTSFITTFGTFCHLRMPFGLRNAGATFARLVYKVLCKQLGWNVEAYVDDIVVKSRKTFDHASNLQETFDNLRAVGIKLNPEKCVFGVRAGKLLGFLVSERGIEANPEKIDAIQQVKPPSSVHEVQKLAGRIAALSRFLSKAAERGLPFFKTLRGAGKFNWTPECQAAFDELKQYLQSPPALISPAPGSELLLYLAASPVAVNAALVQETDFGQKPVYFVFEALQGAKTRYIEMEKLAYALVMASRKLKHYFQAHKVIVPSQYPLGEILRGKEVIGRLSKWAAELSPFDLHFVARTAIKSQVLADFIAEWTPVFAPEPEAVEQFWVVSSDGSWSHKGAGIAAVLITPNGMPIRYAARLQFDTTNNAAEYEAILLGLRKAKALGVRRLLIRTDSKLVAGHVDKSFEAKEEGMKRYLEAVRSMEKCFAGVTVEHLPRGLNEEADALAKSVACGGPHSPGIFFEVLHAPSVPMDSSEVMEIDQVKLDEDPCDWRTPFVKHLETGWLPEDEEEAKRLQLRATKYKMVSGQLYCSGVLQPLLRCISFAEGEEMAKEIHQGLCGAHQAARTVASKVFRQGVYWPIVLKVCVEQIKKCESCQRHGRSQTAPQYDLQPIAPIWPFARWELDIIGTFPVARNGYKFAIVAVEYFSRWVEAEPLGAITSAVVQKFVWKNIVCRFGVPKEFITDNGKQFDSDKFREMCEGLNLEIRFSSVAHPQSNGAAERTNGKILEALKKRLKGAAKGKWPEEMLSVLWALRTTPTRPTKFSPFILLYGDEGXEKGREVSLELLEGIRVDALEHMRKYATSTSATYNRXSSTDELMPGHLVLRKKANPVAVGKLESKWEGPYLIKNKSRTGSFCLATLEGEEFDHSWNAASLKCFYV

SEQ ID NO: 18148 - protein, 463 aa, Pseudomonas syringae pv. phaseolicola 1448A
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNIAIWMFTLVITLLLTATNLFSVKNYGEFEFWFALIKVVAIIAFVVLGVAAIFGLLPTSNVSGVSHLFDTGGFLPNGMGAVLAAMLTTMFSFMGTEIVTIAAAESKNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYIAPAAVFDFLLASSGAIALLVYLVIAVSQLRMRQKRIAAGEAIDFKMWLFPWLTWAVIAFIVAVLTIMLIQEEHRVEIIATGLLSLLVISAGLLVSRRRKAGRVGAAALG

SEQ ID NO: 18149 - protein, 470 aa, Corynebacterium diphtheriae NCTC 13129
MTEHTAPTLTKGLKVRHLTMMGLGSTIGAGLFLGTGVGIKAAGPAVLIAYIIAGFIAVMIMRMLGEMGSVVPASGSFSEYADAGIGHWAGFIQGWVYWLATVAVLGAEITGASGFVASWLGVSPWIPALVFVAFFGLVNLMRVRAFGEFEFWFAFIKVAVLVVFLIIGSLLVLGLLPNHDFVGLSNVRAEGFAPTGLGGIAAALLAVAFGFGGIEVVAIASAESEDPQKSLVNAVRTTITRISIFYLGSVAIIVLLLPYSSLGKAKSAAESPFSQVLAMANIPGVVGVIEVVIVLALLSAFNAQIYASSRMMMSLAERRQAPNIFARVDNRGVPLPAIVLSVVLSVIMVILNYVDTGWLLTFLLNAAGASLLTVWTFIAVSQLKLRRRLEALQGNLAVRMWAFPGLTIATLAILFGLAILMLSDAGARIELLSAIAMVAILFAISLIAVKQPFDKALLPREASYPQNSPS

SEQ ID NO: 18150 - protein, 454 aa, Corynebacterium diphtheriae NCTC 13129
MTQATTETELGTGLKTRHLTMMGLGSAIGAGLFLGTGVGIAAAGPAVLIAYVLAGIFVVFVMQMLGELAAARPASGSFSVYAEQAFGHWAGFSLGWLYWFMLTMVLGAEMTGAAAIMGQWFGIAPWIPALICVIFFAVVNLARVSGFGEFEFWFAFIKVAVIILFLVIGVLLIFGLLPNYDFVGTQHFLGDGFMPNGISGVATGLLAVAFAFGGIEIVTIAAAESEDPKTAIATAVRSVIWRISLFYLGSVLVICFLIPFSSIGGAKSAADSPFTIILGMANIPGVVGFMEAVIVLALLSAFNAQIYATSRIVHSFAERGDAPKIFAATNPSGVPMPAVLLSMFFAFVSVGLQYWNPAGLLNFLLNAVGGCLIVIWVIIAFAYLKLHPELVRNGEITTVRMWGFPWLGWVTIAGFLGLTVLMLTDDASRSQITSVTVVFLLLIVVSFFTKKKSK

SEQ ID NO: 18151 - protein, 101 aa, Glycine max
SREGISAVVQVVSSRFYIHPPGLVHRLNSNLRCEIRIFDYKRLTAYFNATKFRNRRRYVYLIPVFALDPSCHLNIETLMTTLISGIDLVKQLDVSRGAEWL

SEQ ID NO: 18152 - protein, 274 aa, Kluyveromyces lactis NRRL Y-1140
MSNENGRPKAHRLRKHGGDETDADLDSELEMMDKLNMASRLAENNLAKLLDNDKDLLNRVEEIKAQFQDRAKTPFSAEEDVDDIYDADEHGARSRQIMSARSGTGNKEVIPPENFSHVCGEIYRSSFPRPENFEFLRDRLKLKSILVLIPEEYPAENMKFMEETGIKLFQVGMSGNKEPFVNIPSDLLTKALEVVLNPENHPILIHCNRGKHRTGCLVGCIRKLQNWSLTMIFDEYRRFAFPKVRALDQQFIELYDDTGIIKLATENNWLSVEW

SEQ ID NO: 18153 - protein, 211 aa, Campylobacter jejuni subsp. jejuni NCTC 11168
MENLISGAIKFMQEDFKEHEELFESLKNKQNPHTLFIGCSDSRVIPNLITNTGPGELFVIRNIANIVPPYRVGEDYLATTSAIEYALNSLHIKNIVVCGHSNCGGCNALYYSDEELNKIPNVKKWLTMLDPIKKDVMIFARDDLAMRSWLTEKLNLVNSLQNILTYPGVQEALDEGKIEVHAWYYIIETGEIYEYDFKAKIFTLIQDRKVQ

SEQ ID NO: 18154 - protein, 465 aa, Blastopirellula marina DSM 3645
MVLHEKDTRREELDDDVYASTDLSVSMPKYKFPHVEQNPRHAYSVVHDELMLDGNSRQNLATFCQTWVEPEVHKLMDECLDKNMVDKDEYPQTAEIEARCVHMLADLWNSPSEANTIGCSTTGSSEAAMLGGMAMKNRWKAKRVAAGKPVDKPNLITGPVQVCWHKFARYWDIELREVPMEEGRLLLTPEEVIKRCDENTIGVVPTLGVTFTCQYEPVFEIAAALDKLEKEKGLDIPIHVDAASGGFLAPFCAPELVWDFRLPRVKSINTSGHKFGLAPLGVGWVIWREEKDLPDDLIFWVNYLGGNMRDLALNFSRPGGQIVCQYYNFLRLGRDGYRKIHSACYDTASYLAEEIDKIGLFDVIYDGDRRSGIPALCWKLKPGVKPGFSLYDLADRLCTRGWQVPAYSLPDDQSDQVIQRILVRHGVSRDLGSLLLEDIQRGIEYFENHPIDQPLTEEEAGGFHH

SEQ ID NO: 18155 - protein, 326 aa, Zea mays
MAHYQQGRRQQVDEYGNPVPGGHGVQGQQLGEAAGGYGVAGTGSYGGQQQAGYGPTGTGTHDAGGYGGSGHPGYGATGTGVHDAGGPGAYGAATGTRAHGTHGGVTGIQDGAAGLTGGGLHGATGMGTTTGTGAHGATGMLDTGVLGGGGHAATGMPAGHGTRPGATGVAGTGGAFPHAAEHKTGGGILRRSGSSSSSSSSSSEDDGMGGRRKKGLKEKIKEKMPGGHREGQGQATATGAYGGTGYVAGPTTGGPHEKKGVVEKIKEKIPGGHKDYDQHQHTTAATGGGGGYGGTTDTTYGTTTTEGTHEKKGFMDKIKEKLPGQH

SEQ ID NO: 18156 - protein, 141 aa, Yersinia pseudotuberculosis IP 32953
MVSAPLPYIKPGERVIIYDGVCALCTGWVNFLIRHDRRHTVRLSAVQSKKGRALLEWAELPTDKINTLVLIENQQVYLRSEAIFRVIANLPWPWRILGVLRIFPRPLRDRCYDGIALNRYRLFGRYDAVRKLKADHERRFL

SEQ ID NO: 18157 - protein, 520 aa, Zea mays
MGNCCPGSSSSAEPAPPQPPDPSGSSRPVASPASVSPTAAPAPARPPAPIGPVLGRPMEDVRATYAVGKELGRGQFGVTSLCTHKATGHRFACKTISKRKLSTKEDVEDVRREVQIMYHLSGQPGVVELKGAYEDKGSVHLVMELCAGGELFDRIIARGHYTERAAASLLRTIVEIVHTCHSMGVIHRDLKPENFLLLSKDEDAPLKATDFGLSVFFKEGEVFRDIVGSAYYIAPEVLKRSYGPEADIWSVGVIVYILLSGVPPFWAESEHGIFNAILRGQVDFTSDPWPRISQGAKDLVRKMLNPDPKQRISAYDVLNHPWIKEDGEAPDTPLDNAVLGRLKQFRAMNQFKKAALRVIAGCLSEEEIRGLKEMFKSMDSDSSGTITVDELRRGLANKGTKLSEAEVQQLMEAADADGNGTIDYEEFITATMHMNRMDRDEHLYTAFQYFDKDNSGYITMEELEQALREKGLLDGRDIKEIVAEVDADNDGRINYTEFAAMMRKGDPEPSNPKKRRDIVL

SEQ ID NO: 18158 - protein, 212 aa, Brassica napus
MMSDHGGRKVWGKTKRNREDLEENPNIPIAARVGRMMKKVSITSEEEEAVGPQQQFLTMNGKVYSLRYQDDFVDASVKEVDLLNELEVSKLYHCDGLVLCVAKDNSELVLWNPYLCQTRWIGPRESFHLSDRHAVGYDEGRNHKILRFVDNFIKNMNKIEVVYEIYEIRSDSWRVLEEVNPEGLIDTHQRGVSVKGNTYFVANHYGLAHKVP

SEQ ID NO: 18159 - protein, 408 aa, Rhizobium leguminosarum bv. viciae 3841
MAHYVILGAGECGARAAFALREKGFAGEITLVGAEPLPPYERPPLSKAGSTDASDPKFIAAAEKYAENGIRLLTGLEARDFDPASRIVTLSDGTALSYDKLLLATGAAARSLPGAPEGSRHIRALRTHHDAAALREAMKPGRHIAIIGGGFIGLELAATARLLGAGVTVIEGLERVLKRGVPEEIAHLLTERHRAEGVDIRCGVSIEALTEESGKALIRLSTGEVIEADLVLVGIGARPNVEIAERAGLAIDNGIAVDTHLQTSAPDVFAAGDCCSFPLSIYGGRRVRLESWRNAQEQGTLAAANMLGLNEAVSSVPWFWSDQYDMTLQISGLAEGAAAHQRRDLGAGAFILFHLDADGRLIAASGIGQGNAVARDIRLAEMLIAARAHPNPAALAASDIKLKSLLAA

SEQ ID NO: 18160 - protein, 424 aa, Campylobacter jejuni RM1221
MTNKKAFKEACKFIAGGVNSPVRAFANVQSEPKFISHGKGAYIFDIDGNSYIDYVQSWGPLLFGHCDKDIQKACQKALHKGSSFGAPTLLETELAKLVLSDFPHLEKIRFVSSGTEATMSAIRLARGFTKKDKILKFEGCYHGHSDSLLVSAGSGAATFNSPSSLGVLEDVAKHTLVAKYNDINSVKELFEKNKDIACVIIEPIAGNMGLVPAKQDFLEELAKICKNNQTLLIFDEVMSGYRASYLGSYGINHIQADIITFGKVIGGGLPAAAFASRAEIMDILSPLGGVYQAGTLSGNPLAMAAGIASLTKAKKKTKLYDKLGKLAKKLTQGMKKLADEKGLPLQVCHVGSMFGYFFTKDPVSNYQDALKSDLALFSKFHKNMLENGIYLAPSQFETGFICSKMDDKIIDTTLEAVRESFKRI

SEQ ID NO: 18161 - protein, 176 aa, Kluyveromyces lactis NRRL Y-1140
MKFVKNKSYIQSAIFVVNYLIHYIVSYYSCCTHNQHKPNTMARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKKDIKLARRLRGERS

SEQ ID NO: 18162 - protein, 427 aa, Corynebacterium diphtheriae NCTC 13129
MFLCLIVGKPARGAEILDRLGFVRSKQNVLAIVLAGGEGKRLFPLTEDRAKPAVPFGGTYRLIDFVLSNLVNAGYLKICVLTQYKSHSLDRHISQAWQFSGPTSQYIASVPAQQRLGKRWYMGSADAILQSLNLVYDERPDYVLVFGADHVYRMDPEQMVADHIASGKAVTVAGIRVPRSEASAFGCIQADENNNITEFLEKPADPPGTPDDPSMTFASMGNYVFSTDALIQALKEDENNPDSEHDMGGDIIPYFVSMGQANVYDFNKNVVPGSTDRDRAYWRDVGTVDAFYEAHMDLISVHPVFNLYNQQWPIRSTERGDLPPAKFVQGGIAQASMVAQGSIVSGSTVRNSVVSTDVVVEEGATVEGSVIMPGARIGKGAVVRHCILDKNVVVSDGQVIGVDRERDEQRFQISPGGVVVVGKNFVV

SEQ ID NO: 18163 - protein, 528 aa, Stevia rebaudiana
MEFHLSLLTTVTAILVVTAFFLQISKRKKVDTTKNKLLPPKAKGAWPLIGHLPLLGKNRIAHRVLGDLADKYGPIFTIKLGVYQVLVVSSADAVKDCFTTSDKAFASRPKSTAVEIMGYNYAMFGLAPYGEYWRQVRKIAVLEILSQKRVDMLEWARVSEVRTSTNEVYDAWRVNKENEGSDMVLVDMKQWFTNLILNVLVRIISGKRFPFKSVEGIRFQKMEKKLFELLGAFVVSDLIPSMKRFDIGGYQKQMKMAAEEINDIMEGWLNNRKTQKESGEQKEGDQYFMDVLISVLKDASDADFPGYDHDTVIKATCMALLAAGSDTTSVTIIWALALLLNHPEKMKIAQDEIDKHVGRDRLVEESDLKNLVYINAIIKETMRLYPAAPLSVPHEAMEDCVVGGYHIPKGTRLLPNFWKIQHDPNIWPEPYEFKPERFLSTHKDVDVKGKHFELLPFGTGRRMCPAITFVLQILPLTLANLIQQFEIRKPSNDPIDMTESAGLTTKRATPLDVLIAPRLSLKMYPVDV

SEQ ID NO: 18164 - protein, 313 aa, Arabidopsis thaliana
  misc_feature (12)..(12): Xaa can be any naturally occurring amino acid
  unsure (1)..(313): unsure at all Xaa locations
MVALDLEFERYXGKGSFGSVRLFSYKRRCDGETLYATVKTSDDAKSLYEEFQILSKFKGCPRIVQCYGNGVKQRFNDKGYVEYMIPMEYATGGSLNNFMDRFNDRKLPDPMIRKFTRMLLEGLATIHRYGYVHYDIKPENILVFPGSVYKEGAWRYSYKLKISDFGLSKRDGDTKWWHPLKSYAGTRIYMSPESISHGEIGKGLDLWSLGCVVLEMYTGKRPWWHTNYELEDLMKCYEPLFPPNLPCDAKLFLMTCFAPEPDERKDALTLLRQSFFRRDVNKLTKLLKVDNRNDFTLELKKLRQMLSEIRSMR

SEQ ID NO: 18165 - protein, 248 aa, Candida glabrata CBS 138
MARTFFVGGNFKLNGTKKSIKEIVDRLNTASLPENVEVVICPPATYLDYTVSLVSKKQVTVGGQNTYTKASGAYTGENSVDQLKDVGAKWVILGHSERRTYFHEDDKIVAEKTKFALDQGLGVILCIGETLEEKKAGVTLKVVERQLDAVIAEVKDWTNVVIAYEPVWAIGTGLAATAEDAQDIHHSIRSYLAEKLGKDTAEKTRILYGGSANGANAGTFKDKADVDGFLVGGASLKPEFVDIINSRN

SEQ ID NO: 18166 - protein, 199 aa, Prochlorococcus marinus str. MIT 9313
MSIFVGNLPFRAEQEDVIELFAPFGEVANCALPLERDTGRKRGFAFVEMADESAEPAAIEALQGAEMMGRPLRINKAEPRGSAPRRGGGYGGGGGGGGGGYGGGGGGGYGGGGGGYGGGGGGYGGGGYGGGGYGGGGYGGGGGGGDRGSGARGWEDRSYGGASPETSSYDEGRTRRRRGGAAPEGEGGDSYSGYGGAEG

SEQ ID NO: 18167 - protein, 234 aa, Bradyrhizobium sp. BTAi1
MRRGTAYLLLAAFAVLAVALHVGGFTNAVTTENLLSRREMLKDVASSHPLLAPLVFGLVYIAVAAFALPVAAILSMLGGFLFGTWGGAALVLISATVGATIVFLLARSALGRPLRRKAGPLHARIAANMNDNAFGYLMFMRLVPLFPFVLVNLVAALFDVKLRQFVVATLIGMAPATVVYANIGRQIGEISNPKDLVSPGVIAALTASGLLVLTPSIYRQWIAARSKPRPNGEG

SEQ ID NO: 18168 - protein, 318 aa, Idiomarina loihiensis L2TR
MTRDLVSGGQQIHAPDDLKSLLEEIHQQAMKITEGHVADYIPALAEVDPELCGLTLATLDGEVFNVGDTQEQFSIQSISKIFGLMLAMERLGEDLWDRVKMEPSGQAFNSIVQLEWEKGIPRNPMINAGAIVVSDVLVSRYSASKNAVLSLVRTLCGNDNVYADNIVHQSEKEHGHRNAALAHLMKSFGNIDAEVDELLDHYFWQCALTMSCENLARSFTFLANDGICPFSKKKIMSKRDSQRINALLSTSGMYDQSGEFAFTVGVPAKSGVGGGMIAVVPDFGVICSWSPRLNSYGNSARGMYMVRELANRLGLSVY

SEQ ID NO: 18169 - protein, 144 aa, Triticum aestivum
  misc_feature (45)..(45): Xaa can be any naturally occurring amino acid
  misc_feature (95)..(95): Xaa can be any naturally occurring amino acid
  misc_feature (108)..(108): Xaa can be any naturally occurring amino acid
  unsure (1)..(144): unsure at all Xaa locations
MASLVAVQPVAVRGLAGSSISGRKLAVRPASAAVSRSTRRARGAXAVVAKYGEKSVYFDLDDIANTTGQWDLYGSDAASPYNGLQSKFFNTFAAXPFTKRGLLLKVLXCSGGGSLLAYVSATASPDLLPIKKGPQLPPTPGTTR

SEQ ID NO: 18170 - protein, 124 aa, Brassica napus
GTHHLFQIPPANPQFLRVRATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 18171 - protein, 265 aa, Oryza sativa (japonica cultivar-group)
MVEELKESVKEEQAEKKEEAAKEKPDEPQEIVLKVDMHCEGCAKKVEKSLLRFEGVENVKADSRSKTVVVKSRAADPSKVCERVQRKTKRRVELIFPLPPPPEEEKKEEAPAPPPEEKKEEPPKTITVILKVQMHCDACAQILQKRISRTEGVESVETDLLNGLVVVKGVMDPAVLIESIQRKTRRPAVIVEEVKPREEEKKAEEEEKKPDEDKADGIEEIKKYDFWPPVQYYVEYVYPYPLPPPPTALVSEEFSDENPNACTVA

SEQ ID NO: 18172 - protein, 332 aa, Synechococcus sp. RS9917
MVLPFACILGDAGHTGGDGMAGPRVLVVAGTHGNEVNAPWLLQQWERSAGLLESHGLDVVPVIGNPEAQRLGRRYVDRDLNRSFRPEWLEPDASAPRDQEIERARALLHRYGPGGSEACVLALDLHSTTAAMGSSLVVYGRRLPDLALAAALQARLGLPIYLHEGDPAQQGFLVERWPCGLVIEIGPVPQMVLSARIIEQTQLVLQAALHLIAAAWNGRMLTPERLVVHRHLGSLDLPRDPQGRADALIHPELQGRDWSPIRRGDPLFLTAAGDTISYSGPDGVVPVFINEAAYAEKAIALSVTSKEEWPLSPEAPGALQDLLIWAQRGEPL

SEQ ID NO: 18173 - protein, 363 aa, Oryza sativa
  misc_feature (77)..(77): Xaa can be any naturally occurring amino acid
  misc_feature (91)..(91): Xaa can be any naturally occurring amino acid
  misc_feature (114)..(114): Xaa can be any naturally occurring amino acid
  misc_feature (275)..(275): Xaa can be any naturally occurring amino acid
  unsure (1)..(363): unsure at all Xaa locations
MGSFARKEHQFLAELGLAPRNPGSFACGAWGGSGPVVTSTNPTNNQVIAEVVEASAREYEEGMRACYDAAKTWMAVXSLDSLRWSADINSXRMMKCSYYALLVSLLLGEIREIXIGEVQEIIDMCDYAVGLSRQLNGSIIPSERPNHMMMEVWNPLGVVGVITAFNFPCAVLGWNACIALVCGNCVVWKGAPTTPLITIAMTKIVASVLERNNLPGSIFTAFCGGADIGQAISLDTRITLVSFTGSTKVGLMVQQAVNARYGQCLLELSGHNAIXVMDDADIQIIVRSQLCAAAGTPEHTSHILQELFTTKLYTNFSHLWGLKQPIGILAMYYGHGTGKNLRINTPMKNIEHTIKLTRKSTRK

SEQ ID NO: 18174 - protein, 274 aa, Actinidia chinensis
WRTDEEFAREMLAGINPVVICRLQEFPPNSKLNPQVYNNEASSKTKECIEKNLEGLTIDEALKNKKLFTLDYHDVLMPYLRRINSTSTKIYATRTLLFLKNDGTLKPLAIEMSLPHPEDDKLGGVSEVYTPAEQGAEGTIWQLAKAYVAINDSGYHQLICHWLHTHAVIEPFIIATNRQLSVLHPIHKLLHPHFRDTMNINALARQTLINGGGLLERTVFPSKYAMELSAVAYKDWVFPEQALPADLIKRGVAVEDLKSPHGVRLLIEDYPYAV

SEQ ID NO: 18175 - protein, 355 aa, Zea mays
ERTKKKESIAGDGYGCVRLRRSAEKTETDGSSAAVPLPVCHSQPPSLIRLLCCADMRAAQIDPSPAAPPKSRLKRLFERQLLRVSPAERLPSAPPGGGDKDELPEPSSLCLDGMVRSFLEDGGGGGGAERAAAAARCCNCFHAGDTSDDEDGPAAADAAAADIAETIKGLVHCASLRERNLLADVSTLVERHRASGARKRDLLRLLAGSLRAAGHDAAVCLSRWDRSPSHPAGDHAYLDVLLPAASERAGRERVLVDVDFRSAFEVARPTKAYRAVLQRLPPVFVGRDDRLRLLVAAAADAARASLKKRGLHLPPWRKPEYMRARWLSPYDREAPQPEASTGELAGDGEGGGPTA

SEQ ID NO: 18176 - protein, 595 aa, Burkholderia xenovorans LB400
MYQYTEFDKSFVRSRAAQFRDQVERWQSGKLSENDFRPLRLQNGWYVQRHAPMLRVAVPYGELSSSQLRVLARIAREYDEPEAEVYRLACEAQRKLGTLRLPTHYAHFTTRTNVQFNWIPLSKAADVMDLLASVDMHGIQTSGNCIRNISCDERAGVAPDEIADPRPFAEIMRQWTTLHPEFAFLPRKFKIAITGAAEDRAATEWHDVGLRLIRNEAGELGFRVTVGGGMGRTPMIGAVLREFLPWQQIMNYIEAVVRVYNRYGRRDNKYKARIKILVKAEGQRYVDDVNEEFRQIVEFDGGPHTIAQAELDRVSASFVPPALHKRTPANVGGVRPDLHAQAEIHPRFGKWLERNVALHKDPQMRVVTLSFKRLLQAPGDASADQLDTVAELAARYSAGEARVTHTQNVVLPWVHVDDLFPLWQAASDADLASANVHLLTDMIACPGGDFCALANARSIPVAQAIAERYQDLDELDDIGEIDLHISGCINSCGHHHSGHIGILGVDKDGQEWYQVTLGGADGENSSGVAQPGKVIGPSFSAHEIPDVVEAILSTYRDVRSADGTRETFIQTVRRVGLEPFKLAANGARCKTEVSL

SEQ ID NO: 18177 - protein, 135 aa, Glycine max
MAWATRFLSAVCFFAAGVLFAPDVLVGDRSGSGATAVTAAKVSHLLCFATCWGAALWATFIGGIIMFKNLPRHQFGNLQGKMFPAYFTLISACAAVSVAAFAYLHPWKAASAVERYQLGFLISALGFNLSNLLVF

SEQ ID NO: 18178 - protein, 548 aa, Burkholderia cenocepacia
MSTPSNVSPPIAVDRSAVLDDAHLGDIRGALGTIPHHDTGARGTWWARLRTLLAIIGPGLIVMVGDNDAGAFGTYTQAGQNYGTTLLWTLLLLVPVLYVNQEMVLRLGAVTGVGHARLIFERFGKFWGAFSVIDLFLLNALTIVTEFIGITFVLDFFGLPKVAGVCVAAALTMAAVSTGDFRRFERFAIGLCVLSLLLVPVLVSIHPPVAQMTRDFFVPNWPAHAKLSDVMLLVIGIVGTTVAPWQLFFQQSYVIDKRITPRFMKYEKADLWIGIAFVLVGAVAMIGFSSALFGGHPEAGNFTDAGGIIAGLEKYAGRTSATLFAIALLDACIIGAAAVSLSTAYAIGDVFKIRHSLHRGVTDAKGFYLVYFGIVAAAATLVLIPGSPLGLLTEAVQTLAGVLLPSATVFLLVLCNDRQVLGPWVNSTKLNVFTGAVIWVLVLLSIILTASVMYPDISGEAIVDVLVGGTVLAIAGYLATVLIRRNKRVVEPAVDRSLRDTWRMPPLDTLEPQNMTLATRIWMAVLRGYLVIAVGLVIVKVVQMTLLK

SEQ ID NO: 18179 - protein, 158 aa, Frankia sp. EAN1pec
MLAADYGIAADVWSVTSWNELRREALVCERRNLLNPEQPPAVPYISQILNGAPGPVIAVSDWMRAVPDQISRWVPQPYTSLGTDGFGRSDTRAALRRHFNVDAESVVVATLEALTRTGDVEQATVDDAIRRYGLRKDGANEAALGNGATEENDQPVSG

SEQ ID NO: 18180 - protein, 612 aa, Candida glabrata CBS 138
MNSNDLLSEVKVSSSEDSQILSKSNDYVHEQNHIIEGDYDDDDKSSSSHNLRSRFDVQVKNRHLQGFIDSFKRADDSPDHNDLEKTTTAHQEQKKTMKSRHVIMMSLGTGIGTGLLVSNGKGLSLAGPASLVIAYGLVSFVTYFMIQAAGEMAVTYPTLPGSFNAYTSFFISKPFGFATTWLFCIQWLTVLPLELITAAMTIKYWNTSIDPDVFVIIFYVFLMFIHFFGVQAYGETEFIFNACKILMIGGFIIFAIVVNCGGAGKDGYIGGKYWHDPGAFASSNGASRFKGICYNLVNAYFSYGGNELFVLSVNDQKNPRKSTPAAAKSNVYRIVVIYLLTMILIGFVVPHNSSELLGASGGNGLHASPYVLAASIHGIKVVPHIINAVILIALISVANSSLYAGPRLLSSLAQQGYAPRFLSYVDRRGRPLTALLLSALVGVIGFAATSPREEEVFTWLAAISGLSELFTWTSIMFSHIRFRRAMKLQNKSLDTLGYKANTGLWGSYFGVGFNILVFAAQFWVALSPPNSGGKCDANSFFASYLAMPIWLVFYFGYMCWYKDFTVLTDLNQVDLDNHRKVYDPEFLRQEDLENKERLRNSSFLVKIYEFWC

SEQ ID NO: 18181 - protein, 355 aa, Oryza sativa (indica cultivar-group)
MPAVAGSLYMASQHKGVPPPLPPPPRPLPVINLGRLTMDSASRALAVRDIVLACRERGCFEVVNHGISRSCMNGALEAASEFFQLSTERKEEFASDDIRQPIRYDTSSRDGISMSRSFLKHYANPLDDWIKFWPTQPPTYREKMGEYAVETQRVSMQLMEAILQGLGLGPSYLQEKLEGGVQFVALNNYPQSSAKKADKIGLAPHSDYGFLTILLQSSPGLEVMHHEDDAWTSVPAIPGALHVHVGDHLEVLSNGQLKSLVHRAVLNPNESRISIASIHGLSMDEEVHCAEELVDEHHPKMYRGSSFQDFLDFLPANMNRCHHSDNDSGMRRQQPAGNAKRRRRLQQLKGKAGQG

SEQ ID NO: 18182 - protein, 378 aa, Prochlorococcus marinus str. MIT 9313
MADYYDLLGVSKDADGDTLKRAYRRLARQYHPDINKDPGAEDRFKEIGRAYEVLSDPQTRGRYDQFGEAGLGGAAGMPDVGDMGGFADLFETFFSGFGGAGGSGGARPRRRGPQQGDDLRYDLKIDFEQAVFGQEREIKIPHLETCDTCNGTGAKVGSGPTTCSTCGGVGQVRRATRTPFGSFTQVAECPSCEGTGQVIADPCPACAGQGVRQVRKKLRINIPAGVDTGTRLRVAGEGNAGLRGGPSGDLYVFLTVKSHPQLRRDGITVLSEVNVSYLQAILGDIIEVDTVDGNTSLEIPAGTQPNAVLTLENKGIPKLGNPVARGNQRISINVKLPIRLSDEERGLLEELAGHHSAKGRQHHHHNSGLFARLFGQKG

SEQ ID NO: 18183 - protein, 542 aa, Roseovarius nubinhibens ISM
MGWMKDETGLDKCAANFVPLTPLSHLRRAVQIYPDYEALVYGETRRSYREYHARVTQLASALKNLGLRPGDVVATLLPNVPAHVEAHFGVPASGAVLNAINTRLEPDTISYIFGHGEAQLALVDTALLPLAEAAIARMKGKGPQIVEVADPQAGYPATGRYLEYEDFLASGDEDFNWIMPKDEWESLALNYTSGTTGRPKGVVYHHRGAYLMTMGTAVSWPMPHQARYLTIVPLFHCNNWNHSWMMPLVGGCVVCCRDITARAIYDAIADDGVTHMGGAPIVLNMIVNAKPEDRRAFDHIVQTYTAGAPPPAATLRAIEPLGFSVTQVYGLTETYGHVTECTWHARWDGEEDEERYAIKARTGVLMPMMEDITALDPETMKQVPMDGATQGEIMIRGNAVMKGYLKNPEATKEAFKGGYFHSGDIAFQHPDGYLKIADRAKDIIISGGENISSIEVEGVLMKHPEVLLCAVVAKPDDKWGEVPCAFVELKEGAVCDEAAIIAFARERLAGFKTPKQVRFQELPKTSTGKIQKFELRKIAAEG

SEQ ID NO: 18184 - protein, 207 aa, Oryza sativa (japonica cultivar-group)
MAAAAAADSTSAVPPAVVSAAEDTLAAAESVGDHLAEMVAAAGEDPDAIAELPPLRRARAFLAMAKAAASLFAVRLRCSGVDPDEHPIKKEFERLSLWEEKLNRFEDWDKAPLRPTTTVNTQAAARFIGHSLPHLTTDQKRSMQAISRGEGGSYSGNKRKPQPPRPNKKSVRAATEEFLAKAALELSGHNDSKVKGPIRLLSDEDED

SEQ ID NO: 18185 - protein, 589 aa, Oryza sativa (japonica cultivar-group)
MAVAARVVEEEDPDVVEMMKRRDDEEEVVGEAWDYKGRGAIRGSTGGWRSAAMILCVELNERLTTLGVAVNLVTYLTGTMHLGSAASANAVTNFLGTSFMLCLLGGFLADTYLGRYLTIAIFTAVQAAGMAVLTISTAAPGLRPPPCSSGGSGCAAANGTQLGVLYLGLYMTALGTGGLKSSVSGFGSDQFDESDGGERGSMARFFSWFFFFISMGSLLAVTVLVYVQDKVGRRWGYGICVVAILTGLLFFLAGTTTYRFKKLLGSPLTQIAAVTAAAWTNRNLPLPSDPSMLNHDDSAHTTAKPNQKLPHSKQFRFLDHAAIVETTTAEAKKRKRWAACCTVTEVEEVKQLVRMLPTWATTILFWTVYAQMTTFSVSQAAVMDRRLSTSFVIPAGSLTVFFVAAILLTVPLYYRLLAPLVRRLTANPRYDLSPLHRIFVGLLLAALAMVAAALTERARRDAAVTLSVFYLLPQFLLVGAGEAFTYIGQLDFFLRECPKGMKTMSTGLFLSTLSLGFFFSTALVTVVHKVTAESRRPWLADNLDEGRLDNFYWLLGGISVVNLAVFVAAAARGYVYREKRLADAGIIHI

SEQ ID NO: 18186 - protein, 195 aa, Bordetella parapertussis 12822
MRTAEITRNTNETRIRVAVNLDGTGKQTIDTGVPFLDHMLDQIARHGLIDLDIKADGDLHIDAHHTVEDVGITLGMAIAKAVGSKAGLRRYGHAYVPLDEALSRVVIDFSGRPGLEYHIDFTRARIGDFDVDLTREFFQGLVNHALMTLHIDNLRGFNAHHQCETVFKAFGRALRMALEVDPRMGDAVPSTKGVL

SEQ ID NO: 18187 - protein, 488 aa, Candida albicans SC5314
MRIPSARFVRTGLCSFKPRSFASGRLPYTYLATRAFHSSKIRAINFDPYKTLGVDKSADDRQIKKAYYDLVKKYHPDVNKEKDAEKRFHKIQESYELLRDKEKRAQYDQFGASAFDANGNANPFAGQGGNPFGGFGGGSAGGNPFSGMGFDFEDLFREAFAGGRGGAGGGRGGRSFVTEHVGDNIEVLKTIPFKDSIFGTSVTINYKAVDSCTTCSGSGLKAGAKKNTCPTCHGAGQTTHVMGGFHMSSTCPSCQGAGVTISKSDECGTCHGHGVQEIPKSKTVEIPAGVSDGTRIRIPGAGDAPMVTKDPYNQLVNGDLIIRINVQKDPVFSRNKNDLVINEEILMTTAALGGEIVVPTLDGQKIKLKVRPGVQNGRKLTIPEKGVPINRNLNNRGNLEVILNVKTVVPETPTQKALLEALADTFNDKNAKRTDADWSLDIEDDKNGKVNETYDESDLHPSKLKRIGKVLGKFFNFEQNDKGTKKNN

SEQ ID NO: 18188 - protein, 134 aa, Bordetella parapertussis 12822
MNTEPTWMAEVVFDENGLIPAIAQDAETGQILMVAWMNREALAETAATGRAVYWSRSRQRLWRKGEESGHAQDVHELRLDCDGDVILLKVHQNGGIACHTGRASCFYRRLEGTASQAEWITIDPVLKDPELIYK

SEQ ID NO: 18189 - protein, 291 aa, Campylobacter jejuni subsp. jejuni NCTC 11168
MQFTFEQIFIAMLLTLFAGFSTAIGSIIAFFSRKDDLRVLSLGLGFSAGVMIYISFMEILPTALKDFKNHYDSHWAELLGLACFFGGILISLLIDKLIPEDVNPHEPKEDLSELKICPLPQKGQNPPKFHPGEKLHQINTKALKRTGIFTALAIAIHNFPEGFATFISSLDNLTLGIAIAIAVAIHNIPEGLAVSLPIYHATGDKKKAFIYSALSGFAEPLGAFVGALILLPFIGDLTLAISFAVIAGIMVFISLDELLPAAKTYDKAHDSLYGLIAGMAIMALSLNLLGQ

SEQ ID NO: 18190 - protein, 362 aa, Campylobacter jejuni subsp. jejuni NCTC 11168
MPADLNDYFNKKNGNSNNNGNNNRQNFNFKAPEFNFKGFGKFSPFVYGVIIIILFLIVAKPFMVINSGEMGIKSTTGKYDPNPLEPGLHFFLPFVQKITIIDTRVRQINYASIEGSNENLSSGSGVINKNSISVLDSRGLPVSIDVTVQYRLNPLQVPQTIATWSLNWENKIIDPVVRDVVRSVVGKYTAEELPTNRNTIATQIEEGIRKTIEAQPNEPVELRAVQLREIILPSKVKEQIERVQIAKQEAERTKYEVERANQEALKKAALAEGEANATIISAKGKAMAVKIEADAQAYSNKEIANSLNTPLLNLKQIETQKEFNEALKVNQDAKIFLTPGGAVPNIWVDTKDAKKQSAANMN

SEQ ID NO: 18191 - protein, 357 aa, Arabidopsis thaliana
MGINFEDQTTLFNFVVREGNGVKGMIDSGLSSVPRPFVQPLSERIPTQKALTCEATQPIDLSNLDGPQHKEVAKQIVEAAETLGFFQVVNHGVSVELLELLKSSAHEFFAQAPEEKSMYLKEVSPSKLVKYGTSFVPDKEKAIEWKDYVSMLYTNDSEALQHWPQPCREVALEFLNSSMEMVKNVVNILMENVGVTLEEEKMNGLMGTKMVNMNYYPTCPSPELTVGVGRHSDMGMLTVLLQDGIGGLYVKLDNGEWAEIPPVHGALVINIGDTLQILSNGKYKSAEHRVRTTNIGSRVSVPIFTAPNPSQKVGPLPEVVKRDGVARYKEFLFQDYMNNFFGQPHDGKKSLDFARAE

SEQ ID NO: 18192 - protein, 231 aa, Synechococcus sp. RS9917
MKQAVAAAAVDAIQDGMVLGLGSGSTAALMIQGLGAKLAAGELRDIVGVTTSFQGEVLAAELGIPLRSLNAVERIDLAIDGADEVDPAFQLIKGGGACHVQEKLVAARAERFIVVVDATKLVDRLNLGFLLPVEVLPGAWRQVQARLASLGGAAELRMATRKAGPVVTDQGNLVLDVRFGEGIADPRALEQTINNIPGVLENGLFVDLADEVLVGEVTDGVAGVRRLERQG

SEQ ID NO: 18193 - protein, 248 aa, Nicotiana glauca
MPGIAFGRIDDSFSVGSLKAYLAEFISTLLFVFAGVGSAIAYNKLTANAALDPAGLVAVAVCHGFALFVAVAVGANISGGHVNPAVTFGLALGGQITLLTGLFYIIAQLLGSIVACLLLKVVTGGLAVPTHNVAAGVGALEGVVMEIIITFALVYTVYATAADPKKGSLGTIAPIAIGFIVGANILAAGPFSGGSMNPARSFGPAVASGDFTNNWIYWAGPLVGGGLAGLTYSNVFMQHEHAPLSSDF

SEQ ID NO: 18194 - protein, 179 aa, Oryza sativa (japonica cultivar-group)
MATKAGVIATLLALNLHFFTFSDACGCQCGSCPSGGGGGGGGGGGGRGGGGGSGGGSGGGGGSGGGGSGGGGSGGGGSGGGGGGGSGGGGGGGRCPIDTLKLGVCANVLNGLINVQLGTPPRQPCCSLIQGLADLEAAVCLCTALRANILGINLNLPINLSLLVNYCGRSVPSGFQCSN

SEQ ID NO: 18195 - protein, 506 aa, Oryza sativa
KEEEEEMTLLCVPLVARTVEAMRADAAAAAAAGADLVEIRLDFIGSKFRPREDLPRLLRGCPLPAIVTYRPNWEGGQYEGDDATRFEALRLAMELGVNYVDIELKVADKFISFIYGSKPEKCKLIVSAHNYESTPSCEELADLVARIQAVGADIVKIATTANDIVDVSQMFQVMVHCQVPMIGLVMGEKGLMSRVLSPKFGGYLTFGSLDATKVSAPGQPTVEELIDIYDIRRIGPDTKVLGVIANPVKQSKSPVLHNTCLQSVGYNAVYLPLLADNIARFLSTYSSPDFSGFSCSLPFKVDAVQCCHEHDPVAKSIGAISTIIRRPDGKLLGYNNDYIGAICAIEDGIGGPGSKNAAVTPLAGRLLVVVGAGGAGKAIAYGAKEKGARIVVANRTYEKAVSLAAAVGGHALRLAELETFRPEEGMILANATSLGMYPNVDGTPIPKQALSFYDVVFDAVYAPKVTRLLREAEECGVKVVSGVEMFLRQALGQFERFTNGIEGFDS

SEQ ID NO: 18196 - protein, 365 aa, Candidatus Desulfococcus oleovorans Hxd3
MAVKRDYYEILGVARDVSATELKKQYRKIALKCHPDKNPGNKEAEDQFKEASEAYAVLCDPEKRQIYDQYGHAGLEGLGNGRGAGFDDIFSSFGDIFEDFFGFGSGRRSRRGPRKGEDLRYDLTIDFLEAAFGKQTEIELEKLEPCSACEGTGCAEGTQPETCRHCGGTGQATRSQGFFVVKTTCPACRGTGRMIASPCARCRGNGREMVRKTVSLKIPAGVDTGSRLRLSGEGEAGDPGGRPGDLYVFINVRPHEFFQRNNNDVVCIMEISFVQASLGATISVPTLTGERELEIPKGTQYGDIFRFKGEGIASLRSGNRGDQIIQVEIKTPTRLNKKQEELLTEFSRLESDKIGNKLKNLFKRR

SEQ ID NO: 18197 - protein, 122 aa, Bordetella parapertussis 12822
MSDNCIFCKIARGEIPAKKVFEDDEFVAFHDINPAAPVHLLLIPRRHVVSLQDIAEGDADWLGRMTVLASRLAAGNGCNPGPDGGFRLMANSGAEGGQEVPHLHFHILGGPRPWKGRVAPAA

SEQ ID NO: 18198 - protein, 247 aa, Ipomoea nil
MGRGRVQLKRIENKINRQVTFSKRRTGLLKKAHEISVLCDAEVALIVFSTKGKLFEYATESCMEKILERYERYSYAERQLNSTDQNSQGSWTLEHAKLKARMEVLQRNQRHYEGEDLDSLSLKELQNLERNLIQHSNIRSKRNQLMYESILCSEKDKHCRTKYQLSKKIKEREKEMATQQQQQQEVQWEQPNDDINSSYVVPPPLVHLSSEGEYQGEGEYGETEGTQRQQQNNTSAMPQWMLSHLQG

SEQ ID NO: 18199 - protein, 349 aa, Citrullus lanatus var. lanatus
MADQELPPPSQLVPLDFNSIQTVPESHLWPNSIELSPAIKLDERISLPIIDFLDDGASELLGRACEQWGMFQLINHGVPKTLIDEAEEETRRLFSLPARQKMKTLRTDSLTATGYGMAGISKYHQKLMWHEGFTMSGSPVDDAKKLWPNDYKRFCDVMEEYQSQMKGLGERIIRLIFKFLDISEEEMMKLLTSTDESAGKPYMALRLNSYPPCPDPSRVMGLAAHTDTSLFTIVHQARHDGLQVFKDGTGWVPLSPMSGTLIVNVGDILHILSNGRFPSILHRVMIHENKEHRFSLAYFYDPPGDLYISPYCKPLSESPQIPLYRCVNVKEYFTIKAKKEGKGLSAIKI

SEQ ID NO: 18200 - protein, 469 aa, Lactobacillus plantarum WCFS1
MAMLYGKHNHEAEEYLEPVFGAPSEQHDLPKYRLPKHSLSPREADRLVRDELLDEGNSRLNLATFCQTYMEPEAVELMKDTLAKNAIDKSEYPRTAEIENRCVNIIANLWHAPDDEHFTGTSTIGSSEACMLGGLAMKFAWRKRAQAAGLDLNAHRPNLVISAGYQVCWEKFCVYWDVDMHVVPMDEQHMALDVNHVLDYVDEYTIGIVGIMGITYTGQYDDLAALDKVVTHYNHQHPKLPVYIHVDAASGGFYTPFIEPQLIWDFRLANVVSINASGHKYGLVYPGVGWVVWRDRQFLPPELVFKVSYLGGELPTMAINFSHSAAQLIGQYYNFIRFGMDGYREIQTKTHDVARYLAAALDKVGEFKMINNGHQLPLICYQLASREDREWTLYDLSDRLLMNGWQVPTYPLPANLEQQVIQRIVVRADFGMNMAHDFMDDLTKAVHDLNHAHIVYHHDAAPKKYGFTH

SEQ ID NO: 18201 - protein, 470 aa, Frankia sp. EAN1pec
MTPEPDHTRADGTRADHTQADDTPEHPGLATLLGDVDEVIVAVPDLQGRLVGTGLSPEYFREEVLGGDGLGACAYLHAVDVEMETGPGYAYDPWEGGFGDLRLVPDLSTLGHAPWHPESAIVIADAVWPDGTPVDVAPRTVLRRQLDRLAALGLRALAGTELEFLVFEEAYRKAAGRDYARLTPASSYNVDYALAGTERMDDLVRSIRRAMAAAGAPVESARAEVHPGQYEIVFRYDEALRTCDRHALYKTTAKKIAGTAGRALTFMAKYDQGEGNSCHVHLSLRAADGGFVLSAGAEEGMSELMRWFVAGQLACMAELTLLYAPTVNSYKRLAPGGFAPTGISWGLDNRTCAIRVVGRGRSLRIEHRVPGGDANPYLAIAGMLAAGLHGIENRLPLPPPRAGNVFAAPDVPRLPASLRDAARAWRESATARAAFGERVVDHLAHAADVELAGYERTVTDWERRRGFERY

SEQ ID NO: 18202 - protein, 531 aa, Saccharomyces cerevisiae
MRVYQFCRPFQLFTCFLCYLLVFVKANKEKISQKNYQVCAGMYSKEDWKGKIDPFISFNLKKISGLSDESDPGLVVAIYDFQDFEHLGVQLPDEEMYYICDDYAIDIGICEEENRDEFIVQDVVYDPYTSTNRSLANPIMTFSQNEVGLHDTRYPIKETGFYCVTAFRSSTSTKFNAVVNFRNAYGQLAGTEINKLPLYGLLAVAYVVAMALYSFAFWKHKHELLPLQKYLLAFFVFLTAETIFVWAYYDLKNEKGDTAGIKVYMVFLSILTAGKVTFSFFLLLIIALGYGIVYPKLNKTLMRRCQMYGALTYAICIGFLIQSYLTDMEAPSPLILITLIPMALALIIFYYMIIRSMTKTVIYLKEQRQIVKLNMYKKLLYIIYASFLSVLAGSIVSSFIYVGMNTIDMIEKNWRSRFFVTDFWPTLVYFIVFVTIAFLWRPTDTSYMLAASQQLPTDPENVADFDLGDLQSFDDQDDASIITGERGIDEDDLNLNFTDDEEGHDNVNNHSQATGQCLPLQQNNATSSRFD

SEQ ID NO: 18203 - protein, 319 aa, Xanthobacter autotrophicus Py2
MILVCGEALIDLLVGAPEGNEMPARAVAGGSPFNVAVGLARLGAPTAFFGGISSDRFGTHLVDVLAREGVDPRFVVRSDSLSTISVVATQADGQPLYSFHGAGAADRMLAPDRLPPVLPDEVRALTFGSYTLVVEPVASTYAALAEREAGRRVISVDPNLRPGVVGDLSRWAETTERFFRTADIVKASDEDIHIAFGGRMGLTDAARRFLDLGAKLVVITRGDKGAVAYSQLGEVSVPGRSVVVRDTVGAGDTFHAALLAGLHRTGRLEGAAIATLDTEAMGELVAYGTAAAAITCSRAGADLPTAAEVEASLTLAMAS

SEQ ID NO: 18204 - protein, 1089 aa, Campylobacter jejuni subsp. jejuni NCTC 11168
MPKRTDIKSILLIGSGPIVIGQACEFDYSGTQAAKTLKELGYRVVLINSNPATIMTDPEFADATYIEPITKESILSIIKKEKIDAILPTMGGQVALNVAMEVYESGLLGDVKFLGANPEAIKKGEDRQVFKECMKKIGMDLPKSMYAYNYDEALKAVDEIDFPLMIRASYTLGGAGSGVVYNMDEFKELTNTALALSPIHEILIEESLLGWKEYEMEVIRDRADNCIIVCSIENIDPMGVHTGDSITIAPALTLTDKEYQVMRNASFAILREIGVDTGGSNVQFAINPKNGRMIVIEMNPRVSRSSALASKATGYPIAKVATLLAVGFSLDEIKNDITGTPASFEPVIDYIVTKIPRFTFEKFPGANTTLGTAMKSVGEVMAIGRTFKESIQKALCSLERSLSGFDRVKFEDRNDLVFKIRNANEKRLLYVAQAFREGFSVEELYELCKIDPWFLTQIKEIVDFEEQIDMDILNNKALLRKAKTMGFSDKMIALLVNLKDNLELSQNDIYYVRMKQKIIAEFSEVDTCAGEFEALTPYLYSSINVSELTQSKNDAKDKKEKKVMIIGGGPNRIGQGIEFDYACVHASFALKDMGIKTIMYNCNPETVSTDYDTSDILYFEPIDFEHLRAVIEREKPDGVIVHFGGQTPLKFAKRLSAFGAKIIGTSARVIDMAEDRKKFAEFITKLGINQPKNSTATSVEEAVLKASDIGYPVLVRPSYVLGGRAMRVVNDEAELRLYMQEAVDVSDKSPVLIDQFLDNATEIDVDAICDGKDVYVAGIMEHIEEAGIHSGDSACSLPPCNIDEKMQEFIAQKTADIALNLGVVGLLNIQFALHNNELYMIEVNPRASRTIPFVSKATGIPLAKVATRVMWQGNLKEALKFYDTFKVVNFDTKILRPKTPKYMSVKEAVFPFAKLSGSDLELGPEMRSTGEVMGISKDFANSYAKSQIASFNHLPEQGVVFISLKDKDKKYTKKIAAEYVKLGFKLMATGGTCKEILESGFECELVHKISEGRPNVEDKLKNGEIHLVINTSDSHSFKGDTKKIRENIIRFKIPYFTNLRSALAGAKSIKAIQSKSCLDVKSLQEWLKS

SEQ ID NO: 18205 - protein, 209 aa, Coprinopsis cinerea okayama7#130
MAEGSNYDYLFKVVLIGDSGVGKSNLLSRFTRNEFNLESKSTIGVEFATRSINVDGKTVKAQIWDTAGQERYRAITSAYYRGAVGALLVYDIAKHATYVNVTRWLKELRDHADSNIVIMLVGNKSDLKHLRAVPTDEAKAFATENGLSFIETSALDASNVESAFQTILTDIYRIVSAKSLESSSTNIEPPTQGISVTAPEPADKGGKCC

SEQ ID NO: 18206 - protein, 350 aa, Synechococcus sp. RS9917
MTVPVRPETLLGRSAEELEQWAVAQGQPAFRGRQLHDWLYAKGAETLAAITVLPKAWRLALEAQGVRIGRLQEQDRRVAADATTKLLLQTDDGELIETVGIPTDQRLTVCVSSQVGCPMACRFCATGQGGLQRSLATHEIVDQVLSVRAVMDRRPSHVVFMGMGEPLLNIDAVLGAIRCLHNDLGIGQRRITVSTVGVPRTLPQLAELAMARLGRAQFTLAVSLHAPNQALREELIPTAHAYPYDDLLQDCRHYLELTGRRVSFEYILLGGLNDAPTHAEELADRVGGFQSHVNLIAYNPIEEGAFQRPSAERINGFRRVLERRGVAVSLRASRGLDQDAACGQLRRRSL

SEQ ID NO: 18207 - protein, 261 aa, Candida albicans SC5314
MLTLAIGDLFVPERAVDLPSKFRKLLAPQPNNTPSNSKINQVICLGNITNSSTILQFLTNISPQFNLVKGEFDNPVVLSQQLSSLNKSSNIPLYNRFVHDNLKIGYTNGFQVIPRGDPLALSAFARELDVDVLIWGGTHKVEAYTLDGKFFINPGSATGAFNFDWPENDEEEREEADKSQDDDEATDKESHDTEEAEPKVENETSTSASDDFKQTLHEVSEINSNIPSFCLLDTHGSTCILYIYTQIDGEVKVDKVTYTKD

SEQ ID NO: 18208 - protein, 348 aa, Zea mays
LEGRASAAAKKKSSRETLLTLTEGDMMRKLRELLQKSDNRVCADCGAPDPKWASANIGVFICLKCSGVHRSLGTHVSKVLSVTLDQWTDDEINSMIEVGGNSYANAIYEAFLPEGYQKPHPDSSQEERADFIRSKYELQEFLKPSLRLVSSNKGSLEATSTSSRKHKDNTVSLSASFSSEAGMVEFIGILKVKVIRGTKLAVRDLMSSDPYIVLTLGQQKAKTSVSKRNLNPVWNEELKLSVPQQYGPLKLDPTQQVFDHDMLSKDDEMGDAEIDLQPMISAATAFGDPDLLADMQIGKWLRSPDNALARDSAVNVVGGKVKQEVSLRLQNVESGEVELELEWIPLNQ

SEQ ID NO: 18209 - protein, 306 aa, Synechococcus sp. CC9311
MGWTLKDIPDQTGRLALVTGANSGLGLETSRALLQKGATVLMACRNQKKSEAARRDLLELGTTGVDLLDLDLSDLNSVERCAKAVQERYGRLDLLMNNAGLMAPPRRLSVQGFEMQFAVNHLGHMALTQRLLPLMEGRQDPRVVTVTSGAQYFGKMQWSDLQGERRYDRWKAYSQSKLANVMFALELNHRLHKQNSTVISLAAHPGLARTNLQKVSVASRGAWQESLAYRLMDPLFQSAAMGALPQLHAATASSAKGGEHFGPGGFASMRGMPTRQPVARPARDAEQRERLWTTSDDMIQCNKSEV

SEQ ID NO: 18210 - protein, 462 aa, Frankia sp. EAN1pec
MTTISPADVGVGPDGADPAVAPAILARQEARESAARTYARSLPIVPVEAAGCWIVGADGRRYLDFLAGAGTLAVGHNHPVVVEEIERVLRSGAPLHALDIATPEKDAFAAELVGDLPPGLREDPKLLFCGPTGADAVEAALKLAQTVTGHHNVLAFTGAYHGMTSGALAVTGKVAAKEPLPVAGAVVRLPFPYPYRCPFGVGGAASAEISASYIERLLDDSCGGITSPAAMILEPVQGEGGVIPAPDTWLRAMRELTTRRGIPLILDEVQTGVGRTGTFWACERAGVVPDMLVMSKAIGGGLPLAVVAYRAELDTWAPGAHAGTFRGNQLAMAAGRATLELVRTQALAERAAAAGKRLLTGLESITRGKPFIGDVRGRGLMLGLEVVSAEAAPDEIGARPADPRLAAAIRSECLARGLIIELGGRDDAVLRLLPPLTVTDEEADLALEILAESVSAATEQAG

SEQ ID NO: 18211 - protein, 319 aa, Geobacillus stearothermophilus
MKRIGVLTSGGDSPGMNAAIRSVVRKAIYHGVEVYGVYHGYAGLIAGNIKKLEVGDVGDIIHRGGTILYTARCPEFKTEEGQKKGIEQLKKHGIEGLVVIGGDGSYQGAKKLTEHGFPCVGVPGTIDNDIPGTDFTIGFDTALNTVIDAIDKIRDTATSHERTYVIEVMGRHAGDIALWSGLAGGAETILIPEADYDMNDVIARLKRGHERGKKHSIIIVAEGVGSGVDFGRQIQEATGFETRVTVLGHVQRGGSPTAFDRVLASRLGARAVELLLEGKGGRCVGIQNNQLVDHDIAEALANKHTIDQRMYALSKELSI

SEQ ID NO: 18212 - protein, 369 aa, Oryza sativa (japonica cultivar-group)
MGKGGKGAEAAAAAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 18213 - protein, 224 aa, Brassica napus
  misc_feature (214)..(214): Xaa can be any naturally occurring amino acid
  unsure (1)..(224): unsure at all Xaa locations
MQLINAVAAARMLSGLGQSNGGGEAIPFGSPWWFIYAGVSCILVLFAGIMSGLTLGLMSLGLVELEILQRSGTPNEKKQASAIFPVVQKQHQLLVTLLLCNAVAMEGLPIYLDKLFNEYVAIILSVTFVLAFGEVIPQAICTRYGLAVGANFVWLVRILMILCYPIAFPIGKILDLVLGHDDALFRRAQLKALVSIHSQEAGKGGELTHDETTXISGALIDREN

SEQ ID NO: 18214 - protein, 502 aa, Thermus thermophilus
MEKVFYVTTPIYYVNAEPHLGHAYTTVVADFLARWHRLDGYRTFFLTGTDEHGETVYRAAQAAGEDPKAFVDRVSGRFKRAWDLLGIAYDDFIRTTEERHKKVVQLVLKKVYEAGDIYYGEYEGLYCVSCERFYTEKELVEGLCPIHGRPVERRKEGNYFFRMEKYRPWLQEYIQENPDLIRPEGYRNEVLAMLAEPIGDLSISRPKSRVPWGIPLPWDENHVTAVWFDALLNYVSALDYPEGEAYRTFWPHAWHLIGKDILKPHAVFWPTMLKAAGIPMYRHLNVGGFLLGPDGRKMSKTLGNVVDPFALLEKYGRDALRYYLLREIPYGQDTPVSEEALRTRYEADLADDLGNLVQRTRAMLFRFAEGRIPEPVAGEELAEGTGLAGRLRPLVRELKFHVALEEAMAYVKALNRYINEKKPWELFKKEPEEARAVLYRVVEGLRIASILLTPAMPDKMAELRRALGLKEEVRLEEAERWGLAEPRPIPEEAPVLFPKKEA

SEQ ID NO: 18215 - protein, 251 aa, Oryza sativa (japonica cultivar-group)
MCTSKLEEITGEWPPPALQAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSSDIADVSLWSY

SEQ ID NO: 18216 - protein, 462 aa, Synechococcus sp. WH 5701
MASAREKFERTLVSVQGSLVGSVAALEHPRSHGSLNYGEVFLRDNVPVMIHLLLEGRFDIVRHFLSVCLDLQSSTYQTRGVFPTSFIEENGQLMADYGQRSIGRITSVDASLWWPILCWYYVKRSQDWEFGASQKVQRGVQLLLDLVMHPTFEGTPVLFVPDCSFMIDRPMDVWGAPLEVEVLLFGCLRSCGHLMEIARRDRSSRLLEQRLELTRQWIHDLRSFLLKHYWVTSKTMQVLRRRPTEQYGDHQHENEFNVQPQVIPDWLQDWLENRGGYLIGNIRTGRPDFRFYSLGNSLACLFGLLTAPQQRGLFRLVLHNRSHLMAQMPMRICHPPMEAAEWMTKTGSDPKNWPWSYHNGGHWPSLLWYFGGAILQHEQNHPRADALLMGQAKAMLEECYWSQLNQLPRQQWAEYFDGPTGTWVGQQSRTYQTWTIIGFLLLHHLLRVNPADVSVLSIDAPP

SEQ ID NO: 18217 - protein, 108 aa, Cryptococcus neoformans var. grubii
MGVTVENISAGDGKTFPQPGDNVTIHYVGTLLDGSKFDSSRDRGTPFVCRIGQGQVIRGWDEGVPQLSVGQKANLICTPDYAYGARGFPPVIPPNSTLKFEVELLKVN

SEQ ID NO: 18218 - protein, 203 aa, Triticum aestivum
MMTRSPEPAAEQKASSSFGNLLSIFLRVSSSETKPPRRSFDAEGVVGLGIVAAMSRACLTAQPIAIGAAARRRGREEDELSESYTCVITHMAAGADEGGSMRKRVYFGFGDGGDGWFVEAAEEAPARADDFLSRCCLCNKRLDGLDIYMYRGEKAFCSSECRCHQMLMDDHAEKCGSEALRASSYSASPCSAPMSFSPSVAAA

SEQ ID NO: 18219 - protein, 924 aa, Pisum sativum
MMELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 18220 - protein, 290 aa, Arabidopsis thaliana [sequence omitted]

SEQ ID NO: 18221 - protein, 782 aa, Oryza sativa
MDSIGINRAPLGSSSSAAAVTARRGIALRPARRSVASTNRVGVATIGFGDASGLRACSEKVRRFDSVRSTTARAQNGNAGRSMTEERGCTMSDTEMPFKYSSGKAFPLGVSQVEGGLNFALFSQHASSVILCLKLPGRGTEDEKGADVVEFVLDQQKNKTGDIWHVIVEGLPASGVLYGYRVGGPQGWDQGHRFDSSTVLLDPYAKLVSGRKYFGVAEEKSSQHFGTYDFDSSPFDWGDDYRLPNLPEADLVIYEMNVRAFTADESSGLDSTSRGSYLGLIDKIPHLLELGVNAVELLPVFEYDELEFKRYPNPRDHMVNTWGYSTINFFAPMSRYASAGGGPVAASKELKQMVKELHKAGIEVILDVVYNHTNEADDAHPYMTSFRGIDNKVYYMLDLNKNAELLNFSGCGNTLNCNRPVVKELILDSLRHWVEEYHIDGFRFDLASVLCRGPDGCPLDAPPLIKEIAKDAVLSRCKIIAEPWDCGGLYLVGRFPNWDRWAEWNGKYRDDLRRFIKGDPGMKGVFATRVSGSADLYQVNERKPYHGVNFVIAHDGFTLCDLVSYNLKHNDANGEGGCDGCNDNFSWNCGVEGETNDLNVLSLRSRQMKNFHVALMISQGTPMMLMGDEYGHTRYGNNNSYGHDTCINNFQWEQLEQRRDGHFRFFSEMIKFRHSNPILRRDRFLNKNDVTWHEDCWENQESKFLAFTVHDHNSGGDIYLAFNAHDYFVDAVIPPPPHHKCWNRVVDTNLESPNDIVPEGVPFTGPKYRIAPYSSILLKAKP

SEQ ID NO: 18222 - protein, 338 aa, Francisella tularensis subsp. holarctica
MYILSGDIGGTNTRLEVSLLENGATQSIAIRKYKGANFNCLSDIIDKFLSEVDLVGQIDSVCLAVAGFVSNGEVEVTNLPWMVSEQYISEGLGIDKTKVKVINDFEAIGYGIESLDREKDIITIQEGKKDDDNLCAVVGAGTGLGMCLVSYDKDDKPRVYKTEGGHVDFSPVDDEQVELFKFMRKTFHRISPERFCSGYGIYNIYKYVVRHPLYDQPECMELRRALFSVSDSDKAAVIVKYAIEHREPSALRTIDIFLSIYGSVAGNLALTSLPFRGLYIAGGIAPRLIKQIKESKFLEKFRDKGRMSNVMKDFPVHIIMNTDVGLIGARTYAAGLVK

SEQ ID NO: 18223 - protein, 924 aa, Synechococcus sp. RS9917
MAEIDTLAAEPASVGSPDPAQIFPFPLDGFQLEAIEALNQGHSVVVSAPTGSGKTLVGEYAIYRAIAHRQKVFYTTPLKALSNQKLRDFRAQFGAENVGLMTGDLSVNREASIVVMTTEIFRNMLYAEADAHRDPLADVEAVVLDECHYMNDSQRGTVWEESIIHCPPSVQLVALSATVANAGQLTDWIERVHGPTRLVLSDHRPVPLQFSFCSAKGLHPLLNDQGTGLHPNCKVWRAPKGSKRKGRSPKPPQPEPPPISFVVAQMAERDMLPAIYFIFSRRGCDKAVRDLGAQCLVNENEQARIRERFKAYASANPEAVRDGVHADALLRGIAAHHAGVLPAWKELIEELFQEGLVKVVFATETLAAGINMPARSTVIAALSKRTERGHRPLMASEFLQMAGRAGRRGLDSQGYVVTVQSRFEGVREAGQLATSPSDPLVSQFTPSYGMVLNLLQRHDLAKARELVERSFGRYLASLDLVEEEEILTQLRLQLGQLQGTAGDVPWEDFEEYEKRRGRLREERRLLRILQQQAEETLAHELTLALQFASVGTLVSLKAPQLRGVVTPAVIVEKCDGPGQFPLLLCLTDDNAWLLLPCQAVVSLHAELSCLQVEGVNPPELRRAGELRHGDQQSGGLALAVGHMAQRHDMTTPQYDLAGEVLTQARLVQELEADLEAHPAHRWGDRRQLKKHRRRMEELELEIRERQQMLHHRANRHWETFLALIEILQHFGCLDDLEPTEIGRTVAALRGDNELWLGLALMSGHLDELQPAELAAVFEAISTEVNRPDLWSGFPPPPRAEEALHDLMGIRRELLRAQERAQVVMPAWWEPELMGLVEAWASGTAWNDLIANTSLDEGDVVRIMRRTVDLLAQVPYCEAISEQLRRHARQALKAINRFPVAEAEDLLKAAAAEAGGLNPATERAA

SEQ ID NO: 18224 - protein, 678 aa, Mycobacterium avium subsp. paratuberculosis K-10
MQPGRRHADGARPGCTLKRPGFTLDERTRAARVIQPVRYRWPRAARISDVPFRNVAIVAHVDHGKTTLVDAMLRQSGALHHRGDDTQERILDSGDLEKEKGITILAKNTAVHRHHPDGSVTVINVIDTPGHADFGGEVERGLSMVDGVLLLVDASEGPLPQTRFVLRKALAAHLPVILVVNKTDRPDARIAEVVEASHDLLLDVASDLDDEAAKAAEHALGLPTLYASGRAGVASTEQPADGEVPAGENLDPLFDVLLEHIPAPSGDPEAPLQALVTNLDASTFLGRLALIRIYNGKLRKGQQVAWMREVDGLPVITSAKITELLATEGVERSPTDEAIAGDIVAVAGLPEIMIGDTLADPDHAHALPRITVDEPAISVTIGTNTSPLAGKVPGHKLTARLVRNRLDQELVGNVSIRVVDIGRPDAWEVQGRGELALAVLVEQMRREGFELTVGKPQVVTRTIDGQLHEPFEAMTIDCPEEFVGAITQLMAARKGRMEEMTNHAAGWVRMDFIVPSRGLIGFRTDFLTITRGTGIANAVFDGYRPWAGEIRARHTGSLVSDRAGTITPFAMIQLADRGQFFVEPGQDTYEGMVVGINPRAEDLDINVTREKKLTNMRSSTADVSETLAKPLELDLEQAMEFCAADECVEVTPEIVRVRKVELDATSRARSRARAKARG

SEQ ID NO: 18225 - protein, 552 aa, Francisella tularensis subsp. holarctica
MIKKFLRLIYIFYVINKYCLLNEPIRATKIKTLRALLLLNPFYYSRRVRRLEHGVRIREALEKLGPIFIKFGQALSVRADLLPPDVIKEVSKLQDNVPPFDNKIAAEQIEKAAKKPINEIFKSFESSPLASASVAQVHAAILQNDDKVVVKVLRPGIEKILKLDTSLMLFFATLLSKLKEIRRFKPVEIVKEINQSFFDELDLVREASNASQIRRNFEDSAIHYVPKIYWEYTSSTVMVMERVGGVRVSDIETLDALGVDRRLLAQRGVEIFYSQVFDDCFFHADMHPGNMFIDVSNPADPKYISIDFGIVGTLNRDDQRYLAGNFLAFFKRDYRKVAELHIESGWVPSDTRVDVLESAIRTVCEPIFEKPMKEISLGYTLMQLFAVARRFNMNIQPQLTLLQKTLFHVEGLGQKLYPELNIWETSRPILEKWMKEQMGLRGFYHRSMENMPRVSDKLPELPRMVFDILQQTQINLKNTTTSTQFNNLKEPKKKYRFALGCGLVLTTIGVIYTLNKDTTPLIKLQNFISNYSTSFIIVGVACLIYYSFKKEK

SEQ ID NO: 18226 - protein, 574 aa, Aspergillus oryzae
MQSSLLLRARGLPLAKSSFARSSIRAMGSYATFKVPRIDNEPNKHYAPGSPDRKGLEEALAKHKQSAPLTVPLVIAGKEIKSSETFTQANPATHAPLATYSHATASDVQAAIDAALKARESWASTSFAERASIFLKAADLISTKYRYDIMALTMHGQGKNAWQAEIDSAAELCDFFRFGVKYAEDLYAQQPVHNSPGVWNRVEYRALEGFVYAISPFNFTAIGGNLAGAPALMGNVVVWKPSPSAIASNWLVHEILLEAGLPKNVIQFVPGDAEEVTNTVLNHPEFAALHFTGSTSVFRSLYGQIANRVAEGKYRSYPRIVGETGGKNFHLIHKSADIRNAAVQTVRGAFEFQGQKCSATSRAYVAASVADEFLEQVATETKNLKVGEPTDFTNFCGPVIHEASFNKLAKVIDEAKNDPELELLAGGTYDSSKGWYIQPTVYRTSNPDHPLLSRELFGPVLVVHAYNDATEADFTKICEKIDQTGEYGLTGAVFAQDREALRQADDALRNTAGNFYINCKSTGAVVGQQPFGGARASGTNDKAGSGNLLSRFVSLRSMKEEFVPTYNVAYPSNA

SEQ ID NO: 18227 - protein, 479 aa, Aspergillus oryzae
MKAARRPLRPLAGTPSSVLTPRYVSRTSNPKSSVATSTTTTNNVWQQEPQTPKQELSPLAKLPISSVLRSLVILSVSSSSLLLKPCIKTLSMLAHPKTALLDVAKNPLLNMLVKHTIYKQFNAGENKLEVQRSIEDIKRLGYRGVLLGYAKEVLVGESNVDPKDEQAAREEIQMWLDGTLQTVDMAQEGDFVALKFTGMGVQALDVLQRQAAPTEFMDRAIQKVCDLAISRNVRLLVDAEEQAVQPGIEEWTMKYQKYCNSQTPGRAIFYNTYQAYLCSTPTTLAKHLEISRQEGYTLGVKLVRGAYLKTEPRHLIWSTKEETDQCYDGVVEALLTRKYNSMLKSASEKHQTDLPSVNVIIATHNRDSVRKAHALRTEQAMKGENHGVDLSYAQLQGMADEVSCELLQGFQSAEVMKGASMESPNVFKLLTWGSVKECMGFLMRRAIENTEAVGRTKQSQEAMFEELKRRARLAFRRSN

SEQ ID NO: 18228 - protein, 500 aa, Euphorbia lagascae
MEQKNLSFPSILISFLLVLILVVVMRLWKKQNPPPGPWKFPIIGNLPHLLLTSDLGHERFRALAQIYGPVMSLQIGQVSAVVISSAEAAKEVMKTQADAFAQRPIVLDAQIVFYNRKDVLFASYGDHWRQMKKIWILEFLSAKKVQSSRLIREEEMEDAITFLRSKAGSPVNITKIIYGIIISIMIRTSVGNCKQKERLLSVADAVNEAATSFGTADAFPTWKLLHYIIGAESKPRRLHQEIDDILEEILNEHKANKPFEADNLMDVLLNLQKNGNVPVPVTNESIKASVLQMFTAGSETTSKATEWVMAELMKNPTELRKAQEEVRQVFGEMGKVDESRFHDLKFFKLVVKETLRLHPPVVLIPRECRETTRIDGYEIHPNTRIVVNAWAIGRDPNTWSEPGKFNPERFKDCAIDYKGTTFELVPFGAGKRICPGITSAITNLEYVIINLLYHFNWELADGITPQTLDMTEAIGGALRKKIDLKLIPIPYQVSLGSNIS

SEQ ID NO: 18229 - protein, 686 aa, Vitis vinifera
MQDIFGSVRRSLVFRPASGEDGEYGGYGGPAEKIWFSIRKSGIGLFSRQSVRALPPIPKDEAPSTRWRKGELIGCGAFGRVYMGMNLDSGELLAIRQVSIAANSASKEKTQAHIRELEEEVKLLKNLSHPNIVRYLGTAREDESLNILLEFVPGGSISSLLGKFGSFPESVIRMYTKQLLLGLEYLHKNGIMHRDIKGANILVDNKGCIKLADFGASKKVVELATMTGAKSMKGTPYRMAPEVILQTGHSFSADIWSVGCTVIEMATGKPPWSQQYQEVAALFHIGTTKSHPPIPEHLTAEAKDFLLKCLQKEPNLRPAASELLQHPFVSGEYQEPHPVFQTSVMENSGNMMATSETDLKSFPNPVIRRSNCTSSNNVCNMGSVRCSTVYPEKFSGTGPLWGANSCDDDMCQIDDKDDFIVHQSVKFGSAILSDHLNKSFNPMCEPTDDWPCKFDESPELTKSGANLSSHQTISKPAGSPRASNERENDFTFPCGPLVGDDDDEVTESKIRAFLDEKALDLKKLQTPLYEEFYNSTLNAAGPPSAVGKSHDNVTNFLNLPPKSRSPNRTPTRRLSAAVDAACTSNSANHTKRGLNVGTISDRTLKEIQSPQLSEWKELLLDAQQEPVSLSTNFSERRRKWKEELDQELEKKRELLRQAGVGGKTASPKDQILNRPRERLRFAFPGK

SEQ ID NO: 18230 - protein, 526 aa, Magnaporthe grisea 70-15
MLSRLAIRTLRAPALQGLGRTTAARQTTSLLAARTWTRGMAKNNKPAPTPSQQTSKSNAPSEEQASSPAPKQSENATKPEASDAQPEQVPFNLPDLTKGLPSTFEYEASGADKASKMALEGVASAGGRGKGELPASAYVSSSDRRRQKVAQWVFYGFVAGGLFGVVFLGRNWEDEEERAKHADVPDGWTPVLWWKRAMARMGDTVSYYQEPAFEKLLPDPDPVNSPPYTLCISLEDLLVHSEWTRDHGWRVAKRPGVDYFIRYLSQYYELVLFTSVPYGIAEPLWRKMDPFRFVQWPLFREATKYVDGKIVKDLSYLNRDLSKVIIIDTNPEHVSAQPENAIILPKWTGDAQDKDLVALIPFLEYIHTMQYPDVRKVLKSFEGKNISEEFARREAIARKKFQEQLEQNRKKHPNKPGAGVFGALGNAFGLKPSKMSMMVPVEGEESVADALAQGKMLQDIARERGQRQYERIDKMVRENGEKWLKEEAEMMEKMQAEAMANMKTGFMGWFGSSEQKDGAKDEPKKA

SEQ ID NO: 18231 - protein, 450 aa, Lactobacillus plantarum WCFS1
MKVIVIGCTHAGTAAVNQILASNPDTEVTIYERNDNVSFLSCGIALYLGGQVADPQGLFYSSPEQLAKLGATVHMQHDVTDVNTDKHEITVTDLKTGESKTDHYDKLVVTTGSWPVIPPIDGIDSPNVYLCKNWTHAQNLWEAAKPAKRVIVIGGGYIGTELVEAYQKQGKEVTLIDGLPRILNKYLDKEFTDRVEQDFVDHGIKMALNQMVQGFSDDGKEVTVKTDKGSYTADMAILCVGFRPNTGLLKGKVDMNANGSIKTNDYMQTSDPDIYGAGDSVAVHYNPTKKDAYIPLATNAVRQGTLVGLNIFKPTRKYMGTQSTSGLMLFGQTIVSSGMTLEHAQAENVPAAAVTFEDNYRPEFMPTTKPVLMQLVYNPETREILGAQFMSEHDVSQSANVISVMIQNHNTIDDLGFVDMFFQPIYDRPFNYLNLLGQAAIAHAAEAVTE

SEQ ID NO: 18232 - protein, 481 aa, Acidobacteria bacterium Ellin345
MGIGAVIGSGIFTVIGTAIAGQKFDTSSILNAPLLDYIIHHTATTGRPGAGPALALSLVLVALVCAFTALCYAELASMIPIAGSAYTYTYATMGELIAWIIGWDLILEYAVSNMAVSVGFAAHLVDAFDWFGWHPNPRWISPAYLPSGLTDLQGGTIYNTGWHFGFNIPAFLIVMLLTVVLVRGIRESAETNNIMVLLKIGAILAFVVAGMKYIHPTNYHPFAPQGWPGVLTGGSIIFFTYIGFDSVSTAAEEAKNPQRDLPIGIIATLVICTVLYIAVAVVLTGIVKWDTLIDDAAPVVNSLKKLGLMSHSKGLHWTRLVVLFGAMMGMISSLLVFQLGQARVWFAMSRDGLLPKLFGRVHPKFRTPSTATWIAGVLVGIPAGILDIGTLADLSNIGTLFAFVLVSLGVIILRFKQPERRRGFRAPGGLTAPILSVVFCILLMSGLPILTWLRFFAWLIIGMSVYWLYSRHRSEFAPVRK

SEQ ID NO: 18233 - protein, 345 aa, Xanthobacter autotrophicus Py2
MKAAVIHAAKDLRLDECPEPEMAANEVLVSFRAGGICGSDLSYYGKGRVGDFALRQPMVLGHEISGEVIKLGASVSTLALGDHVAVNPSRPCLECDYCRAGRSNLCRNMRFFGSAAIYPHVQGAFSETFVCRADQCVSVPRDIPFRRVAMAEPLSVAIHGVRRAGELAGKRVLIAGAGPIGMLLAIAARRVGASYIAITDIVDAPLELARAAGVDETINVATAPEQLARYEKDKGFFDAALEATGVPQALASLFKVVRPGGRVVQLGMMPPGDVPVPANMLMAREIDFVGAFRFSGEFATAVDWLVRGLIDVEPVMSADLPMSRLDEAFQLAADRSRAIKVHLHF

SEQ ID NO: 18234 - protein, 557 aa, Gibberella zeae PH-1
MGGAPTTVGTYDAALQRRQALMGASGARALVKNWKVFRIAAFACIGGILYGYNQGMFSGILVMKSFERHMGDYVQNKTKKGWLTSILELGAWLGTLMSGAIAELCSRKYGILIATSVFIIGVVIQCTAMQAGHNAILAGRFITGMGVGSLSTIVPLYNSECAPPEVRGALVALQQLAITFGIMVSFWIDYGTHFIGGTGEGQSDAAWLIPVCLQLGPAIILFIGIMWMPFSPRWLTHHNREEEARQVLANLRDLPTDHELIELEFLEIKAQSLFEKRSLAEKFPHLQEQTAGNTIKLQFVAIAALFKTKAMFKRVIVATVTMFFQQWTGINAIFEQLGLSSNTTSLLATGVVGIVMFIATIPAVLWIDRLGRKPVLAVGAIGMGLCHLIIAVILARNIDQFDTHPAAGWAAICMVWLFVVHFGYSWGPCAWIIIAEIWPLSTRPYGVALGASSNWMNNFIVGQVTPEMLDGITYGTYILFGLLTMIGAAFIWFFVPETKRLSLEEMDIIFGSEGAAQADNERMAEINREIGLDDLIYRSGAVHSNEDIHQDVKDVKE

SEQ ID NO: 18235 - protein, 295 aa, Medicago truncatula
MEGSLPIIVVASGGLVSPLLVLVVRERMKRSFMSFVIVCTLIREWIFNNLNKKGIGDNPATWQTTFMTTCWYLCNWRNKSIFEIGFQRPSNPTLVIQKFTREIEDNTKLVHKSSHQKETIYIGWMRPPFGWVKLNCDGAWKGSGTLAGYGGLLRDSDGRWIKGYFKKIGMCDAFHAEMWGMYLGLDMAWRENTTHLIVESDSKILVDMITENCNFSGTTPTLVRRIRQLLSLSWTVKITHTWREGNRSADWLANFSISTDFLDFHILETPPSELQSLLFDDISGACMPRNVRLIS

SEQ ID NO: 18236 - protein, 534 aa, Gibberella zeae PH-1
MSSHKDEVKDETTVATPHDEELGSTDGEGQLKRHLQNRHMQMIAIGGAIGAGLFVGSGSALHKGGPAALVIGYLIIGIMLLCTNLALAEMAVLYPVNGAFYTYIVRFVDPSWGFACGWEYALSWLTVLPFELIAASKTIEFWRSDIHMAVWVTVFLVALTIVQIFGVRGYGEVEFVLSAIKIAACLGFIILGIIINCGGVGDQGYLGTKYWHDPGAFTDFKGFCAVFVVAAFAFGGTEMVGLAAAETADPRKSVPTASKQVFWRIALFYVINLFIVGTILRSDDDRLQGASGANTKASPFVLAIQDAGIKVLPSIFNAVITISVLSVANTCTFGSTRTMQAMAMRGHAPKFLNYIDGKGRPIYCVIIQLGFGLLAYIGESPKGGTIFDWLLALSGLAFLFVWGTICLAHARMRSGMKAQGVNMNLIPYKTPFGVWGSYLGVFLNVLALVATFYSALFAPDGSAPNAESFFMSFLAGPIILVLYLGYKVYSRDWKLYVRAIDMDLQTGISLLDEEIPEEPKTWASLPRRILSAVI

SEQ ID NO: 18237 - protein, 373 aa, Arabidopsis thaliana
MEVCGDLKSDNLKNRPLTPLRILRGLMILLVFLSTAFMFLLYFAPIAALGLRLLSVQQSRKVVSLIFGLWLALWPYLFETVNGTTVVFSGDIIPVEKRVLLIANHRTEVDWMYLWNIALRKGCLGYIKYVLKSSLMKLPIFGWGFHVLEFIPVERKREVDEPVLLQMLSSFKDPQEPLWLALFPEGTDFTEEKCKRSQKFAAEVGLPALSNVLLPKTRGFGVCLEVLHNSLDAVYDLTIAYKPRCPSFMDNVFGTDPSEVHIHVRRVLLKEIPANEAESSAWLMDSFKLKDKLLSDFNAQGKFPNQRPEEELSVLKCIATFAGKQQQVTKPSCQKVFLLLNQSSDEKESKKAVAQHPFTDTLDHLFQVQMSSG

SEQ ID NO: 18238 - protein, 353 aa, Glycine max
MEKVDQAFIQYPQHRPNLTIIQPEHIPIIDLSPITNHTVSHPSPIEGLVKEIGNACKEWGFFQVINHGVSLTLRQNIEKASKLFFAQSLEEKRKVSRDESSPMGYYDTEHTKNIRDWKEVFDFLAKDPTFVPLTSDEHDNRLTQWTNPSPQYPPHFRDIIKEYVEEMEKLSFKLMELIALNLGLEAKRFEEFFIKDQTSFLRLNYYPPCPYPHLALGVGRHKDSGPLTILAQDEVGGLEVRPKADQDWIRVKPIPNAYIINLGDMIQVWSNDAYESVEHRVVVNSEKARFSIPFFLFPAHDTVVKPLEELINEQNPSKFRPYKWGKFLVHRLDSNFKKQNAENVQTYHYKIRE

SEQ ID NO: 18239 - protein, 291 aa, Roseovarius nubinhibens ISM
MLKGSLPALVTPFKNGALDVDTLKHLVEWHINQGSHGLVPVGTTGESPTLSHEEHEAVVEIVVKAVNGRIPVVAGAGSNNTAESLRFMEHAKKVGADAALVVTPYYNKPTQRGLIAHFKTLHDACDLPIVIYNIPGRSVVDMLPATMGELAKLPRIIGVKDATGDLARVCQQRITCGTDFLQISGEDATAHGFNAQGGVGCISVTANVAPKLCAELQEATLRGDYAEALKIQDRLMPLHQAIFTEPGLVGVKYAMSRLDLCSAEVRPPLTPLLDETKALVDAGLRHAGLLN

SEQ ID NO: 18240 - protein, 284 aa, Aspergillus oryzae
MASARSLMRLGTGRSLASAARSSRMCRPFSTTPLLKESIPEPPNMRQAQRPPEGALRAPIVNPADKYQDKADALHQYGQYVMSCLPKYVQQFTVWKDELVIYVPPSGVVPLMSFLKYHTAAEFTQISDITAVDFPTKDQRFEVVYNLLSVRHNSRIRVKTYADEATPVPSVTGLFEGALWYEREVYDMFGVFFTGHPDLRRIMTDYGFDGHPLRKDFPLTGYTELRYDEEKKRIVIEPLELTQAFRNFEGGTAAWEPVGTGVDRTPESFKLPTPKPEEKPEEKK

SEQ ID NO: 18241 - protein, 713 aa, Bacillus cereus ATCC 10987
MLKVKRPFDAYLDEMNKITILLPHAYGTSRTFRLQEGSNVKDLPIAHTIALPDATKYECFIEEPLDVGKYYTVRDERNEETDLQIGAVIRTAIFDEKYYYEGTDLGAVHQKEATTFKVWAPTARLAKVRIYKSDKEYTDYEMYREENGVWAHTLHGDLAGEKYTFLVCINLIWNEAVDPYAKSVTVNGKYGVVIDLEKTNVTKRGQLPPLQAMTDAILYELHIRDATIHPGSGVSKKGTYKGLMEEGTTGRNGTLTGLSHIKDLGVTHVELLPLYCFGGVDEANPSSAYNWGYNPLYYNAPTGYYATNPSDPYNRIVECKQLIETFHEHGIRVIIDVVYNHVYERELSSFEKLVPGYYFRHGENGMPSNGTGVGNDIASERKMMRKFIVESILYWLTEYNVDGFRFDLMGILDVDTINIIEKEVRNIKRDALLLGEGWDLQTPLPLEEKATLNNAKKMPHIAQFNDQFRDGIKGSTFHINKRGFAFGGYVDCNHLQYIASGSLLSMKETGLFLEPVQSINYVECHDNMTMWDKLMRSNEESEEILKKRHLLATAMVILSQGIPFLHAGQEFYRTKQGNENSYNANDEINQLDWDRKEKEIETVNYIKGLIAIRKEHGAFRLQNADLIKKHMTFLQTSPEVLAYHLEHVESFGPWKEIVVLFNSSLEAKTVQLPKEETWHVLVNEKQAKIEPISSFRGKELRLAPISTYILTIM

SEQ ID NO: 18242 - protein, 315 aa, Clostridium perfringens SM101
MNKVFCIGELLIDFIGKDIGKGLKNGVNFEKKAGGAPANVGAAVCKLGGESYFLGQVGNDSFGEFLVDMLKNIGINTEMTKMDGYTTLAFVAIDEKGERDFEFHRGSDGEYSFNNIDLSKIEKDDIIHFGSATGFLKGELKNTYFKLLEVGRKNGNFISFDPNYRDMLIKEEGIEEFKEDCKKFISSCDFLKLSDEEIKLLTEEEDLERGVEKLHSLGAKIIAVTLGGKGTLLSNGIHLEIVPSIKINQVDSTGAGDAFVGAVLKKVSELKDKKNLDLNSWREIISYGNKVGALTCTNYGAIDAIPNEEDLMKYI

SEQ ID NO: 18243 - protein, 488 aa, Yersinia pseudotuberculosis IP 32953
MKIVNHWIDGKNITSKDYFTTINPATGEVLADVASGGIKEINQAVAAAKSAFPHWANLPMKVRARLMRRLGELIEQQIPEIAQMETQDTGLPIYQTQNALIPRAAHNFEFFAEICQQMNGQTYPVDDQMLNYTLVQPVGVCALVSPWNVPFMTATWKVAPCLALGNTAILKMSELSPLTADKLGELALEAGIPAGVLNVVQGYGATVGDALVCHQDVRAISFTGGTATGNRIMQRAGLKKYSMELGGKSPVLIFDDADIERAMDAALFSIFSLNGERCTAGSRIFIQESLYSAFIQRFAERASRLRVGDPQDLDTQVGALISKPHWDKVSGYIQLGIEEGATLLAGGPDKPIDLPAHLRGGHFLRPTVLADVDNRMRVAQEEIFGPVACLIPFKNEDAGLRLANSVPYGLAAYIWTQDVSKVLRLARSIEAGMVFVNTQNVRDLRQPFGGIKASGTGREGGKYSFDVFAEVKNVCISMGEHPIPRWGM

SEQ ID NO: 18244 - protein, 455 aa, Aspergillus oryzae
MGHLQQQSPMIPLSSPADPSVPTMIKKDRLARDELSLLSLTPPDVINSALSTTKDGHADASVSTAIHVISTERAALAHLERLYETNALAQESLARAVSQIARSVRSGGKLVCCGVGKSGKIAQKLEATMNSLGIYSAFLHPTEALHGDLGMIRPQDTLLLISFSGRTPELLLLLPHIPSTVPIIAITSHLHPSTCPLLSFQPSDMGILLPAPIHEDEELSIGVCAPTSSTTVALSLGDALAIATARRLHTSPGRGPAEIFKSFHPGGAIGAASNVLTPMSMSTASFPSTTSDDLSSQQQSVASLPQSEDTQRIIDKLVPIDQIPAVSTSTGTIRLLDILLTAIQHPTAKSWVHLSPSEIIPPRHLRSLSQTNYVDMDTSALASLGLPFSVPRDDWLRLPSSTSLDDARRLVSESTAAAGAVIAVMQDENPDACLGFFEAEDLWDGFISTGVVSGV

SEQ ID NO: 18245 - protein, 214 aa, Triticum aestivum
MPTPYSAAALQQHQRLVSSSGGLAATGAHRCGEHDGTVPPEVARHHEHAAPGGRCCCSAVVQRVAAPAADVWAVVRRFDQPQAYKSFVRSCALLDGDGGVGTLREVRVVSGLPAASSRERLEILDDERHVLSFSVVGGEHPLRNYRSVTTVHPAPGESASATLVVESYVVDVPPGNTPEDTRVFVDTIVKCNLQSLARTAEKLAGRGAAYGALP

SEQ ID NO: 18246 - protein, 243 aa, Synechococcus sp. RS9916
MRKPVIAGNWKMHMTCAQAREWMAAFLPLISATPNDRHLVVAPPFTAISTMAELAKGSSVELSSQNVHWEGHGAYTAEIAPSMLLEHGVGYAIVGHSEPRKYFSESDEQINHRARSAQTNGLIPIVCVGESDEQRTRGEAERVIRRQVEQGLEGLDPAKLIVAYEPIWAIGTGKTCESSEANRICGLIRSWVGSPDLIIQYGGSVKPGNIDELMSMSDIDGVLVGGASLEAESFARIANYQAG

SEQ ID NO: 18247 - protein, 257 aa, Arabidopsis thaliana
  misc_feature (17)..(17): Xaa can be any naturally occurring amino acid
  misc_feature (80)..(80): Xaa can be any naturally occurring amino acid
  unsure (1)..(257): unsure at all Xaa locations
MASSMLSSAAVVTSPAXATMVAPFTGSKLFAAFSVTRTTNKDITLIVSNGGRVSCMNVWPPIGKKKFATLSYFPDLSDVXLAHEVDYLLPIKCISCVALPLQHGLVVRALRAHFPLTFDGLALWPIRALLHFPRAPDSLSSLSLLSPFLHQCVLLSFPFTTNWFPSITLYSYSIPLIVFSLPLLTFLYSFLYTLFLHLLPIYSSSLLSPLLSPISHCPFTILLSYSTPSSLPLIYLVWLVLIFPYFLPFSPPSLPPF

SEQ ID NO: 18248 - protein, 214 aa, Brassica napus
MTSFSAFSEMLGSEYESPTLSGEYCPTLAASCPKKPAGRKKFRETRHPIYRGVRLRNSGKWVCEVREPNKKSRIWLGTFLTAEIAARAHDVAAIALRGKSACLNFADSAWRLRIPETTCPKDIQKAAAEAAVAFQAEINDTTKDHGLDVEETIVEAIFTEENSDGFYMDEEESMFGMPTLLASMAEGMLLPPPSVQFEYNYDFDGDTDVSLWSY

SEQ ID NO: 18249 - protein, 108 aa, Frankia sp. EAN1pec
MSLSTHVLDTASGKPAAGVPVRLERAAVTLDGATKGWRPVAQAVTDDDGRVGDLPADRAGAWRLVFDTTGHSAFYPEVAIVFVIREPADHHHVPLLLAPYGYSTYRGS

SEQ ID NO: 18250 - protein, 578 aa, Lactobacillus plantarum WCFS1
MTNNNEERPQWQVNQNRHTRFRTIVSVLRRYNVLSNLARQKNPDQVRAAFEELGPTFIKIGQILSSRTDIVKPEFANEFKKLQNNVRADDFSVVKQTIEQQTGKPINEMFAQFDERPFASASMGQTHHATLLNGQKVVVKVQHPGIDAEVALDISLFERALPLLRYIPESSVVDLREMVGEIKRSLFNELDTSIEVKNGLRFYRLNNADDIIRVPRVYAKYSTQKVLVNQYMPGTTIQHFMAQMLAADEDGNHQYDDERRYLAHVLVQNFLKQVFEDGFFHADPHPGNILLRELQPDDIGYHDTVPKHGGKIGKRQLPPYRLVYLDFGMMGEISPALMAGIANVVVAVTTEDTHQVGKAILAISNRTGVVDEEAFFSELAPFLSQYYNSGLGDIDFQGLLFEMVKVCRSNNIQMNPAVTMLGKAFGTIEGIVETLDPTLSMMDVARPFARKYIRENFNWRNELEDGMLASLQSLRDAPKIPSRLLSALDTFENGQTRVNLVFAHRKMFIDRIDSMVNKIVLSVILAALIVGSSLLVQSHPDNSWITNIGIFGYVSAVVVIIGLLIGTLHSWYTHWRRK

SEQ ID NO: 18251 - protein, 691 aa, Frankia sp. EAN1pec
MASPPSSWAWPRCGPRHAAAGTASSTSSGGCAPAPPTWSGWAPRDWLPRDWAPRDWAPAGRAPCRTAPRDASPLAPTPTWWSSTPTPRSSSNRPCCATAIRSRPTLGERLTAWFWRRTCGDGGRTVTGPREAGCSPDDPPATPQPVPALSPFPAARTVRPPRPPEQKEPARMTDAPDLTNLVDLAAARFGGSVVAVNDEFFALAERMLLAEAPIVRPGVFTERGQWTDGWETRRRRDLPAADWAIVRLGAPGIVHAVTVDTTHFTGNAPESVELHGATLAGYPSAEDVAEDSVTWVPLVARTPVAADAVNVLPVSAEGRLRISHLRLTIHPDGGVARLRVHGVVVPDPRLLDRVTSDLAAAYLGGVVVAASDMHYGDRHNLNASGDARAMGEGWETRRRRGPGHDWAVVRLATEGTVVRAEVDTRHFRGNAPRAVALWAANAPTTGDDDLATDALSAITDWRPLLPRTRVQPNTRHLFDLEVPVEATHVRVDAIPDGGLARLRLVGAPTEAGRESLAMRWFDSLTPAAAREELLACCGSEDWADAVTALRPFDTLATLLPAAEQEWWNLPETAWLEAFTAHPRIGERPTPAPTPPTSSRATVVSLDAPRREQAALDQASEDVRAAFAEGNAEYEDRFGFIFLVRAAGRGAQEMLELLRERMANDPRTELRVAAGQQAEITALRLRHLITGA

SEQ ID NO: 18252 - protein, 1107 aa, Synechococcus sp. RS9916
MPRRSDLRRILLLGSGPIVIGQACEFDYSGTQACKALRADGFEVVLVNSNPASIMTDPELADRTYIEPLTPEVVTRVIEQERPDALLPTMGGQTALNLAVALAENGTLERYGVELIGADLPAIQKAEDRQLFKQAMERIGVKVCPSGIASSMEEAEAVGAAIGTFPRIIRPAFTLGGSGGGIAYNPEEYAAICKSGLEASPVSQILIEQSLLGWKEFELEVMRDQVDNVVIVCSIENLDPMGVHTGDSITVAPAQTLTDREYQRLRDQSIAIIREIGVATGGSNIQFAINPDDGDVVVIEMNPRVSRSSALASKATGFPIAKIAARLAVGYTLDEILNDITGKTPACFEPTIDYVVTKIPRFAFEKFRGSPAVLTTAMKSVGEAMAIGRCFEESFQKALRSLETGLSGWGCDRPDVSMPAAELERSLRTPSPDRILAVRAAMVEGRTDAEIHALSRIDPWFLAKLRTLINAEASLLKGRSLEQLDADVLLQLKQLGYSDRQIAWATGSDELSVRQHRQQQGIAPVFKTVDTCAAEFASTTPYHYSTYERPVRRLTGAGALEALPMASEVQPEDRRKVMILGGGPNRIGQGIEFDYCCCHASFSAQDGGYATVMVNSNPETVSTDYDTSDRLYFEPLTLEDVLNVIEAERPEGVIVQFGGQTPLKLALPLLDWLSSDAGRSTGTRILGTSPESIDRAEDREQFEAILRELEIRQPRNGLARSEEEARSVAERVGYPVVVRPSYVLGGRAMEVVFDEQELNRYMVEAVQVEPDHPVLIDQYLENAVEVDVDALCDRENTVLVGGLMEHIEPAGIHSGDSACCLPAVSLGEQALGLIRRWTEALAVALKVQGLINLQFAVQRDASGEEIVYIIEANPRASRTVPFVAKATGVPLARIATRLMTGETLAEVGLTDEPKPPLQAVKEAVLPFRRFPGADSVLGPEMRSTGEVMGSAQDFGMAYAKAELAAGDALPTSGRVFLSTHDRDKQALVPVARRLIELGFELTATSGTAAVLTEAGLEVSSVLKVHEGRPNIEDLIRSGGIQLAINTPIGRQAAHDDRYIRRAALDYSVPTVTTLAGACAAVEAIAALQAESLTIHALQDVHRHGVSH

SEQ ID NO: 18253 - protein, 202 aa, Brassica rapa
MALLGGVRDVPAYQNSDEVESLARFAVDEHNKKENVLLEFARVVKAKEQVVAGTMHHLTLEIVEAGKKKLYEAKVWVKPWLNFKELQEFKPASDGAPSITPSDLGCKKGEHESGWREVPGDDPEVQHVADHAVKTIQQRSNSLFPYELQEVVHANAEVTGEAAKYNMVLKLKRGDKEEKFKVEVHKNHQGVLHLNHMEQHHD

SEQ ID NO: 18254 - protein, 370 aa, Roseovarius nubinhibens ISM
MRTRAAVAVEAGKPMEIMEVNLEGPKAGEVLVEIKATGLCHTDDFTLSGADPEGAFPAILGHEGAGVVLEVGPGVTSLEPGDHVIPLYTPECRQCEYCLNPKTNLCQSIRETQGKGVMPDGTSRFSMLDGTPILHYMGCSTFSNHTVLPEIALAKIRKDAPFDKVCYIGCGVTTGIGAVINTAKAEIGSRAIVFGLGGIGLNVIQGLRLAGADQIVGVDLNDDKAVMAKKFGMTDFVNPSKVKGDLVGHLVELTGGGADYTFDATGNVQVMRTALEAAHKGWGESIVIGVAPAGAEISTRPFQLVTGRVWKGTAFGGARGRTDVPKIVDWYMDGKIEIDPMITHTMPLDDINKGFELMHSGESIRSVVIY

SEQ ID NO: 18255 - protein, 503 aa, Arabidopsis thaliana
MDFFHSREKRHGKRAGLFGHKSASKSNPSSPPHLAEGRSQPTTHFGMKRSESEYAFPISDEQTTHWKPQQQASERIPNSHQRPPVYRYSTPERPREPDEDVTPRSNGSGSPFRSARTRTPDRRKRSSEITKELYERMYEADANHERGRDYSRERYEAEGNVTSRNRPSSPFHPSQSRSPPPHARTQRYNNGKDHFEGMYEADADITPRNSPPMSPVHQHTSYSPPPPFYSSSDDEDDNNSTYLFPEIATGRRSRGVSGSSTPVHYKYQITSVETYEQERQFEPPELPDESQSFTMQEIARMRGLQSYGKEEIQLAISETYVSVANYKVRMSIAATLEAIIDKHGDIAASSKLQSTSTRSFYLESLAAAVMELKSTALRDLTKTRVAEIAAVVKDMDSVKIDVSWLKTAVTELAEAVEYYGKYDTAKIVREECDREMTAGKKEMEEMREELRRREKETKECRERVTELAGRLGQLEMKDVRVKKNLELYESKVLKFDGHSVLVD

SEQ ID NO: 18256 - protein, 411 aa, Arabidopsis thaliana
MEEKVVAVIMVGGPTKGTRFRPLSLNIPKPLFPIAGQPMVHHPISACKRIPNLAQIYLVGFYEEREFALYVSAISNELKVPVRYLREDKPHGSAGGLYHFRNLIMEDSPSHIFLLNCDVCCSFPLPKMLEAHRGYGGIGTLLVIKVSPESASQFGELVADPVTNELLHYTEKPETFVSDRINCGVYVFTPEIFNAIGDVSTQRKDRATLKRVSSFEALQPATRIPTDFVRLDQDILSPLAGKKRLYTYETMDFWEQIKSPGMSLRCSGLYLSQFRLTSPQLLASGDGTRSAIVIGDVYIHPSAKVHPTAKIGPNVSISANARVGPGVRLMSCIILDDVEIMENAVVTNAIVGWKSSIGRWSRVQAEGVYNSKLGVTILGDSVAVEDEVVVTSSIVLPNKTLNVSVQDEIIL

SEQ ID NO: 18257 - protein, 327 aa, Medicago truncatula
MGKEIPQTQAILNCIDLSNPNIDHNVDLLKQSCTDSGFFYLINHGISQDFMDEVFAQSNTFFTLPLNEKMKLLRNDSHKGYTPVLDEILDPQNQLHGDYKEGYYIGVEDNDSLHHKPFYGPNQWPASDVLPGWRETMEEYQRRALEVGKALARIIALALGLDGNFFDKPETLREPIAILRLLHYQDKVSDPSQGLYAAGAHTDYGLITLLATDDVQGLQICKNKDAKPQIWEDVTPLKGAFIVNLGDMLERWSNCTFKSTLHRVIGNGQERYSIAYFLEPGHDCLVECLPTCKSDENPPKFPPIYYRDYFSQRFKETHADLHVYSKQ

SEQ ID NO: 18258 - protein, 505 aa, Arabidopsis thaliana
MDFFHSREKRHGKRAGLFGHKSASKSNPSSPPHLAEGRSQPTTHFGMKRSESEYAFPISDEQTTHWKPQQQASERIPNSHQRPPVYRYSTPERPREPDEDVTPRSNGSGSPFRSARTRTPDRRKRSSEITKELYERMYEADANHERGRDYSRERYEAEGNVTSRNRPSSPFHPSQSRSPPPHARLQTQRYNNGKDHFEGMYEADADITPRNSPPMSPVHQHTSYSPPPPFYSSSDDEDDNNSTYLFPEIATGRRSRGVSGSSTPVHYKYQITSVETYEQERQFEPPELPDESQSFTMQEIARMRGLQSYGKEEIQLAISETYVSVANYKVRMSIAATLEAIIDKHGDIAASSKLQSTSTRSFYLESLAAAVMELKSTALRDLTKTRVAEIAAVVKDMDSVKIDVSWLKTAVTELAEAVEYYGKYDTAKIVREECDREMTAGKKEMEEMREELRRREKETKECRERVTELAGRLGQLEMKDVRVKKNLELYESKVLKFDGHSVLVD

SEQ ID NO: 18259 - protein, 374 aa, Clostridium perfringens SM101
MKKVLILSTSTGYGHNQAANSLMELIKNDDTEILVHDFLKENRFFDRSIVNGYDLCASSLGTLYGLLYKISNIKFINNLVSFLFLPVANKLVKFIHSFNPDLIITTHPLAVSILSYLKKRQIIKVPVISVVTDFKCHYTYVSKIIDHYIVACDFTKENLASKGIPKERISPFGIPVKQDFYKEDYHNYIENIIQSPLNILLMGGGMGLDNISKVLKTLIKNDNPLNLTIVCGNNAELKKELCKEYGHITGNKNLNILGYTTEIPKIMKSSDLIITKPGGLTTTESLLSHLPMIIPFIIPGQESENREFLSKSNCAITINHLEELNKVINDLNKDNNKLINMRQSILDVLSSYSPEETIKLCTKMLNDSYNKRRY

SEQ ID NO: 18260 - protein, 530 aa, Arabidopsis thaliana
MDFFHSREKRHGKRAGLFGHKSASKSNPSSPPHLAEGRSQPTTHFGMKRSESEYAFPISDEQTTHWKPQQQASERIPNSHQRPPVYRYSTPERPREPDEDVTPRSNGSGSPFRSARTRTPDRRKRSSEITKELYERMYEADANHERGRDYSRERYEAEGNVTSRNRPSSPFHPSQSRSPPPHARTQRYNNGKDHFEGMYEADADITPRNSPPMSPVHQHTSYSPPPPFYSSSDDEDDNNSTYLFPEIATGRRSRGVSGSSTVRFFLSRVSIYQSVKKMLKFKLLWFVQPVHYKYQITSVETYEQERQFEPPELPDESQSFTMQEIARMRGLQSYGKEEIQLAISETYVSVANYKVRMSIAATLEAIIDKHGDIAASSKLQSTSTRSFYLESLAAAVMELKSTALRDLTKTRVAEIAAVVKDMDSVKIDVSWLKTAVTELAEAVEYYGKYDTAKIVREECDREMTAGKKEMEEMREELRRREKETKECRERVTELAGRLGQLEMKDVRVKKNLELYESKVLKFDGHSVLVD

SEQ ID NO: 18261 - protein, 224 aa, Pseudomonas fluorescens PfO-1
MTQDQLKQAVAQAAVDFILPKLDDKSIVGVGTGSTANCFIDALAQHKGAFDGAVASSEATAARLKGHGIPVYELNTVSNLEFYVDGADESDEHLNLIKGGGAALTREKIVAAVAQTFICIADASKLVPVLGAFPLPVEVIPMARSHVARQLVKLGGDPVYREGVLTDNGNIILDVHNLQITNPVELEAQINAIVGVVTNGLFAARPADLLLLGTSEGVKTLKAE

SEQ ID NO: 18262 - protein, 575 aa, Aspergillus oryzae
MRRPEDASNENPVTSAGLVAQGQTPPNWVSVKEDVAFTPRKIKIICAGAGFGGLTLAHKIKHGLKLEGVVDFVIYEKNADVGGTWFENRYPGVACDVPAHAYTFLFEPNPNYSHFYAPGPEIEEYIQRTARKWNLYDNIELNSKVVEATWDEAAGKWKVKVEQNGVIKEDEAEVFVSASGPLSKWKLPNIPGMSEFGGKLVHTAAWDESYEWKNKRVAVIGNGSSGVQCVAAMHSQVSKMVNYVRNPTWIASNFSGHLTRDGRNFAYTEEEKKKFREDPAAFFEMRKELENSVNQFAYGMMKDHTLNKLATEIATQQMQDRLKNSHDPSIALKMKPDFSPGCRRLTPCDGYLESFANPNTHMCWEAIDCITEKGIKTVDGKEEEFDLIVCATGFDTSFVPRWTMSGRDNATLDERWKHNPEAFFSVQVDGMPNYFIIGGPNFTVSNGSLLAGISFVCDYIMRWAQHMATHDIKSMEVKKEAIDDYNVWAQEYFKRTAWADNCRSWYKNGKSSGQVTAPYAGTTSHFKKCLDSIGAEHFNIQYNSANRFRCLGNGQVAGEENGMGDLAYYFVEGLW

SEQ ID NO: 18263 - protein, 151 aa, Zea mays
  misc_feature (57)..(57): Xaa can be any naturally occurring amino acid
  unsure (1)..(151): unsure at all Xaa locations
MAGMTVGNKLALAAVLLCAAAAMATAQQASGVRATYNFYNPQQNNWDLNAVSAYCAXTWDASKPLSWRMKYGWTAFCGPAGPTGQAACGQCLLVTNTATGASITVRIVDQCSNGGLDLDYDTAFKPIDTNGQGFQAGHLTVNYQFVNCGDN

SEQ ID NO: 18264 - protein, 470 aa, Bacillus anthracis str. Ames
MVVGDFPIELDTVVVGAGPGGYVAAIRAAQLGQKVAIIEKANLGGVCLNVGCIPSKALINAGHRYENAMHSDDMGITAENVKVDFTKVQEWKNGVVKKLTGGVEGLLKGNKVEIIRGEAYFVDANTLRVMTEEAAQTYTFKNAVLATGSTPIEIPGFKYSKRVINSTGALSLPEIPKKLVVIGGGYIGMELGTAYANFGTEVTVVEAGDEILAGFEKAMSSVVKRALQKKGNVNIHTKAMAKGVEETETGVKVSFEVKGEIQTVEADYVLVTVGRRPNTQEIGLEQVGVKMTDRGIIEIDEQCRTNVPNIYAIGDIVPGPPLAHKASYEGKVAVEAISGHASAIDYIGIPAVCFTDPELASVGYTKKQAEEAGMTVTVSKFPFAANGRALSLNSTDGFLQLVTRKEDGLLVGAQVAGAGASDIISEIGLAIEAGMTAEDIAQTIHAHPTLGEITMEAAEVALGMPIHIVK

SEQ ID NO: 18265 - protein, 237 aa, Mycobacterium avium subsp. paratuberculosis K-10
MRIAVLSGAGISAESGVPTFRDDKNGLWARFDPYELSSTQGWRDNPQRVWGWYLWRHYLVADVAPNAGHRAIAAWQDHAEVSVITQNVDDLHERAGSRPVHHLHGSLFEFRCARCAKPYTGELPAMAEPALEVQPPVCGCGGLIRPDIVWFGEQLPDEPWRRAVEATESADVMVVVGTSAIVYPAAGLAELALSRGAAVVEVNPEVTPLSASATLSIRETASQALPGLLQRLPALLN

SEQ ID NO: 18266 - protein, 419 aa, Bacillus anthracis str. Ames
MAFEFKLPDIGEGIHEGEIVKWFIKPGDEVNEDDVLLEVQNDKAVVEIPSPVKGKVLEVLVEEGTVAVVGDTLIKFDAPGYENLKFKGDDHDEAPKAEATPAATAEVVNERVIAMPSVRKYARENGVDIHKVAGSGKNGRIVKADIDAFANGGQAVAATEAPAAVEATPAAAKEEAPKAQPIPAGEYPETREKMSGIRKAIAKAMVNSKHTAPHVTLMDEVDVTELVAHRKKFKAVAADKGIKLTYLPYVVKALTSALREYPMLNTSLDDASQEVVHKHYFNIGIAADTDKGLLVPVVKDTDRKSIFTISNEINDLAGKAREGRLAPAEMKGASCTITNIGSAGGQWFTPVINHPEVAILGIGRIAEKPVVKNGEIVAAPVLALSLSFDHRLIDGATAQKALNQIKRLLNDPQLLVMEA

SEQ ID NO: 18267 - protein, 325 aa, Bacillus anthracis str. Ames
MAQMTMIQAITDALRVEMKNDPNVLVFGEDVGVNGGVFRATEGLQAEFGEDRVMDTPLAESGIGGLAVGLALEGFRPVPEIQFFGFVYEVMDSISGQLARMRYRSGGRWTAPVTVRSPFGGGVHTPELHADSLEGLVAQQPGLKVVIPSTPYDAKGLLISAIRDNDPVIYLEHMKLYRSFRQDVPEGEYTIDLGKADIKREGTDVSVIAYGAMVHAALKAAEELEKEGISLEVVDLRTVQPLDIETIIASVEKTGRVVVVQEAQKQAGIAANVVAEINDRAILNLEAPVVRVAAADTVFPFSQAESVWLPNHKDIVEAVNKVMNF

SEQ ID NO: 18268 - protein, 345 aa, Glycine max
  misc_feature (125)..(125): Xaa can be any naturally occurring amino acid
  unsure (1)..(345): unsure at all Xaa locations
MLGRRPFIHLAGHHTPKLFSYCLLHCHFQVMALLRLVCLPSTNQLSTQPHSHSQSTSFSFLRKTPHSQPINFSLSSFHFPRLSLITTKQTLNLTPTHSSTSEQQTEEPLVSEEEFSRTRLLAQNXPWTSTPEDIRTLFEKHGKVLEVELSMYKKNRNRGLAFVEMGSPEEALEALNNLESYEFEGRVIKVNYARPKKEKTAPPPVKPKVVTFNLFVANLSYEASSKDLKEFFDLGTGRVVSAEVVYRDNPRRPSGYGFVSFKSKKEAEAALAEFQGKVFMGRPIRVDRGRRFVQQPGDGSAKSEDTPSELSVNGAEAPQPAEGSAKSEDTPSELSVNGEEADKAD

SEQ ID NO: 18269 - protein, 440 aa, Bacillus cereus ATCC 14579
MKQHPFKIASLGMQHMLAMYAGAIIVPLIVGGGLGLNQKELTYLVSIDLLMCGVATILQALSNRFFGIGLPVVLGCTFTAVGPMIAIGKQYGVSSIYGAIIAAGLFVVIFAKLFGKLVKLFPPVVTGSVVTVIGVTLVPAAINDMAGGVGSKDFGSLENLALAFGVLLFIIIMYRFFDGFIRSISILLGLLFGTIVAAFMGKVSLQAVGEADWFHGIQPFYFGTPTFELTPIITMILVACVGIVEATGVYFALSDICNKKIGEKELTKGYRAEGLAMVLGGIFNAFPYTTYSQNVGLVQLTGVRNRVIIYTCGGMLIALGFIPKIAAITTIIPKSVLGGAMLAMFGMVMAYGIKMLSSVDFGRQENLLIVACSVGIGLGVTVVPTLFSQLPESIRILTDNGIVLGSASAVLLNIVFNMVPQRKVKVEEEPVSMQSAVREA

SEQ ID NO: 18270 - protein, 326 aa, Oryza sativa (indica cultivar-group)
MAATNNVGAGALPVVDLAPFLATGDDEGGVARASASATGAVREACRDYGFFRAVNHGVPAELMARALELSAAFFALPDEEKAKARPVEGSEAPLPAGYARQPAHSADKNEYLLAFDPQLGFNLYPDEPSGFREALEELYGKLTELGVLIQEILNKCMGLPPGFLKEYNGDRSFDFIAALRYSPATAEENNGVSEHEDGNCITFVLQDGVGGLEVLKDGAWVPVDPVEGSIIVNIGDVIQVLTNGKMKSATHRVVRKPAVHRHSLVFFFNVHGDRWVEPLPEYTEKIGEAPRYRRFLYSEYQQLRMRNKTHPPSRPEDVVHITHYAI

SEQ ID NO: 18271 - protein, 355 aa, Robiginitalea biformata HTCC2501
MSITINEIPVKRVDKSRLPEVDFDNLAFGSVFTDHMFRCTYREGRWQQAEVVPYGPLTLDPASKIFHYGQSVFEGMKAYRDSDGKAWLFRPEENQRRLNISASRMAIPELPDGLFMEGLKALLEVDRDWIPGQSGSSLYIRPFIFASGTGFHASPADAFTFIIACAPSGSYFSGKVSVKIEEAYSRAADGGTGFAKAGGNYAGQFYPTQLAARDGFQQVIWTDDHRHEYIEEAGAMNIFVRIGDTLMTAPTSDRILDGITRKSILQLAESEGIPVEVRKIRVAEVVEASKNGSLREMFGAGTAAVVSPISSFGYRDELFELPEPEDSYAAHFKKRITDIQYNRAEDPFGWRYPLG

SEQ ID NO: 18272 - protein, 634 aa, Candidatus Desulfococcus oleovorans Hxd3
MTGFVISINNRDTTAAVKMKKTNNIPIRNIAIIAHVDHGKTTLVDAMFRQSGLFREGQAVDERLMDSMDLERERGITIAAKNCAIHWRDTKINIIDTPGHADFGGEVERALSMADGAILLVDASEGPLPQTRFVLDKALKSGLAIIVVINKIDRADARPAEVLDEIYSLLIDLGATDRQIECPCLYAVGRQGIAMKSPVDKGENLHLLLDMMIDEIPGPSADPEAPFQMLVSDLGYSDYLGRLAVGRVVNGSVESRKNLVCLKEDGEQAPLKISRLQVYSGPGLKDAQRADAGDIVVLSGIENVHIGDTICTDETPIALPRIRVDEPTVFMRFAGNTSPLAGMEGKLVQASRIYARLVKETLMNVSIRVEAGDDRESFIVKGRGEFQMAILVETMRREGFELCVGRPQVIYRYENGRRLEPIEDLLVNCEAAYSGIVTEKLLQRKGTLVRMERQDNDRTRLAFSVPSRALIGFRDEFLTDTRGTGIMNSALAGYEPYRGDFPGRFTGSLVSDRQGKAVAFALFNLEARGKLFTRPGEVVYEGMIIGERNRDTDLNVNPCKTKQLSNMRASGKDEAVTLTPVTPMTLEKAIQFIGDDEMIEVTPKSIRLRKTILSAHGRKVFERRGAVDLSSACA

SEQ ID NO: 18273 - protein, 128 aa, Zea mays
MGRTIKKARKAKPKKSKKKTEASSSSNHAVASGPAKVWQPGVDALEDGEELQFDPEAYNYLRGFGIGWSCLSFDVVRDQLGLVRSEFPHTLYGVAGTQAEKASLNYIGGFKLSNINGKKREPIPAFSS

SEQ ID NO: 18274 - protein, 432 aa, Thermus thermophilus HB8
MKPSVRTPLPGPRARALLERGEKVLSPSYVRPYPFVPARGQGAFLEDVDGNLFLDFMSGIAVNTTGYAHPKVVEAVRAQAERFAHVCFSDFTHEPTLSLAERLVGKLGGGYRVFFGNSGTEGVEAAIKLVRYHTRRPYLLAFTGAFHGRSLGALSVTASKSAYRQGFAPFLPGVVHLPFPNPFRPPLGARPEEVGDAVLNHLEHLFQTVLPPEEVAALFLEPIQGEGGYVVPPPGFIPRLKEVLDRFGILLVADEVQTGAGRTGRFFALEHEGVQADVYVLAKGLASGYPISAVLFREELGSWPPGAHGTTFGGQAVAAAAAHATLDLLEGGLQENAARLGEFLLAELRALKRRFPFLGDVRGRGLMIGLDFGDPDHPRPDLRDKAVRLAFEKGLLLLPAGPSALRIAPPLVLTQEEAALGLEILEEVFRAL

SEQ ID NO: 18275 - protein, 371 aa, Robiginitalea biformata HTCC2501
MKEDYYELLGVSKGATAAEIKKAYRKKAIEFHPDRNPGDATAEENFKKAAEAYEVLSDPNKRARYDQFGHQAFEGGGFGGGGMNMEDIFSQFGDIFGSAFGGSGFGGFGGFGGGQRRVKGSNLRIRVTLDLEEVALGVEKKIKVKRKVQAPGVTYKTCGTCGGNGQVTKITNTILGRMQTAATCTACGGSGQVIDSRPDGADAHGLVMQEETVSIKIPGGVESGMQLKVSGKGNDAPGNGVPGDLLVAIETREHPTLKREGDNLHYDLYISMPDAVLGTSKEIDTIGGKVRIKLEPGIQSGKILRLRNKGIQSINGYGAGDLLVHVNVWTPKELSKEQREFFERMQEDDKFAPKPEKSDKSFFEKVKDMFS

SEQ ID NO: 18276 - protein, 356 aa, Arabidopsis thaliana
MVAVERVESLAKSGIISIPKEYIRPKEELESINDVFLEEKKEDGPQVPTIDLKNIESDDEKIRENCIEELKKASLDWGVMHLINHGIPADLMERVKKAGEEFFSLSVEEKEKYANDQATGKIQGYGSKLANNASGQLEWEDYFFHLAYPEEKRDLSIWPKTPSDYIEATSEYAKCLRLLATKVFKALSVGLGLEPDRLEKEVGGLEELLLQMKINYYPKCPQPELALDVEAHTDVSALTFILHNMVPGLQLFYEGKWVTAKCVPDSIVMHIGDTLEILSNGKYKSILHRGLVNKEKVRISWAVFCEPPKDKIVLKPLPEMVSVESPAKFPPRTFAQHIEHKLFGKEQEELVSEKND

SEQ ID NO: 18277 - protein, 402 aa, Campylobacter jejuni subsp. jejuni NCTC 11168
MDYKQLKQEFNTPFYIYNFDFIKERFLNLKEAFKARKSQIFYAVKANSNLSLLQMLANLDSGFDCVSIGEVKRALKAGAKAYKIIFSGVGKTKEELRQALEYDILYINLESEAEMMLLESVAKELNLKARISIRVNPNVDAKTHPYISTGLNENKFGVEIDIARKMYLYAKNSSFLEPVGVHFHIGSQLLDISPIHEAAAIVAKLVRELKALQIDLKFFDIGGGLGVAYEKNECEPDLYDYAQGILAQLHGLDLTIGMEPGRYLVAKSGEFVCSVLYEKQNKTKRFVVVDGAMNDLIRPSLYEAYHEIILPYNQGEESLCDVVGGICESGDFFAKARSLPSTQSDDIMVIKNTGAYGFSMSSNYNTRNKVCELALEEGQVRLIRQRENFEDQIALEEKFLKA

SEQ ID NO: 18278 - protein, 280 aa, Oryza sativa (indica cultivar-group)
MDAAAAAGGEMSRQKATASAPPPPELDMVARAVQRLVARNDAVEALSGGGEAAAGLGAGMAAFEAARGAPAPRIGVAQYLERVHRYAGLEPECYVVAYAYVDMAAHRRPAAAVASRNVHRLLLACLLVASKVLDDFWKHNHRSAVQGVKNRRHHNNAFFARVGGVSNAEMNRLELELLAVLDFEVMLSHRVYELYREHLEKEARRDGGGGDMLAGASAAAAAKAGRMAAVSPSKLLERAAVNGAAQHDDWRSLGTAAAAEAANGVRRHRSSSSSRYSFDC

SEQ ID NO: 18279 - protein, 516 aa, Candida albicans SC5314
MFTNSIISKSTTRLTQLSRQLSTTTMAPTSTKNSIKHFDYLVIGGGSGGVASARRAAKYGAKVLLIESNFKKFGGTCVNVGCVPKKVMWYTADLAHKKHDLYAYGLDKEPDSIKYGDFDWAKLKHKRDAYVTRLNGIYENNLKREKVDYAYGFAKFINSEGEVEVTLSGDQELPFLDEGKTYKKGEKLVFSADKTLIATGGTAIVPPSVPGAELGTTSDGFFALEKQPKKVAIVGAGYIGVELSGVFSSLGSETHFFIRGDTVLRSFDEVIQNTVTDYYIDNLGINIHKQSTITKIEGSKDGKKVVHLKDGTSVEVDELIWTVGRKSLIDIGLDKVDVKINDKQQIVADEYQVTNNPKIFSLGDVVGKVELTPVAIAAGRRLSNRLFGGPEFAKDKLDYNNIPSVIFSHPEAGSIGLSTKEAIEKYGEENLKIYQSKFTAMYYAMMDDQKDKSPTVYKIICAGPEEKVVGLHIVGDSSAEILQGFGVAIKMGATKKDFDNCVAIHPTSAEELVTMT

SEQ ID NO: 18280 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYRENHKSPGYYDGRYWTMWKLPMFGCTDATQVLAEVQEAKKAYPQAWIRIIGFDNVRQVQCISFIAYKPEGY

SEQ ID NO: 18281 - protein, 181 aa, Medicago truncatula
MEIEARQGVVAKKLWNMVRVLLFIIRKGIAKSKTMVHLNLILKRGKLAGKALINTLMLNHQLYHSSFTCRSDNNSFISPCEYEFSCRNTPANPLRHSSRRFSKSRRQRHNDFSIMNNNIAVQKVFIEMMLNNEKVEAVANSPLAPFTLEDEGNCHQVDIAAEEFINNFYKELNRQNRTIAS

SEQ ID NO: 18282 - protein, 446 aa, Staphylococcus epidermidis ATCC 12228
MPKRSFTKDDIRKFAEEENVRYLRLQFTDILGTIKNVEVPVSQLEKVLDNEMMFDGSSIEGFVRIEESDMYLHPDLDTWVIFPWTAGQGKVARLICDVFKTDGTPFEGDPRANLKRVLRRMEDMGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPEGDLQLTDTAYQFTAGVLKNARGFTAVCNPIVNSYKRLVPGYEAPCYIAWSGKNRSPLVRVPTSRGLSTRIEVRSVDPAANPYMALAAILEAGLDGIENKLEVPEPVNQNIYEMNREEREAVGIQDLPSTLYTALKAMRENKSIKNALGNHIYNQFINSKSIEWDYYRTQVSEWEREQYIKQY

SEQ ID NO: 18283 - protein, 437 aa, Bacillus halodurans C-125
MNRSRSESLFQKAQSLIVGGVNSPSRSFKAVGGGAPVFMEKAKGAYFWDVDGNQYIDYLAAYGPIITGHAHPHITNAIQRAAENGVLYGTPTKLENQFASMLQQAIPSLEKVRFVNSGTEAVMTTIRVARAYTGRDKIIKFAGCYHGHSDLVLVAAGSGPSTLGTPDSAGVTKNIAEEVITVPFNQLDSLKEALDHWGEEVAAVLVEPIVGNFGIVEPHEGFLEGVNELAHNAGALVIYDEVITAFRFMYEGAQNYVGVEPDMTALGKIIGGGLPIGAYGGRIDIMEKVAPLGPAYQAGTMAGNPASMSAGIACLEVLQEEGLYDELDRKGAILEKGIKAHAEAHGITISINRLKGALTVYFTDETVTCYEQAERSDGEKFSLFFKEMLNQGINLAPSKYEAWFLTIAHTDEDIEKTLQAVDHAFSVMAAKGYHLKR

SEQ ID NO: 18284 - protein, 520 aa, Medicago truncatula
MAFQSLFSKHKLLSSYLFPLVQHKFIHSFPTQQISVPLLPELVNEISRIVSDHRHPRHDLELSLTPFSTQISTDLVEQVLKRCNHLGFSAHRFFLWAKSIPGFQHSVQSFHILVEILGRSKQFAILWDFLIETRESDSSCKITNEIFWIIFTAYSRADLPDGAIRSFVRMDEFGIKPSIIDVDLLLYTLCKKKHVRQAQQFFDQVKSHFLLTTKTYSILINGWGKIGDSGKARELFDAMLEQGCHVDLLAYNNLLEALCKGGHVDEAMDFLNDMLSKKVEPDAFTYSIFIRSYCDANNVHSAFGVLDKMRRCNLLPNVFTYNCIIKRLCKIKKVEEAYQLLDEMISSGLKPDTWSYNAIQAYHCDHCEVNRALKLISRMEKDVCFPDRHTYNMVLKLLIRIGRFDKATEVWECMGDKKFYPSVSTYSVMIHGLCKKKGKLEEACKYFAMMIDEGIPPYDTTIEMLRNRLLGLGLLDNIEILAAKMRQSTSCSIQELANIMIGARSAQNTWRRDESDIESD

SEQ ID NO: 18285 - protein, 119 aa, Oryza sativa
MASSEPTPMNTDDVEQPSGSSKTDSSVVPRKYFEVKKWSAVTLWAWDIVVDNCAICRNHIMDLCIECQANQAAATTEECTVAWGVCNHAFHFHCISRWLKTRQVCPLDNREWEFQKYGR

SEQ ID NO: 18286 - protein, 570 aa, Arabidopsis thaliana
MEMLAYFLSEFQICYNNAQRVVSGKEVLVTSKVEESDVVSDLPSFEVAETNTVDRSGGMLETQNVGPEEISDDEIELPEGKSTDSQNVAPVQDHSLSDAERIQREIAATSVQAAFRGYLARRAFWALKGIIRLQALIRGHLVRRQAVATLFSVMGIVRLQAFARGREIRKSDIGVQVYRKCRLQLLQGNKLANPTDAYLGIKKLTANAFAQKLLASSPKVLPVHAYDTSNPNSNLIWLENWSASCFWKPVPQPKKTISRKPQNRLLVEAESAKPKKSVRKVPASNFESSSVQTSFEFEKPKRSFRKVSSQSIEPPAVEDPQIELEKVKRSLRKVHNPVVESSIQPQRSPRKEVEKPKLGVEKTRESSYPLVHETAEEPVNVCDEKKKQEISEQPEEEVHALEMEVHTPGPLETNEALDSSLVNQIDSNEKAMVEEKPSMEKDTKEEKTPKPNNKENSAGKENQKSRKKGSATSKTEREESNGHHETSPSIPSYMQATKSAKAKLRLQGSPKSAEQDGTEKATVPRRHSLPSPGNGRITSHSPRTTRLANSGDKTGNKKEKPLLSSREGNG

SEQ ID NO: 18287 - protein, 266 aa, Triticum aestivum
  misc_feature (233)..(233): Xaa can be any naturally occurring amino acid
  unsure (1)..(266): unsure at all Xaa locations
LQESARGGFPGKVMHACEYRTGKGMEGNAVLVVGSGNSGMEIAYALAEAGAATSIIVRSELHLVTKEIWNVAMTLYRYLPLWLIDRIVLLMCSVVFGDTSRYGLRRPAIGPFSMKIHTPAYPVVDVGTYAKIKTGEIQVLPAMKAVHGNVVEFADGKRHPFDAIVFATGYRSTTKKWLKSDDGLIGEDGMARRSFPEHWKGENGLYCAGMVRRGLYGSCEDAESIAEDISKKXRSHTKPEHDHRQKSNNTFWSRTAIVGRETMGVL

SEQ ID NO: 18288 - protein, 100 aa, Oryza sativa
  misc_feature (77)..(77): Xaa can be any naturally occurring amino acid
  unsure (1)..(100): unsure at all Xaa locations
MSAMETDINAPPPPAPAPAGAGEGSSSAAGPSSRKPNKRFEIKKWNAVALWAWGIECQANQASATSEECTVAWGYQXVCNHAFHFHCISRWLKTRQVCPL

SEQ ID NO: 18289 - protein, 604 aa, Francisella tularensis subsp. holarctica
MERREKRIRKLRNKSGKVFAIETNLTGRQLLNNRVLNKDVAFSQEERVAFALIGYLPEKVESLEEQAIRVRRQLDLKPNSLEKYVFLNRLHDLNTTLFYHFVRENLEEIMPIIYTPTVGEAVQKYSSSFRKQSGLFISISHKKHIARILERYEYNSIDLVLVTDGEAVLGIGDQGIGGMNISIGKIMVYVAASGIDPARVLPVQLDMGTNNDALLNAPGYLGVRLPRVSGETYDEFIEEFVTQVKARFPNVFLHWEDLGRDNATRILEKYKDKLCTFNDDIEGTGIVATANCIAGVKTASTIRINAGEITVEEALSGICDIKVVIFGAGSAGCGIARQLADVIADRAGVSIEKARSSIYLVDRYGLVCDRLRAKRIIPEQKLFVKTSEEIDKWKVEDFNYITLEETVKNTKCDILIGTSGQPGSFTKEIIKTMAKNNNYPIIMPLSNPTSLCEALPEDIIKWTNGKALIAAGSPFPDVTYNGRDYRISQGNNAFIFPGLGLGSVAVHARVLTKGMIRAACYRLSELSPMVINEDITQPLLARITDLVDVTKEITKAVAKQAILEGVHGVDIDLEDLTETELDEEIERLINLSSWTPTYAPYMPI

SEQ ID NO: 18290 - protein, 339 aa, Bacteroides thetaiotaomicron VPI-5482
MKEIDWANLSFGYMKTDYNVRINFRNGAWGELEVSSDEHLNLHMAATCLHYGQEAFEGLKAFRGKDGKVRIFRLEENAARLQSTCQGILMAELPTERFKEAILKVVKLNERFIPPYETGASLYIRPLLIGTSAQVGVHPAEEYMFVVFVTPVGPYFKGGFSTNPYVIIREFDRAAPHGTGIYKVGGNYAASLRANKKAHDLGYSCEFYLDAKEKKYIDECGAANFFGIKDNTYITPKSSSILPSITNKSLMQLAEDMGIKVERRPIPEEELETFEEAGACGTAAVISPIQRIDDLENGKSYVISKDGKPGPICTKLYNKLRGIQYGDEPDTHGWVTIVE

SEQ ID NO: 18291 - protein, 425 aa, Ostreococcus tauri
MDRRVRVRPRARRSRWISTTRSMTITPARSPSSSARAWTTCSRARACSNTSFAERERVRDNKEKIKLNKQLPYLVGNVVELLDLAPEEEELEDQATADVDAQRSGKACVLKTTTRQTIFLPVVGLVDAETLKPGDLVGVNKDSYLILDTLPAEYDSRVKAMEVDEKPTDDYTDIGGLEKQIREMREAIVLPMTHAEKFAKLGIRPPKGVLLYGPPGTGKTLIARACAAQTNAAYLKLAGPLLVQMFIGDGAKLVRDAFALAKEKAPAIIFIDEIDAIGTKRFDSDTNGDREVQRTMLELLNQLDGFSSDDRIKIIAATNRADILDPALMRSGRLDRKIEFPHPNEDARAQIMKIHSRKMNVNPEVNFEELARGTEDFNGAQLKAVCVEAGMLALRRDGTEIQHEDFNEGIIQVQAKKKADLFYYA

SEQ ID NO: 18292 - protein, 342 aa, Oryza sativa (indica cultivar-group)
MEIQQQKGVGNSKVVKVEKEESWDLFINQASNEGRPVVAHFGASWCVTSLSMNYKFEELAQTHPEILFLYVDVDDIQSVSSKLGVKAMPTFFLIKDKEVVNKIVGANPDEVKKMVDASAESIGVTAPPDIVPRTSAKPTASTTAKNSRRVGVGVGAGSLSPLLSPASFLFPSRALCCECGCGVASHALCELWVRERWPEELAGEEEEEEEDDELSFAMCCYVGKATKIFLCLAAALIVVGLVLGFGLAHRTWGERKVQPDCRWPDCQLQPTYGGGGGGDPLPATSGAGAGGVDTPPGVPLTEPAVAAFPGVASASSAAPPTASMPYLGPPSPFAVGLAPAHG

SEQ ID NO: 18293 - protein, 375 aa, Saccharomyces cerevisiae
MSTEEQNGVPLQRGSEFIADDVTSNKSNNTRRMLVKEYRKIGRGAFGTVVQAYLTQDKKNWLGPFAIKKVPAHTEYKSRELQILRIADHPNIVKLQYFFTHLSPQDNKVYQHLAMECLPETLQIEINRYVTNKLEMPLKHIRLYTYQIARGMLYLHGLGVCHRDIKPSNVLVDPETGVLKICDFGSAKKLEHNQPSISYICSRFYRAPELIIGCTQYTTQIDIWGLGCVMGEMLIGKAIFQGQEPLLQLREIAKLLGPPDKRFIFFSNPAYDGPLFSKPLFSGSSQQRFEKYFGHSGPDGIDLLMKILVYEPQQRLSPRRILAHQFFNELRNDDTFLPRGFTEPIKLPNLFDFNDFELQILGEFADKIKPTKVAE

SEQ ID NO: 18294 - protein, 307 aa, Saccharophagus degradans 2-40
MDAIDYKKIFSEIVNELSSEDEKGSVATYIPELANVDPNKLGMHLTTVTNQHFAYGDAEEAFSIQSIAKVWSLTLALKHLGADTWQRVGVEPSGTAFNSLVQLEYEMGIPRNPFINAGAIVVCDILVSCLKNPKEDLLDFIRTSSGIPSIEYCPVIAESEVKTGHRNYALAHMMKGFGNIHNDVDCVLDLYFSLCSIKLTCKQLAQAFLFLAAGGVNPATQQQVITPKRTKRINSIMQMCGFYDEAGEFAFKVGLPGKSGVGGGIVAVHPGKYCIAVFSPRLNASGNSVKAMKVLEALTTKTELSIF

SEQ ID NO: 18295 - protein, 406 aa, Thermus thermophilus HB27
MQELKVPSVGESIVEVEIGAWLKGEGESFAQDEPLVELITDKATLELPAPFAGTLKQILKKTGETARVGEAIALLEEGRAEAAPKAQAPAEAPKEPSPEPLAMPAAERLMQEKGVSPAEVQGTGLGGRILKEDVMRHLEERTPTKPQEAPPPPPPSRPVPPPSTPTQPPADKPWRVSEAVPMTPLRRRIAERLLMVRQTTAMLTTFNEADMSAVIALRKEFGEAFQKKYGVKLGFMSFFVKAVVQALKEIPELNAEIRDNHIVYHRYYDIGIAVGGGEGLVVPVIRDADRLSFAEIEQKIADFAERARTKKLKPEELMGGTFTITNGGIYGSLNSTPLLNPPQVGILGMHAIQERPVVRDGQVVIRPMMYLALSYDHRIVDGREAVTFLRRVKELIENPARLLLEV

SEQ ID NO: 18296 - protein, 467 aa, Thermus thermophilus HB27
MRTRRGSFWRCSVYDLLVIGAGPGGYVAAIRAAQLGMKVGVVEKEKALGGTCLRVGCIPSKALLETTERIYEAKKGLLGAKVKGVELDLPALMAHKDKVVQANTQGVEFLFKKNGIARHQGTARFLSERKVLVEETGEELEARYILIATGSAPLIPPWAQVDYERVVTSTEALSFPEVPKRLIVVGGGVIGLELGVVWHRLGAEVIVLEYMDRILPTMDAEVSRAAERVFKKQGLTIRTGVRVTAVVPEAKGARVELEGGEVLEADRVLVAVGRRPYTEGLSLENAGLSTDERGRIPVDEHLRTRVPHIYAIGDVVRGPMLAHKASEEGIAAVEHMARGFGHVDYQAIPSVVYTHPEIAAVGYTEEELKAQGIPYKVGKFPYSASGRARAMGETEGFIKVLAHAKTDRILGVHGIGARVGDVLAEAALALFFKASAEDLGRAPHAHPSLSEILKEAALAAWERPIHL

SEQ ID NO: 18297 - protein, 207 aa, Oryza sativa
  misc_feature (164)..(164): Xaa can be any naturally occurring amino acid
  unsure (1)..(207): unsure at all Xaa locations
MANQATFDAKLKEALPLYEKLKNEWNRKPPNVGKTDELLTGLKNLFAEGGFYPSDSSEDTRGLHIARDTLEIAAQCAIEKGDIPAFERALAQLKPFYFDLEGRIPESPYRYLLLGLNLLCLLSQNRLADFHTELELLSPKDIQNNPYIRHPVSLEQYLMEGSYXKVFLAKGNVPSPLFTFFMDILLHTIRDEIAFCMEKSYRKYRRG

SEQ ID NO: 18298 - protein, 197 aa, Capsicum annuum
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIVLVGTKLDLRDDKQFFVDHPGAVPIATAQGEELRKTIGAPSYVECSSKTQQNVKAVFDAAIKGRPPASQDEEKKGKSQKACSIL

SEQ ID NO: 18299 - protein, 543 aa, Thermus thermophilus HB27
MIVKEDLLPIEEVAAKLGLDRDRLYLYGPHMAKVLGEPPKAKGKLVLVTAITPTPAGEGKTTTAIGLVDALWRLGKRAALALREPSLGPVFGVKGGATGGGKARVEPRHEINLHFTGDFHAVTSAVNLLNALLDNHLHQGNELGIDPRRIELKRAIDMNDRALRHIVLGLGGKAHGVPREGGFELTVASEVMALMSLARDFQDLKRRLGRMRVAFTHEGKPVYAEDLMAVGAMAALLRQAFLPNLVQTAEGNPAFIHMGPFGNIAHGTNSLRASLFALGLADLVVQEAGFATDLGLEKFMNVVARTTGLVPEAVVLVATIRALRYHGGQDAYGMPDPKAVKAGLANLEKHVENVELFGYKPVIALNRFPSDAPEEIALVRAFAEERGLPFAPSEVYAQGGEGGLELAERVLEALDLPHAYRPLYPLEASLEAKVEAIATRVYGAEGVEWSEEAKRALKAAKKEGCEALPVVVAKAATSLSDNPRLRGRPRGFTVRVTDLRCRLGAGFVVVYMGGIETLPGLPKTPQAFGIDVDEEGNIRGMDY

SEQ ID NO: 18300 - protein, 454 aa, Pseudomonas fluorescens PfO-1
MTSNNPQTREWQALSSDHHLAPFSDFKQLKEKGPRIITNAKGVYLWDSEGNKILDGMAGLWCVAIGYGRDELADAAAKQMRELPYYNLFFQTAHPPALELAKAIADVAPEGMNHVFFTGSGSEGNDTMLRMVRHYWAIKGQPNKKVIISRKNGYHGSTVAGASLGGMTYMHEQGDLPIPGIVHIAQPYWFAEGGDMTPEEFGIWAANQLEEKILEVGVDNVGAFIAEPIQGAGGVIIPPDTYWPRIKEILAKYDILFVADEVICGFGRTGQWFGSDFYDLKPHMMTIAKGLTSGYIPMGGLIVRDEVVAVLNEGGDFNHGFTYSGHPVAAAVGLENIRILREEKIIERAHEETAPYLQKRLRELNDHPLVGEVRGVGLLGAIELVQDKATRKRYEGKGVGMICRQFCFDNGLIMRAVGDTMIIAPPLVISKAEIDELVTKARKCLDLTLSALQG

SEQ ID NO: 18301 - protein, 293 aa, Oryza sativa (japonica cultivar-group)
MEQYEEEKIGEGTYGVVYKARDKVTNETIALKKIRLEQEDEGVPSTAIREISLLKEMHHRNIVRLHDVIHSEKRIGLVFEYLDLDLKKFMDSCPEFAKNPTLIKSYLYQILRGVAYCHSHRVLHRDLKPQNLLIDRRTNTLKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQALATIVPTLDPAGLDLLSKMLRYEPNKRITARQALEHEYFKDLEMVQ

SEQ ID NO: 18302 - protein, 421 aa, Triticum aestivum
MASHETDPSPAAPSKKKKRHSKKRKAIEVTVDASFPGAAAPVVGYFPTGYDPLAAAEPPRARLFRHEKHHNRVELVVRAPGGGPDFVGRSYAGEAAAPQLCGYALGVLDKATSTLKIVPIASNKILRLEPHFEVQQPAHSQQSAAEAGSSVADTELNRQDLTQAYGTKKDKDKDNKWKSLKEQRNDPSAYLDLDLGESKTTADATDSQASMEVRNIPPYDPAADTSEKAYLFDEIIPKNIRPHLLDIVGHFESGEFGLKGYGSFVSNRVNKLQELQGEDQERLAWILSYITHLLSLLARNSSMSKQKRKEKDQTIRGPMIPQAVHRKLLLMFTEPGSSSLSTEKHELLINYILVLTLFADDFRSEPTDICADLKMNRQMLKPYYDQLGCKSVSTGAFKPVFMTLPAPLKFPQQVTRRRRRK

SEQ ID NO: 18303 - protein, 935 aa, Treponema denticola ATCC 35405
MKISNNIHFFNSKEIVGKKVDKNLLGIRGRQANEFAELKLPILPGIIIDASVAQDLGDIKIYSEISPYLSKFGSEVKKTYGDAGSPLLLKLVISPNMLITSYPTLHNFGLTKDTVIGFQENVGEDFAANEVLFLLNGILTVVLKIEELEKNEQKVKDLEKALHDIKESMKMGKIGLKPGAIMDKYSKFLPKHFFDDCKVQLEESIRLIARLLTLEEDSDHDVALLIQPMVYGNYSKDSYSGSFFSRNIVNGEKKLQGQFFAEKFNEVNAEGKDINSIKPEYLKHLQQIAWQLEDYTKDIRNIRFTIEAGRLWLIEQKSVEAKSTISMVQILLDLYNRKIVDAEYVVRAVKPGQLNEILHPVIDIMSTKGMKSSKGGIAGAPGAAVGRVYFTADSLIEAQRAAKLQGLDTRCILCMPATYAGDVKGIEVSTGVISNEGGYSAHASVVARQYGKISLVRPDMKISGNKAVIEGVTINEGDYITLNVPYYGDSTVYFGEAKLIEPDPETSGLLDFIGLAKSFLSNFHVRANADSPRDAQLALDFGAEGIGLCRTEHMFFNEKRINTFREMILAPSEAERKKVLDKLQKVQTEDFYGIFKAMNGKEVTIRLLDAPLHEFLPHNDLELDGFVKYLTAQKKKVSKKDLTAEIEKLSEINPMLGHRGCRIAISYPEIYAMQIRAIFEAAYKLKKEKVDVKPEIMIPLIMNFRELKQIIYGKKIEGHTYLGIDAIAEEVKAAVKGGDLDYKVGTMIELPASALSADEIAKYAQFFSFGTNDLTQTTLGLSRDDFNSFMPDYTMYDLIDGNPFAVLDSRVRDLIEIAIQRGKLTRPDLHLGLCGEHGARPENVRFCMDAGLDYVSCSSYSVPIALLSIAQAELENAEKAGIKLEPKAHVSRKPSSAAPKSAAKKQAPEKKAVKAKPASAKKASSAKKKTAKKSK

SEQ ID NO: 18304 - protein, 860 aa, Ostreococcus tauri
MPDHPPTPPRVVRRTSAGYYESISYDLGVNAVLRRRINRDSVNSQPRAPPARRVASHAASRLESRVRFAARASRYALTVVIGVITGACAWGVSAATMQIVTMQSALVSRYYGDDARATTTVFFVTSATLGLVGGWMAIFYAPAASGGGVTQVMATLNGARVPGLLSGRTLAAKIVGVIAGVGSALAIGPEGPMVHIGAGIASVCALYWPRKFLCEDKEEAEASRADALRRRYNETASSSSEDGYTDDDYSDERSESGAWASSESDDEEILDGDGAMDGLLAESRRRRARRRAATRRQRWPRFGESQKLDAVLLDLAAPSTHRDFVSAGAAAGLAAAFGAPIGGVLFSFEEASTYWSQRTMWRCLICAAIASFVLALLDLRGNPGMVFITGDSLRPTTPRDYFHQLPFFVIVAALAGLTGVTFNKIQAWTSRFRPAPKHKIARLFECVAVVLATVGIRFAASAFAGQCMAPPDAWVEDGFGVRFNCPEGEINDIATVFFVYPGRAIGWMFGMAEHVWGEAYGFTAQGLGIAAVCYLVMMALAFGIAVPGGLFMPSLFLGACTGACSGLMLKAALPESWDIQPGIYALIGATSALGGVFRSSVSLVVIMVESTNGQAFVFAIIVAVIVSNLVGNYFAHGIYHAELSRSKTVAYLPRDPSSSLDGKTAADVMATPAAFLPEIAFRDAVKSLLEHTTHNGFPVVDDRGKLSGLILRSQLEVLLAASPRDAAPSASETTQSRLDLEMRTAHIQRVTKGATPGVAAGLLDETLDDIEVERIMRTNSTPRRPADADADHAGGDFASPLVDIRTYMNPAPLAVPLDYPADRAHGVFLSLALRHLPVIDDEHIVRGIITRKDLIDARPH

SEQ ID NO: 18305 - protein, 452 aa, Salmonella enterica subsp. enterica serovar Typhi str. CT18
MLSIFKPALHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPSCGRTMVHWWSQKERGGIVSVWNCAHNVGGGIPPLLFLLGMAWFNDWKAALYMPAFGAIVVALFAFAMMRDTPQSCGLPPIEEYKNDYPDDYNEKAEEELTAKQIFMQYVLPNKLLWYIAIANVFVYLLRYGILDWSPTYLKEVKHFALDKSSWAYFLYEYAGIPGTLLCGWMSDKVFRGNRGASGVFFMTLVTIATIVYWMNPAGNPNVDMACMIIIGFLIYGPVMLIGLHALELAPKKAAGTAAGFTGLFGYLGGSVAASAIVGYTVDFFGWDGGFMVMIGGSILAVILLVVVMIGEKRHHDELQLKRNGG

SEQ ID NO: 18306 - protein, 150 aa, Glycine max
MNVRVLFLALLLLASPLLQVARCKADAEDHSSIVHDAGGEPRTAASEDDDQDLDNINFGPLFLGVENSTMNKTQHTCRDGFPSCMKKEMKLPLLAPWRYRRRPIFEAQKGAGIPPIHMTLAVSQSSPFYVDHKNGGESPTSRNHGIKEGA

SEQ ID NO: 18307 - protein, 294 aa, Oryza sativa (japonica cultivar-group)
MGGDLYALDFDGVLCDSCGESSLSAVKAAKVRWPWVFEQVDAAMEEWIVEQMYTLRPVVETGYENLLLVRLLIEIRIPSARRSSVADGLSIQEILENWLKLKPTIMSEWNEDRDSLVDLFGSIRDDWIENDLSGWIGANRFYPGTADALKFSSSEVYIVTTKQGRFAEALLKELAGIEFPSERIYGLGTGLVQYFFYFLFSPVNHFIESVSLCSSPKVKVLQQLQQMPQHQGLTLHSCACAGELATSPVPTAADLRLILHKLHSVCELLRMAMEGNYVAAMGMRRLENSMTLMP

SEQ ID NO: 18308 - protein, 591 aa, Oryza sativa (japonica cultivar-group)
MRRHEATIGGDGAAAPWKEQQLASHRWPEAQEGAPAFPPSTMRRLVYSAANAALVVFIMTVPPMVVLYGARSSSPAVWISSANVGGRGSSSDESILLLHRPAAAHDKLLGGLLADGFDEGSCHSRYQSAMYRRNNAGKEPSPHLVSRLRRHEELQRRCGPGTAAYSNAVESLRSGKSGGIGSPPQTECRYLVSISYRGLGNRMLAAASAFLYAMLTDRVLLVDPSNEMGELFCEPFPGTTWLLPPGFPLTNFTSFSVDTTESYGNMLKNKVITTDAAAGDVPTPHQQLPAFAYIHLDHDYTFHDKFFFCDDDQSVLRNVPWLVMRTDSYIVPGLFLVTGFQAELDSLFPETDAVFHHLARYLFHPNNHIWGLVTRYYDAYLATARQRVGVQVRVFGARQESPKVLEQITACAHMENLLPDVITTGEPAATTRRRLKPKAVLVTSLTSWYYEKLKGMYWERATATGEAVGVHQPSHEEYQRFGSGSHDAKACAEIYLLSLSDALVTSGWSTFGYVAQGLAGLTPRVMYKPANESSAVPDPPCRRDVSMEPCFLTPPYNNCRMKRSAHSGKVVAHVKNCHDVPWGLKLVRRVE

SEQ ID NO: 18309 - protein, 565 aa, Oryza sativa (japonica cultivar-group)
MNSEGGIGAGITNRPSQQCSAAAAEDGDDYERPCPWIPGKKKKKKITCLAICLIASPILILLVSRRGSPFPSMSGWASPSRMYASKGSKRDVLMGGLLVPGLDERTCASRYSSAMYRKNTARSPCRHLVKRLREQEALQRRCGPGTAAYWRAAERLGSRRNGTAGADDEGCKYLVLVPYRGLGNRMLAMASAFLYAMLTGRALLVDRGESLADLFCEPFPGTSWLLPPEFPIKNLQDLTGEAPESYRNLVQSDRPATSVSELPYVFVDLDHGCTYHDKLFYCDDERHFLHRAPWLLMRTDGYFPPALFLNPAYQDELDRLFPRKDSVFYLLAHYLLHPTNKVWGLITRFYDSYLRDSDERLGIQVRVFDGDTPFKHILDQITACTSQERLLPEVVEQEPSSFPAPAAAATAARSKAVLMTGLNSWYYDNIRSRYWQSPTATGEVVRVHQPSHEEHQLSGSTTHDMKAMAEMYLLSMTDAIVTSGWSTFGYVGHGLGGLSPWVMFKPENLTTPDPPCRRAVSMEPCLHGPPFYDCRVKRGADTGKLVPHVRHCEDMSWGLKLVHPE

SEQ ID NO: 18310 - protein, 388 aa, Frankia sp. EAN1pec
MTTSDTATGAATGPIGSIDAIDPGPVDPVSIGPDSIAPDSVGSVGPATDGEPPASPRQTLTLAKALNTGLLSAMAADPKVVIMGEDVGKLGGVFRITDGLQARFGEDRVIDTPLAESAIVGTAIGLAMRGFRPVCEIQFDGFVYPAFDQIVSQLAKLHYRSAGRIRLPVTIRIPYGGGIGAVEHHSESPEAYFCHTAGLRVVTCSNPADAHLMIQQAVASDDPVIFLEPKRRYWEKGEVDTTPLASMPVQEQLALHTARVVRPGADATLVAYGPMVRTCLDAAQVAAEDDGSSLEVIDLRSLSPLDLDPVVESVRRTGRLVVVHEAPSNVSLSSEIAARVTEQAFYHLESPVLRVTGFDTPYPPARLEDHYLPDVDRILDAVDRSFGY

SEQ ID NO: 18311 - protein, 585 aa, Frankia sp. EAN1pec
MTHRQFRLPDLGEGLTEAEIVRWLVEVGETVTVNQPLVEVETAKAVVEIPSPFAGVLVERHGEAGTELAVGTPLLTIDEPGDEPATGPTTGSVTGATEATGQETTPGDATRNGAASLPVSRTGEAADVPGGAGTADLSPMAAGRTPMLVGYGPRSDSGPRRRRRPRNPDGPLPGSTTPAATIAAPAPAPGTAPTASSAPRAMAPVVSSVPASAPATSPASAAAGAPDRSAVVPIGAAPRHGRVAAKPPVRKLARDLGVDLSTLAGTGPAGTISRADVETAARQATPPEPAPVPTTATPTTRTGPVRVPGVVPSSNGIDGPRQPELNGHAATTRRVPGAIPPDAGFNDTDRIWRIPVTGVRRTMARAMVASVFSAPHATEFLSVDVTETMAARERIAALPDFAGIRVTPLLLVAKALLTAVRRHPMINSTWVGDTSGENAEIQVHERINLGIAVAGPRGLVVPNIPDAGSRGLVDLARSLHSLTEAARADRLRPADLSGGTITITNVGVLGVDTGAPVLNPGEAAILALGAIRPAPWVHEGELAVRTVAHLALSFDHRVVDGELGSAVLADVAAVLADPVIALAWS

SEQ ID NO: 18312 - protein, 434 aa, Rickettsia rickettsii
MTNENNNDSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLAAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAVVLKETCKEVLKELGQLDNNLLQIAIELEAIALKDEYFIERKLYPNVDFYSGIIYKAMGIPSQMFTVLFAIARTVGWMAQWKEMHEDPEQKISRPRQLYTGYVHREYKGIRER

SEQ ID NO: 18313 - protein, 1108 aa, Zea mays
  misc_feature (136)..(136): Xaa can be any naturally occurring amino acid
  unsure (1)..(1108): unsure at all Xaa locations
MTTSPPPAEHDQQQDEEVPVPHGPHQERPHGAQPMGVVPAEPAATVENQQIEDPPISRFTWTIENLSRVSTKKLYSEIFVVGGYKWRILIFPRGNNVEFLSMYLDVADSGVLPYGWTRYAQFSLSVVNQIHNKFTXRESDWGFTSFMPLGELYNHSRGYLVNDTCIVEAEVAVCKVVDYWSYDSKKETGYVGLKNQGATCYMNSLLQTLYHIPYFRKAVYHMPTTENDMPSGSIPLALQSLFYKLQYNDSSVSTKELTKSFGWDMHDSFMQHDVQELNRVLSEKLEDKMKGTVVEGTIQQLFEGHHMNYIECINVDFKSTRKESFYDLQLDVKGCQDVYASFDKYVEVEQLEGDNKYHADKHGLQDAKKGVLFIDFPPVLQLQLKRFEYDFMRDTMVKINDRYEFPLQLDLDRDDGKYLSPDADRNVRNLYTLHSVLVHSGGVHGGHYYAFIRPTLSDQWFKFDDERVTKEDAKRALEEQYGGEEELPQTNPGLNNTPFKFTKYSNAYMLVYIRESDKDKIICNVDEKDIAEHLRIRLEKDREEKERRKKEKAEAHLYTIIKVARDDDLKTQIGKDIYFDLVDHDKVPSFRIQKQMAFAQFKEEVAKEFGIPTQFQRFWLWAKRQNHTYRPNRPLCPQDEAHTVGQLKELVNKAHNAELKLFLEVELGLDLKPLPLPDKTREDIFLLFKLYEPEKEQLRYVGRLFVKASGRPQDILPKLKMLAGFSQDDDIELYEEIKFEPNVMCEYIDNRLLFRSCQLEDGDIICFQKSSKADSADRYRFPDVPSFLTYIRNRQVVHFRSLEKPKEDDFFLEMSKIFTYDQVVEKVAEKLGVDDPSKIRLTSHNCYSQQPKPQPIKYRGVERLLDMLIHYNQTSDILYYEVLDIPLPELQALKTLKVTYHHATKDEVSVHSIRLPKNSTVGDVLNDIKTKVELSHPNAELRLLEVFYHKIYKVFAPNEKIENINDQYWTLRAEEVPDEEKNLGPFDRLIHVYHFTKDTQNQTQVQNFGEPFFMVIREDETLSSIKERIQRKLKIPDEDFSKWKFAYISLGRPDYFEDSDTVALKFQRNMYGAWEQYLGLEHPDTAPRKAHTINQNRHSFERPVKIYN

SEQ ID NO: 18314 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 18315 - protein, 675 aa, Oenococcus oeni PSU-1
MTKKNRFYITTPIYYPSGKLQLGNTYTTVLADSVARFHRALGEDVFFLTGTDEHGLKIQEKAEAAGKSEMEYLDEMAVSIKKLWKLMNISYDKFIRTTDEYHERVVQHIFKKFMDEGDIYKGNYTGWYSVSDEEYFTESQLAEVYRDKDGKVIGGKAPSGHEVQLVKEETYFFKMSKYSDWLLQYYHDHPEFLQPESRMNEMISNFIKPGLEDLALTRTSFNWGIPVPGDEKHVIYVWIDALSNYITALGYDPELGDFDHQPELFKKFWPANLQLVGKEIVRFHTIYWPIMLHALGLPLPGEVLGHGWLVMKNGKMSKSKGNVVYPETLESRYGLDAVRYYLLRSMPFGNDGVFSPEDFVNRVNFDLANDLGNLLNRTISMINRYENGQIPKLDKLLPEDRELEETASQAVENFKDEMEKVHTADALEAVWTLIRRTNKYIDETEPWVLDKNKQRAELDDAMAHLAASLRVVGSLLQPVLTQAPKKIFDQLGLPEVEPISNLNFADIPSGIKVVEHPTPLFPRLDVKKEVEFISGLVQKDTKGKGRARMEAAKEKAREELQNETVEEINYDDFAKLRLIAGKIKSGEILKNSKKLIKWQIDDGSEDGRQILSGIREWYPDPSVLVGKKIAIVANLKARKMAGEISQGMILCAENSDGKVIVSELPDEVEAGAAIN

SEQ ID NO: 18316 - protein, 407 aa, Clostridium perfringens SM101
MRYIVVGASAAGISGAKTLRELDKDAEIILVSKDENVYSRCILHHYISGHRDIEALDFTDRDFFEKYNIEWKKGLEVKSIDDREHVIGLSNGESLKYDKILLATGASAFIPPVENLREAKNVVGLRNLEDAIKIKEEAEKVKNVVVLGAGLVGIDAIAGLVGKNLNVTLVEMGDRVLPIQLDKYASSKYEKRFEDAGIKLKLGVRAEKVLIDENKNPKALLINTGEEIPCELIIVATGVRSNVAFLKDSSIETDRFGLIINEKGETNARDVYGAGDITGRNPIWPTAVKEGIIAANNMVGNEIFMEDFFGSKNTMNFLGLTTMSLGVVNVPDDSYTEEIDISGENYKKIIHKDGKIYGAIIQGDLSYAGVLTQLIKEKIHVSKVKKPLFEIDYADFFNIKENLEYTY

SEQ ID NO: 18317 - protein, 374 aa, Zea mays
  misc_feature (23)..(23): Xaa can be any naturally occurring amino acid
  misc_feature (31)..(31): Xaa can be any naturally occurring amino acid
  misc_feature (40)..(40): Xaa can be any naturally occurring amino acid
  misc_feature (108)..(108): Xaa can be any naturally occurring amino acid
  unsure (1)..(374): unsure at all Xaa locations
GEVAENQRGINGSQLNMSGTGIXGSFNDRIXRDAINGGQXFGNPLQQGFSTGLFLEPNGFYQGNETETRLTLATYADHIQIGLAGNLKDYVVISHTGEARKGSEIRTXFDGSPVGYASSPIETINYASAHDNETLFDIISLKTPMDLSIDERCRINHLSTSMIALSQGIPFFHAGDEILRSKSLDRDSYDSGDWFNKIDFTYETNNWGVGLPPREKNEGSWPLMKPRLENPSFKPAKHDIIAALDKFIDILKIRYSSPLFRLTTASDIVQRVHFHNTGPSLVPGVIVMSIEDARNDRHDMAQIDETFSCVVTVFNVCPYEVSIEIPDLASLRLQLHPVQVNSSDALARQSAYDTATGRFTVPKRTAAVFVEPRC

SEQ ID NO: 18318 - protein, 502 aa, Pisum sativum
MSPLFYYSFLSLTFIITIKILLQTQSRRLKNLPPGPPTIPIIGNLHHLKHPLHRTFATLSQKYGDIVSLWFGSRLVVVISSASLVEECFIKNDVVLANRPRFLTGKYIFYDYTTLGSVSYGDHWRNLRRITTIDVLSNNRLTSFLGVRTDEANRLIQNIIKHGASRDFIKVELRSILTEMTFNGMMRMISGKRYYGDDGDVTEVEEAKQFREIISEILSLLGANNKGDFLPLLRWFDLDDLEKRCKKIANRADAFLEGLIQEHRSANHGNGDTMIDHLLKLSEVQLNIIPSHIIKGLIQAMLLAGTDTSALAIEWVMSELLNHPEVLNKAKEEIETQVGKNKIIDEQDLPKLPYLQNIISEALKLHPPAPLLLPHYSSEDCTIGGFNVPKDTIILTNVWAIHRDPTRWSDALSFKPERFEKEGEVNKLMAFGIGRRACPGLSLAQRTVGLNCGACWFQCFEWKRESEEKLDMMEGKVLPCLKRSPFKALCKGTTLLPNDLMK

SEQ ID NO: 18319 - protein, 247 aa, Oryza sativa (japonica cultivar-group)
MMPSASDAAAAAAALELQESGWEELRREARKLEGDLDVKLSSYARLAARSSSAADAASASSPSERSSWKSMEFEIQSLLDKLQDVNDAMSRCAASTAPTTSVSQKLARHRDILHEFAQEFRRTRGNLSSIREHADLLSSVRDDITESKATGGMSPRVHLLRERASIHGSINQIDEVIGQAQSTRVALSNQRALFGDVQGKVKQLGEKFPVIRGLLGAIKRKKSKDTIILSAVIAACTIFLIIYWLSK

SEQ ID NO: 18320 - protein, 560 aa, Mycobacterium avium subsp. paratuberculosis K-10
MPESAATPRRGCTTARTAPGSGAHRNASRDRDAAPTEQSVVLLDGTSSHPRELLGNKGHGIEVMRRHHLPVPPAFCLTTAVGLRYLADPAATMDAVWDDVLDRIGWLQAQTSRTFGRGPHPLLVSVRSGATQSMPGMMDTLLNLGINDSVEQALAAEHGPAFARDTHRRFREMYRRIVGVERPVPSDPYTQLRAGIEAVFASWNSPRARAYRAHYGFADRHGTAVVVQAMVFGNHGPNSGAGAFFSRNPITGDDEPFGEWLPGGQGDDVVSGSVDVEPIAALRDEQPAVYDQLMAAARTLERLDRDVQEIEFTVEDGALWLLQTRAAERSAQAAVRSALQLRREGLIDDAETLRRVTPAHVRSLLMPALQPEIRLAAPLLAKGLPACPGVVSGTAYADVDEALHAAERGEPVILVRDHTRPEDVSGMLAARGIVTEVGGAASHAAVVSRELGRVAVVGCGAGVAAMLAGRRITVDGAEGEVREGELSLSAWSENDTPELRELAEIARLISPLRAHSGGDHPRLDDDSESAVRAALAAGQTDVVSPTPLLVMLTALRQGAP

SEQ ID NO: 18321 - protein, 463 aa, Bacillus subtilis subsp. subtilis str. 168
MQKQKQELHRGLEERHISLMSLGAAIGVGLFLGSASAIQLAGPGILVAYAASGLVMFFIMRALGEMAIQKPVAGSFSRYARDYLGPLAGYLTGWNYWFLWVVTCMAEITAVGIYMGFWFPDVPNWIWALSALVIMTGVNFLAVKAYGELEFWFALIKIVAILSMIAVGLLMIIAGVGNGGIATGISNLWNNGGFFPHGLKGVLLSLQMVMFAYLGIEMIGVTAGEVKNPQKSLAKAIDTVFWRILIFYVGALFVIMSIYPWQEIGSQGSPFVLTFQKVGIPSAAGIINFVVLTAALSSCNSGIFSTGRMLFNLAEQKEAPQAYGQLTKGGIPGKAVLASAGALLVGVLLNYVVPAKVFTWVTSIATFGAIWTWAIILLSQIKYRKSLKPEEKKQLKYKMPLFPFTSYVSLAFLAFVVILMAYSPDTRVAVIIGPIWFLILLAVYYGKGFHKKNAAAASERNIS

SEQ ID NO: 18322 - protein, 632 aa, Bacillus subtilis subsp. subtilis str. 168
MCGFVGVFNKHPLAQTADQEELIKQMNQMIVHRGPDSDGYFHDEHVGFGFRRLSIIDVENGGQPLSYEDETYWIIFNGEIYNYIELREELEAKGYTFNTDSDTEVLLATYRHYKEEAASKLRGMFAFLIWNKNDHVLYGARDPFGIKPLYYTTINDQVYFASERKSLMVAQNDIEIDKEALQQYMSFQFVPEPSTLDAHVKKVEPGSQFTIRPDGDITFKTYFKANFKPVQTEEDKLVKEVRDAIYDSVNVHMRSDVPVGSFLSGGIDSSFIVSVAKEFHPSLKTFSVGFEQQGFSEVDVAKETAAALGIENISKVISPEEYMNELPKIVWHFDDPLADPAAIPLYFVAKEAKKHVTVALSGEGADELFGGYNIYREPLSLKPFERIPSGLKKMLLHVAAVMPEGMRGKSLLERGCTPLQDRYIGNAKIFEESVKKQLLKHYNPNLSYRDVTKTYFTESSSYSDINKMQYVDIHTWMRGDILLKADKMTMANSLELRVPFLDKVVFDVASKIPDELKTKNGTTKYLLRKAAEGIVPEHVLNRKKLGFPVPIRHWLKNEMNEWVRNIIQESQTDAYIHKDYVLQLLEDHCADKADNSRKIWTVLIFMIWHSINIEKRYMPEELSHQPKEVIFV

SEQ ID NO: 18323 - protein, 369 aa, Thermotoga maritima MSB8
MKKEKKDYYEILGVPRDATQEEIKRAYKRLVKEWHPDRHPENRKEAEQRFKEIQEAYEVLSDPQKRAMYDRFGYVGEQPTYQETESGGFFDDIFRDFENIFNRDIFDVFFGERPHQEERREYARRGEDIRYEIEVTLSDLINGAEIPVEYERYETCPRCGGTGVEPNAGYMDCPSCGGTGRIREERRSFFGYFVSERTCERCGGTGKIPREYCHECGGSGRVLRKVRRTVKIPPNVEDGTHLRITGGGNAGYYGGPYGDLIIIVRVKPDPRFKKSGSDLVYDVTIDYLQAILGTTVEVPLPEGGTTMLKIPPGTQPETVFRLKGKGLPNRYGRRGDLIVNVHVEIPKSLSREERKVLEELAKKRGVTIG

SEQ ID NO: 18324 - protein, 81 aa, Triticum aestivum
MGCNDKCGCAVPCPGGTGCRCTSARSDAAAGEHTTCGCGEHCGCNPCACGREGTPSGRANRRANCSCGAACNCASCGSTTA

SEQ ID NO: 18325 - protein, 420 aa, Glycine max
EAAATTTTSRKFNVEKERSELVTRDDSYVKKAKSSFYSNGYGFEPTIPSKASILDSSLKPTSTAGQDGDKLSLIKLASLIEVSAKKGTRDLKLQNKLMDQVDWLPDSIGKLSSLVTLDLSENRIMALPATIGGLSSLTRLDLHSNRITELPDSVGNLLSLLYLDLRGNQLTLLPASFSRLVRLEELDLSSNQLSALPDSIGSLVRLKILNVETNDIEELPHSVGSCSSLRELRVDYNRLKALPEAVGKIQSLEILSVRYNNIKQLPTTMSSLTNLKELNVSFNELESVPESLCFATSLVKMNIGNNFADMRSLPRSIGNLELLEELDISNNQIRVLPESFRMLTRLRVLRAEENPLEVPPREIAEKGAQAVVQYMDELVEKREKKDVKAQPLKQKKSWAQICFFSKSNKRKRDGVDYVKT

SEQ ID NO: 18326 - protein, 530 aa, Magnaporthe grisea 70-15
MATVVVKNSSCLSVLPLKTVLRSLAVTTVSSSPLLLNPSLAIMSGLAHSKSPLLNPDRNPILRWALKKTFYAQFCAGENPLEVRQTIAGLKKIGFTGVLLGYAKEVVLSDKETKELHSCTEGKASEECTQKEVIPWAEGTMETVRLVSPGDFVSVKFTGAGRQALFSLSEKLPPPPALAKAIDDICKLAAARGVRLLFDAEQQALQPGIDDWTMHYMRKHNAPGRCVVYNTYQAYLKATPSVLASHLRAAAQSAAEGKPFAVGAKLVRGAYLGSDPRHLIHDTKADTDACYDGVAAALLRQRWEGPLAGKDEGSEFPEVHMVLASHNSESVCKGREIIKRGEARTTEVAFAQLQGMADEVSCDLIASACEKDAAAVKSYKYLVWGTTGECMKYLLRRAHENRDAVQRTRSGRDAMAAEVWRRIAGTSWKSVHDSIQIVLFSHMGGVLVAGTGQADMVESNMTHLIEYRTDGSNAKVASSTLVTPFESVEKCCGVGGGFLWSLLGCRCCVNRGVVWVAGVLELLFRVVSAI

SEQ ID NO: 18327 - protein, 125 aa, Synechococcus sp. CC9311
MTSSITLVSVRALKRARQAMRCLPFRRAFYDELEHKARSSTQLSSQQNWMAISRKPLSPSSTEDDLIWLIQVGVLRREVDGQGLTERVRLTPMGRNLLDDWDGEIPSADVFQVMHHWLRRHRPRL

SEQ ID NO: 18328 - protein, 517 aa, Medicago truncatula
MAGGGLTNGGPGKRAHLYEHKFTAYFAFTCVVGALGGSLFGYDLGVSGGVTSMDDFLEKFFPDVYRKKHAHLKETDYCKYDNQVLTLFTSSLYFSALVMTFFASYLTRNKGRKATIIVGALSFLIGAILNAAAQNIPTLIIGRVFLGGGIGFGNQAVPLYLSEMAPASSRGAVNQLFQFTTCAGILIANLVNYFTDKIHPHGWRISLGLAGIPAVLMLLGGIFCAETPNSLVEQGRLDEARKVLEKVRGTKNVDAEFEDLKDASELAQAVKSPFKVLLKRKYRPQLIIGALGIPAFQQLTGNNSILFYAPVIFQSLGFGSNAALFSSFITNGALLVATVISMFLVDKFGRRKFFLEAGFEMICCMIITAVVLAVEFGHGKELSKGISAFLVIVIFLFVLAYGRSWGPLGWLVPSELFPLEIRSAAQSIVVCVNMIFTALVAQLFLLSLCHLKYGIFLLFGGLIVVMSVFVFFLLPETKQVPIEEIYLLFENHWFWKNIVREGTDQEQGKPNGKPIAP

SEQ ID NO: 18329 - protein, 482 aa, Staphylococcus epidermidis ATCC 12228
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDKIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 18330 - protein, 84 aa, Arabidopsis thaliana
MADTGKGSASASCNDRCGCPSPCPGGESCRLMMSEASGGDQEHNTCPCGEHCGCNPCNCPKTQTQTSAKGCTCGEGCTCATCAA

SEQ ID NO: 18331 - protein, 357 aa, Sinorhizobium meliloti 1021
MPKMKAAIFVAPGRIVLDEKQIPDVGPLDALMRITTTTICGTDVHILRGEYPVARGLTIGHEPVGVIEKLGSAVRGYSEGQRVIAGAICTSGHSNAALCGCHAQDGPGTKHGWKGMGGWKFGNTIDGSQAEYVLVPDAMANLAPVPDGLADEQVLMCPDIMSTGFSGAESGAVRVGDAVAVFAQGPIGLCATAGARLIGATTIIAVESVPARMEMARRMGADDVVDFTVSDPTAEIMRLTDGRGVDVAIEALGRQETFEGALRVLRPGGTLSSLGVYSGDLRIPLDGFLAGLGDHTIRTTLCPGGKERMRRLMEVIASGRVDTRPLVTHRFKLDQIEEAYDLFANQRDGVLKVAINP

SEQ ID NO: 18332 - protein, 325 aa, Debaryomyces hansenii CBS767
MCILISSIEHPDYPFILLSNRDEYFKRPTQRAHFKDYDGVRVLSPLDLGRQEHGTWIAVNTDGKLAVLVNYREKSNKDQISEISRGVLPLQYLISDELNEEWYTKLNKLISEKLPLGILDTVDDNVLSRIGGFSILYGQLNINKSTGTIEPLNILSNRGDVGKIFESNGDTSISDDIEIQKTFGLSNSLYNDPWRKVELGQKMLKETIQNSVKDNYTHDQLIESCFEILSYDTYNRNVAKNGTPHEAILELRNSIYIPPIELGTVNQLPDSSTVGKFYGTRTQTIIILDKKGNMHYYERDIHSSDSIDKNVKSKTNHFQFNISNK

SEQ ID NO: 18333 - protein, 590 aa, Arabidopsis thaliana
MAMVDEPLYPIAVLIDELKNDDIQLRLNSIRRLSTIARALGEERTRKELIPFLSENSDDDDEVLLAMAEELGVFIPFVGGIEFAHVLLPPLESLCTVEETCVRGKAVESLCKIGSQMKENDLVESFVPLVKRLAGGEWFAARVSACGIFHVAYQGCTDVLKTELRATYSQLCKDDMPMVRRAAASNLGKFATTVESTFLIAEIMTMFDDLTKDDQDSVRLLAVEGCAALGKLLEPQDCVARILPVIVNFSQDKSWRVRYMVANQLYELCKAVGPDCTRTDLVPAYVRLLRDNEAEVRIAAAGKVTKFCRLLNPELAIQHILPCVKELSSDSSQHVRSALASVIMGMAPILGKDSTIEHLLPIFLSLLKDEFPDVRLNIISKLDQVNQVIGIDLLSQSLLPAIVELAEDRHWRVRLAIIEYVPLLASQLGIGFFDYKLGALCMQWLQDKVYSIREAAAAANNLKRLAEEFGPEWAMQHLVPQVLDMVNNPHYLHRMMVLRAISLMAPVMGSEITCSKFLPVVVEASKDRVPNIKFNVAKLLQSLIPIVDQSVVDKTIRQCLVDLSEDPDVDVRYFANQALNSIDGSTAAQS

SEQ ID NO: 18334 - protein, 149 aa, Triticum aestivum
  misc_feature (123)..(123): Xaa can be any naturally occurring amino acid
  unsure (1)..(149): unsure at all Xaa locations
LAWSRPRSPHLTWGVRQAHSFLTFATSTPMQSAAAAALRAPDSYFEELKRDYGVKKALLVDGLKAAGFIVYPSSGTYFVMVDHTPFGFDNDIEFCEYLIREVGVVAIPPSVFYLNPEDGKNLXVRFTFCKDDSTLRAAVDRMKAKLRKK

SEQ ID NO: 18335 - protein, 113 aa, Rickettsia akari str. Hartford
MSLLDKLYRKGIKLEELTDIFAIRIVVIDEEQCYKALKVVHDLYVHGNDKFKNYVLNPKPNGYQSLHTIITTEDNYKIEIQISFILYCFEVEKRNFVNQHFEILLFVLKGNVA

SEQ ID NO: 18336 - protein, 557 aa, Moorella thermoacetica
MSKVPSDIEIAQAAKMKPVMELARGLGIQEDEVELYGKYKAKISLDVYRRLKDKPDGKLILVTAITPTPAGEGKTTTSVGLTDALARLGKRVMVCLREPSLGPSFGIKGGAAGGGYAQVVPMEDINLHFTGDIHAVTYAHNLLAAMVDNHLQQGNVLNIDPRTITWRRVIDLNDRALRNIVIGLGGKANGVPRETGFDISVASEVMACLCLASDLMDLKERFSRIVVGYTYDGKPVTAGDLEAQGSMALLMKDAIKPNLVQTLENTPAFIHGGPFANIAHGCNSIIATKTALKLADYVVTEAGFGADLGAEKFYDVKCRYAGFKPDATVIVATVRALKMHGGVPKSDLATENLEALREGFANLEKHIENIGKFGVPAVVAINAFPTDTEAELNLLYELCAKAGAEVALSWAKGGEGGLELARKVLQTLESRPSNFHVLYNLDLSIKDKIAKIATEIYGADGVNYTAEADKAIQRYESLGYGNLPVVMAKTQYSFSDDMTKLGRPRNFTITVREVRLSAGGRLIVPITGAIMTMPGLPKRPAACNIDIDADGVITGLF

SEQ ID NO: 18337 - protein, 450 aa, Bacillus cereus ATCC 14579
MMKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPEIEGQHIYDVECVKEVDRVMTWELSETIAAFIMEPIITGGGILMPPQDYMKAVHEMCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKDEIGEHPLVGNIRGKGLLVGIELVNDKETKEPIDNDKIASVVNACKEKGLIIGRNGMTTAGYNNVLTLAPPLVISSEEIAFVVGTLKTAMERI

SEQ ID NO: 18338 - protein, 346 aa, Oryza sativa (japonica cultivar-group)
MGVPSAPAPDAHRRGVFLLSVGAGGGGAGTAVVEVEVEHPHSLSLSPPPMSSCGRYILHRVCRFDTLAGVAIKYGVEVADVKRVNGLTTDLQMFAHKTLRIPLPGRHPPAATATATAPSHPPPSSSPAATHRPREWATRRPPKNSALDPLLKPPQSTVAPSMDLLQNYYGLARPPKGDPENEGTEMATYSIGQHTKARSLSTGFSLVNGEVDDAEKPIRRRQKSDAEFSTREGNSGGVLMKAGPGLALRPKSGSRPEINNSQQDLVATAVPSYGDGLQAVRKSSSTPEFQDSDNSIASVWLKSKWNLKPDAFTLPLPILLLDSIPKPIFDTFPKQIAAWRNKAARD

SEQ ID NO: 18339 - protein, 543 aa, Clostridium difficile 630
MKVLIIGGVAAGTKTAAKIKREMGDNCSVTILNKGDDISYAGCGLPYYVGKIIEDKSSLIVNTPESFSKLTGAEVRCGVEVTSIDRNAKQVTLKTLSTGEKENLSYDKLVIATGADPIKPPIPGIDLPGVFFMRTPNDAIKLRDSIENGIKRAVVIGGGFIGLEIAENLSAMGIRVSVVDMAEHVMPGFDTDFAEYVENHMADKGIMIFTGDQVVGIEGENKVEKLRTKNRAIKTDLVVMSVGIRPNTGFLKDTGLEFAPNNTIIADEYMLTNDKDIYVVGDCAFVKNSLTNKPTWSPMGSSANHEGRICAQNISGKSKTYNGVLGTTVVKLPELNAGKTGLSKEIAEKEGYNVCSVTIATDDKAHYYPGASNFIIRMVAEKNTRKLLGVQVMGPGAVDKIVDIAATAITLGADLYSLESMDLAYAPPFSTAIHPFVVAVNVLQNKLNGELDSVLLDEIEDFDSWTKLDVSKAPSIPSLRYIPVGEINGEIEGLAKDEKILLICAKGKNSYMAQNRLRRFGYTNTKVLEGGILFYPNLKVMEE

SEQ ID NO: 18340 - protein, 183 aa, Bacteroides thetaiotaomicron VPI-5482
MGTVYAFFADGFEEIEAFTAVDTLRRAGLNVEIVSVTPDEIVMGAHDVSLLCDINFDNCDFFDADLLLLPGGMPGAATLDKHEGLRKLLLDFAAKGKPIAAICAAPMVLGKLGLLKGRKATCYPSFEQYLEGAECVSEPVVRDGNIITGMGPGAAMEFALAIVDLLVGKDKVDELVEAMCVKR

SEQ ID NO: 18341 - protein, 378 aa, Burkholderia vietnamiensis G4
MAKRDYYEVLGVAKNASDDEIKKAYRKLAMKYHPDRNPDNKDAEEHFKEAKEAYEMLSDGQKRAAYDQYGHAGVDPNMAGAGGQGFGGFADAFGDIFGDIFGQAAGGAARGGRGGPQVYRGADLRYSMEITLEQAAHGYDTQIRVPSWVSCEVCHGSGAKPGTKPETCPTCHGQGTVRMSQGFFSIQQTCPKCHGTGTYIPEPCAHCHGSGKVKETKTLEVKIPAGIDDGMRIRSAGNGEPGINGGPPGDLYVEIHIKPHAVFERDGDDLHCQMPIPFTTAALGGEIEVPTLAGRASFPVPEGTQSGKTFRLRGKGIKGLRSSIAGDLYVHVQVETPVKLTDQQRDLLKQFEKSLAEGGARHSPQSKSWFDRMKSFFE

SEQ ID NO: 18342 - protein, 465 aa, Oryza sativa (japonica cultivar-group)
MGRKIKVKKKKASSKKAEASSSRVPSCPAKVWQPGVDTLEEGEELQFDPQAYNYLRGFNIGWPCLSFDVVRDQLGLVRSEFPHTLYGVAGTQAERASWNYIGIFKICNINGKKREPIPASAIDGDSDMDSESSSDEEDEAANEDTMPILHLKKVAHAGCVNRIRSMNQEPHICATWGDTGHVQVWDFSSFLNSLAESGAVAHNEDDRIHNHVPVKIFGGHKDEGYAIDWSPLVTGRLVSGDCNKCIHLWEPTSNSWNVDTNPFVGHTASVEDLQWSPTEADIFASCSADRTISIWDIRTGKKPCISVRAHNADVNVISWNRLASCMIASGCDDGSFSIRDLRLIKDDSLVAHFEYHKHPITSVEWSPHEPSTLAVSSADHQLTIWDLSLEKDAEEEAEFRARMREQADAPEDLPPQLLFVHQGQKDLKELHWHPQIPSMIISTAADGFNMLMPSNIDTTIREADA

SEQ ID NO: 18343 - protein, 109 aa, Brassica napus
EELMLSVPHDYGSVKLQVFDYDTFSADDIMGEAEIDIQPLITSAMAFGDPEMFGDMQIGKWLKSNDNALIEDSIINIADGKVKQEVQIKLQNVESGELELELEWLPLEQ

SEQ ID NO: 18344 - protein, 154 aa, Bacteroides thetaiotaomicron VPI-5482
MIEKTLVILKPCTLQRGLVGEITHLFERKGLRLAGMKMMQLTDELLSEHYAHLSSKPFFQRVKDSMMATPVIVCCYEGVDAIQAVRTLAGPTNGRLAAPGTIRGDYSMSFQENIVHTSDSPETAAIELTRFFKPEEIFDYKQATFDYLYANDEY

SEQ ID NO: 18345 - protein, 420 aa, Robiginitalea biformata HTCC2501
MKGKDLLGIAKDFGAPVYVYDAGKIQSQFKRLTHAFRVVPKLKLNYAAKALSNLSILRLLNNLGSGLDTVSIQEVQLGLLAGYRPEDIIYTPNGVSLEEIEEAASLGVQINIDNLSILEQFGSKHPDIPVCIRINPHVMAGGNSKISVGHIDSKFGISIHQIPHLLRIVELTKMKINGIHMHTGSDILDIDVFLYASEILFDTAMHFKDLEFIDFGSGFKVPYKEGDIETNVEELGEKLGGRFREFCDAYGRELTLAFEPGKFLVSEAGYFLARVNVVKQTTSTVFAGVDSGFNHLIRPMLYGANHHIENLSNPGGKERYYSVVGYICETDTFASNRRIREISEGDILCFRNAGAYCFTMASNYNSRFRPAEVLWMDGKAHLIRKRENFEDLIRNQVDVPALAERPRQTADPNEAHSRVK

SEQ ID NO: 18346 - protein, 182 aa, Bordetella pertussis Tohama I
MQTDYAELVRRTIRSVPDWPTPGVTFRDITPVLQDPRTFRVLIDLFVYRYMRQRLDLVAGVDARGFIVGAVLAHELNLGFVPVRKKSKLPYRTVAEEYSLEYGNAAVEMHTDSVRTGQRVLLVDDLIDTGGTMLAAIKLLQRLGANVVEAAAIIDLPYLGGSAQITATGTPLYTVCQYQEGD

SEQ ID NO: 18347 - protein, 252 aa, Bacteroides thetaiotaomicron VPI-5482
MRKNIVAGNWKMNKTLQEGIALAKELNEALANEKPNCDVIICTPFIHLASVTPLVDAAKIGVGAENCADKASGAYTGEVSAEMVASTGAKYVILGHSERRAYYGETVAILEEKVKLALANGLTPIFCIGEVLEEREANKQNEVVAAQMESVFSLSAEDFSKIILAYEPVWAIGTGKTASPEQAQEIHAFIRSIVADKYGKEIADNTSILYGGSCKPSNAKELFSNPDVDGGLIGGAALKVSDFKGIIDAFNA

SEQ ID NO: 18348 - protein, 144 aa, Synechococcus sp. CC9311
MLTGLFFCRPKWIGFKKEKLMVMLNPISLFALILCISLNLLGVSPASAASSPSGDLDHGGQLFSANCAACHMGGGNVISASRTLSQSDLQAHLNEYGDDHLEAIEHQIEKGKNAMPSFVGKLSEQDILDVAAYVELKAEKGWQR

SEQ ID NO: 18349 - protein, 229 aa, Thermoplasma acidophilum
MIFLDYDGTLVPIIMNPEESYADAGLLSLISDLKERFDTYIVTGRSPEEISRFLPLDINMICYHGACSKINGQIVYNNGSDRFLGVFDRIYEDTRSWVSDFPGLRIYRKNLAVLYHLGLMGADMKPKLRSRIEEIARIFGVETYYGKMIIELRVPGVNKGSAIRSVRGERPAIIAGDDATDEAAFEANDDALTIKVGEGETHAKFHVADYIEMRKILKFIEMLGVQKKQ

SEQ ID NO: 18350 - protein, 331 aa, Thermus thermophilus HB8
MKVGINGFGRIGRQVFRILHERGVEVALINDLTDNKTLAHLLKYDSTYGRFPGAVGYDEENLYVDGKAIRATAIKDPREIPWKQAGVGVVVESTGVFTDGEKARAHLEAGAKKVIITAPAKNEDITVVLGVNHEQYDPAKHHILSNASCTTNSLAPVMKVLEEAFGVEKALMTTVHSYTNDQRLLDLPHKDLRRARAAALNIIPTTTGAAKATALVLPSLKGRFDGMALRVPTPTGSISDITALLKREVTAEEVNAALKAAAEGPLKGILAYTEDEIVLRDIVMDPHSSIVDGKLTKAIGNLVKVFAWYDNEWGYANRVADLVELVLKKGV

SEQ ID NO: 18351 - protein, 390 aa, Thermus thermophilus HB8
MRTLLDLDPKGKRVLVRVDYNVPVQDGKVQDETRILESLPTLRHLLAGGASLVLLSHLGRPKGPDPKYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGRSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGQAIAALEGAFTVVGGGDSVAAVNRLGLKERFGHVSTGGGASLEFLEKGTLPGLEVLEG

SEQ ID NO: 18352 - protein, 390 aa, Bacillus sp. B-0618
MSTHFDVIVVGAGSMGMAAGYQLAKQGVKTLLVDAFDPPHTNGSHHGDTRIIRHAYGEGREYVPLALRSQELWYELEKETHHKIFTKTGVLVFGPKGESAFVAETMEAAKEHSLTVDLLEGDEINKRWPGITVPENYNAIFEPNSGVLFSENCIRAYRELAEARGAKVLTHTRVEDFDISPDSVKIETANGSYTADKLIVSMGAWNSKLLSKLNLDIPLQPYRQVVGFFESDESKYSNDIDFPGFMVEVPNGIYYGFPSFGGCGLKLGYHTFGQKIDPDTINREFGVYPEDESNLRAFLEEYMPGANGELKRGAVCMYTKTLDEHFIIDLHPEHSNVVIAAGFSGHGFKFSSGVGEVLSQLALTGKTEHDISIFSINRPALKESLQKTTI

SEQ ID NO: 18353 - protein, 414 aa, Thermus thermophilus HB8
MDLDAFTLFERHINPGLAGLLRFTGLDRVESHAEGPYVWDTQGKRYLDFLGLYGTLNLGHRHPKVVEAVKRQLDRMPMSVRVLVSEPTARLAAKLAEITPEGLEMVFFGNSGAEAVEAAIKLARAYTGKPGIVTTQGGFHGKTMGALSLTPKPEYQDPARPLLPGVKVVPYGDLKALEEAIDETTAAVIVEPIQGEGGIRVPPEGYLRGVRELTREKGVLMIADEVQTGLGRTGKLFGVDWEGVSPDLMTLAKALGGGVMPIGACVGRREVFEVFKNNPLFHSSTFGGNPLAAAAALAAIEVTLEEDLPGRALELGRHLMEGLKVLKEEHPHLIEDVRGRGLMVGVEFADADIGALVVAEMAERGVLTAFGLNNPKVVRLEPPLIIGKEHVDEALAVFAEALKATEKALEGLLG

SEQ ID NO: 18354 - protein, 662 aa, Staphylococcus epidermidis ATCC 12228
MFNEKDQLAIDTIRALSIDAIEKANSGHPGLPMGAAPMAYTLWTRHLNFNPQSKDFFNRDRFILSAGHGSALLYSLLHVSGSLELEELKQFRQWGSKTPGHPEYRHTDGVEVTTGPLGQGFAMSVGMALAESHLAGKFNKDQFDIVNHYTYVLASDGDLMEGISHEAASFAGHNQLDKLIVLYDSNDISLDGDLDKSFSEDTKQRFEAYGWNYILVENGNDLDEIDNAITQAKSQQGPTIIEVKTIIGFGSPNKAGSNGVHGAPLGEEERALTFKEYGLDPEKRFNVPEDVYEIFKSTMLKRANENEEAWNNMLKNYSEAYPELAEEFKLAMSGKLPNNYADALPEYDLNHSGASRADSGEIIQKLSEFVPSFFGGSADLAGSNKSNVKEAKDYNKDTPEGKNVWFGVREFAMGAAINGMAAHGGLHPYAATFFVFSDYLKPALRLSSIMGLNSTFIFTHDSIAVGEDGPTHEPIEQLAGLRAIPNMNVIRPADGNETRVAWEVALESEHTPTSLVLTRQNLPTLDVDKQTVENGVRKGAYIVFETEQQLEYLLLASGSEVNLAVEAAKELEQQGKGVRVISMPNWYAFEQQSSEYKESILPSDVTKRIAIEMASPLGWHKYVGIEGKVIGINSFGASAPGDLVVEKYGFTKENILKQVRSL

SEQ ID NO: 18355 - protein, 130 aa, Glycine max
MVLMSVLSNCLISLTNAEKRGKRQVLIRPASKVVIKFLEVMLRHQYIGEFEVVDDRRSGKIVVHLNGRINKAGVISPRFDVTLSEMDKWTNQLLPSRSFGQVVLTTSYGIMDHEEAKRKHTGGKVLGYFF

SEQ ID NO: 18356 - protein, 323 aa, Clostridium difficile 630
MKKVISIGEALIDFIPNQNGGKLKNVSEFRRVAGGAPANVSAVVAKLGGKSSFISKLGKDAFGDYIIDVLNEVNVNTDYVLRTSKANTGLAFVSLKEDGNRDFSFYRNPSADMLLEADEVKKEWFNNCHILHFCSVDLIDSPMKLAHKKAIEYALESNSIISFDPNIRLPLWDSEQSCKKAISEFLPFAHIVKISDEELEFITGENDIEKSLHKLFVGNVELVLYTKGKDGVDAYTKKVKGMCKGVKVNAIDTTGAGDSYIGSFLYTLLYKQITLNDIKEMKQETLNEYLEFSNYYAARSTTIKGAISSYATKEEITEFIKNL

SEQ ID NO: 18357 - protein, 403 aa, Clostridium difficile 630
MYSNEDYKFIEENAPCYIYDETNIIEKCKELKNNILGFDFLYSIKTNPYNKIVKSIAEQGFGADASSTNEVMISSKCGVSKDDIYYSSPGKTEIDIETVLDKCIIIADSITEIELINKISKKHNQKVKIGIRINPDFTMDDDSAKSSKFGIDIEDMSSVFKMLSMCDYVSVVGIHIHIKSQVLDFEKLGHYYEKCFFIALNLNKSKYINIEFINFGSGLGVAYDNLRENPLNLKELSKLTQKIAFTNSNTLKSRLLIESGRFIVCKSGNYYVKIVDIKVSRGKKYLIVKNGLNGFMRPIISNLIENITCGVELEGQEPLYTSNHAFSLSVLNNLKEEEYVNVVGNLCTSLDVIANNVKLKKANIGDLISISNAGSYSYSLSPLLFSSYEFPKQYYKRKDGYIE

SEQ ID NO: 18358 - protein, 554 aa, Shewanella sp. ANA-3
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNFYVASEMKALMPVCKTVAEFQPGQYLYSSIGEPVQYYTRDWQSFDAVKDNGASQEELRDALEAAVKRQLMSDVPYGVLLSGGLDSSVISAITQTFAKRRIEDDDQSGAWWPQLHSFAVGLKGAPDLAAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLPSAAETVPGGKSVACSTPEALAWDESLRGIIDPSGRAVRSVHAASY

SEQ ID NO: 18359 - protein, 393 aa, Bacteroides thetaiotaomicron VPI-5482
MQKESQTYKIAPAERLASVSEYYFSKKLKEVAQMNAEGKDVISLGIGSPDMPPSKVTIETLCNNAHDPNGHGYQPYVGIPELRKGFAAWYQRWYGVELNPNTEIQPLIGSKEGILHVTLAFVNPGEQVLVPNPGYPTYTSLSKILGAEVISYDLKEEDGWMPDFEALEKMDLNRVKLMWTNYPNMPTGANATPELYERLVDFARRKNIVIVNDNPYSFILNEKPISILSVPGAKECCIEFNSMSKSHNMPGWRIGMLASNAEFVQWILKVKSNIDSGMFRAMQLAAATALEAEADWYEGNNHNYRGRRHLAGEIMKTLGCTYDENQVGMFLWGKIPASCKDVEELTEKVLHQARVFITPGFIFGSNGARFIRISLCCKDAKLAEALERIKKLS

SEQ ID NO: 18360 - protein, 542 aa, Triticum aestivum
FASISFRFWVLAGTERREKRRRVRASPPEMRGVDGAAAAAGVWGGLNSGVVLSIIAVLWTVVWQNLQHLQLQHFVKRNLGRHARRLAALVDPYLSVTIAEYDGGRMRRAEAFEEVKAYLAAATSRSARHLRAEGAPDADRLVLSMVDGEEVPDQLLPEEGGGAVFWWASSRPAPPQDRRWGGGWGGGDEENRRFYRLSFLDRHREQVLNAYLPRVRRQGRAVMVQNRRRKLFTNISSHQFGDGGYARSAWTHVPFQHPKTFATLAMDPASKKEVIDDLDAFKAGKEWYERVGKAWKRGYLLHGPPGTGKSAMIAAMANHLDYDVYDIELTSVHSNTDLRKLFIGTTSKSIIVIEDIDCSLDLTGAREKKKDAAPEEVDKASKGDKKGAADASSKVTLSGLLNFIDGLWSACGGERVIVFTTNHLEKLDPALIRRGRMDKHIEMSYCRGPAFEFLAKAYLGVDEHELFGAVGALLREVDMTPADVAENLTPKSAEDDAGSCLRGLVAALEKARDDKASGGGGGKEEKRPEEEDGGAVAAVDKE

SEQ ID NO: 18361 - protein, 427 aa, Thermotoga maritima MSB8
MEIVDVRAREVLDSRGNPTVEAEVVLEDGTMGRAIVPSGASTGKFEALEIRDKDKKRYLGKGVLKAVENVNETIAPALIGMNAFDQPLVDKTLIELDGTENKSKLGANAILAVSMAVARAAANYLGLPLYKYLGGVNAKVLPVPLMNVINGGQHADNNLDLQEFMIVPAGFDSFREALRAGAEIFHTLKKILHEAGHVTAVGDEGGFAPNLSSNEEAIKVLIEAIEKAGYKPGEEVFIALDCAASSFYDEEKGVYYVDGEEKSSEVLMGYYEELVAKYPIISIEDPFAEEDWDAFVEFTKRVGNKVQIVGDDLYVTNVKRLSKGIELKATNSILIKLNQIGTVTETLDAVEMAQKNNMTAIISHRSGESEDTFIADLAVATNAGFIKTGSLSRSERIAKYNQLLRIEEELGKVAEFRGLKSFYSIKR

SEQ ID NO: 18362 - protein, 282 aa, Shewanella sp. ANA-3
MGSVTTKKHANGLDYVEVNTALCQARIFLQGAQIDHFQPVGKPPLLWVSSADDYQPGNGIRGGVPVCWPWFGMSNQANFPQHGFARTRIWTLESVEMRNQLVDLRFSLTISEEDKVFWPHHTQVNVLFTLGETLSISLVNTNLGDVPVTLTQALHSYFPIEDIHQLKATGFSGAQYIEFAEGPYPQTTDDVLFDRETDRVYTKLGPVQHLYTPQGVIEVSRENSHSAVLWNPWIEKSTRLARFNDDDYLTMVCLEAANVLEDKLTLAPGESHSLVTHIRWAD

SEQ ID NO: 18363 - protein, 634 aa, Oryza sativa (japonica cultivar-group)
MVGMLPETNAQAAAEEVLGDAWDYRGRPAARSRTGRWGAAAMILVAELNERLTTLGIAVNLVTYLTATMHAGNAEAANVVTNFMGTSFMLCLLGGFVADSFLGRYLTIAIFTAVQAPGVTILTISTAAPGLRPAACAAGSAACERATGAQMGVLYLALYLTALGTGGLKSSVSGFGSDQFDESDSGEKSQMMRFFNWFFFFISLGSLLAVTVLVYVQDNLGRPWGYGACAAAIAAGLVVFLAGTRRYRFKKLVGSPLTQIAAVVVAAWRKRRLELPSDPAMLYDIDVGKLAAAEVELAASSKKSKLKQRLPHTKQFRFLDHAAINDAPDGEQSKWTLATLTDVEEVKTVARMLPIWATTIMFWTVYAQMTTFSVSQATTMDRHIGASFQIPAGSLTVFFVGSILLTVPIYDRLVVPVARRATGNPHGLTPLQRIGVGLVLSIVAMVFAALTEVRRLRVARDARVGGGEAVPMTVFWLIPQFLFVGAGEGFTYIGQLDFFLRECPKGIKTMSTGLFLSTLSLGFFVSSALVAAVHKLTGDRHPWLADDLNKGQLHKFYWLLAGVCLANLLFTCRQRAANELAAQDAVAGLMALSNGPIQGAGVDKDSNSGDVVCKVKRTEYSPPIEDEYDDTGDP

SEQ ID NO: 18364 - protein, 350 aa, Saccharomyces cerevisiae
MGLFSRKRDHTPAVPKEKLIPCDKIFLDPPAKYGNAPLLEPISEDQNEKYRAVLRHFQDDDLKLPENLNDLDNGTHANDRPLSDWEKFWLSRECFLRYLRANKWNTANAIKGLTKTLVWRREIGLTHGKEDKDPLTADKVAVENETGKQVILGFDNAKRPLYYMKNGRQNTESSFRQVQELVYMMETATTVAPQGVEKITVLVDFKSYKEPGIITDKAPPISIARMCLNVMQDHYPERLAKCVLINIPWFAWAFLKMMYPFLDPATKAKAIFDEPFENHIEPSQLDALYNGLLDFKYKHEVYWPDMVKKVDDLRLKRFDRFLKFGGIVGLSEYDTKGQHDELKYPVDMVI

SEQ ID NO: 18365 - protein, 108 aa, Brassica napus
MHTDQKKRKNKSKQKQRKHHLFTRMKSTRTCITCFVVCSMLLLAFSNIFSRHPWDLDPPNVTTTTGSKNPENPRDTLQGGLLAKAFDQKSCLSRYQSSLYRKPSPYKP

SEQ ID NO: 18366 - protein, 443 aa, Bacillus halodurans C-125
MSQSIQTQEEDLKSLLTRRERIVPRGVVNNIQTFAKEAKGAIVIDVEGKSYIDFAGAIGTINVGHSHPKVVQAVQQQADQFIHTGFNVMMYESYIELAERLAALAPGSFEKKVLLQNSGAEAVENAVKMARKYTGRQGIVSFSRGFHGRTLMTMTMTSKVKPYKFGFGPFAPEVYKAPYPYEYRRPEGMSEDAYHAYVLQEFIQFMNVEVAPESVAAVVMEPVQGEGGFIVPSKSFVQGVYRYCKEHGILFIADEIQTGFARTGHYFASEHFEIEPDLLTVSKSLGAGVPISGVIGRREVLDEASPGELGGTYSGSPLGCAAALAVLDIIEEEGLNERARKLGQVVMDKMAQLQEQYECIGHIRGLGAMCAMEVVKDRHTKEPDKELTAKIVSEAGNRGLLLLSAGQYGNVLRFLMPIVITDEQLNNGFAILEEALATAIVNR

SEQ ID NO: 18367 - protein, 337 aa, Oenococcus oeni PSU-1
MNALVLDKMNHLELENLEKPTPKNNEVLIKVAYVGVCGTDKALYQGLPGSADAVPPIVLGHEDSGTVVEIGESVTNFEVGDRVAIDPNIYCHKCDFCRTNRPELCTNLSAVGVTRNGGLEEYVAVPEEVAYKLPDNVSFKQAALTEPLSCVVHGVDLLAIKPFQEAIVLGDGFTGQLFVKTLKAYGVSKVTISTRHLDDEKHVDFLKKVVGADEVVDARSNDFDKDYDVVVEAVGSADVQEQAVKAAAHGGQVLMFGVGKPEQKFSVSSYEIFQKQLTVQGSFINPYTFKAAIAMIAAGKIDPSELVSMELKAAKMNDYLSGKIRTNKAVLNIEAAF

SEQ ID NO: 18368 - protein, 437 aa, Mesembryanthemum crystallinum
MEMERVTEFPLTHHLDRRRRKRARLGWDVAPQISKAQIGIFCGQEVGNVTSFAPSAAPSEHTTTTSSLFSKGVARNGSPRQGGMMTKMGITCLSFGENLTSRYKIHGKMGEGTFGQVLECWDRERKEMVAIKIVRGIKKYREAAMIEIDVLQQLGKHDKGGSRCVQIRNWFDYRNHICIVFEKLGSSLYDFLRKNNYGPFPIDLVRENGRQLLDCVAFMHDLHLIHTDLKPENVLLVSSDYVKIRDYKGFSRSPKDSSYYKKVPKSSAIKVIDFGSTTYERPDQNYIVSTRHYRAPEVILGLGWSYPCDVWSVGCILVELCSGEALFQTHENLEDLAMMERVLGPLPQHMLKRVDRHAEKYVRRGRLDWPEGAASRESIRAVTKLLRLQNLVMQHVDHSGGDFIHLLQGLLRYDPSDRLTAREAVRHPFFTRDNLRR

SEQ ID NO: 18369 - protein, 468 aa, Bacillus halodurans C-125
MDLYINGEWMRSGKTLDVTNPATGEVIDTVPFAGKKEAELAVSAAYEAFPQWSSQTASERSRYLMRWFQLIDEQQDEIGEIMTKEQGKPLREAIGEVQYANSFIQWYAEEAKRIYGDTIPASAINKRILVQKQPVGVIAAITPWNFPAAMITRKVAPALAAGCTAIVKPAEQTPLTALKLAQLAEEAGIPAGVLNVITGNAQDIGEAWLEDSRVRKITFTGSTEVGKLLMRGAAQTVKKISLELGGHAPFIIMDDANLEEAVDQVIASKFRNAGQTCVCANRIYVAREIAEAFTEKFAAKVNELKVGNGLEEGVTIGPLIDKAAVEKVEAHIHDALKKGGQVTVGGRWTNHFFEPTIITGATDEMLCMNEETFGPLAPVATFDTEEEVIERANHTPYGLAAYVFTENIGRAIRLSEKLEYGIVGVNDGMPSVAQAPFGGWKESGLGREGGKYGIEEYLEVKYVSVAFK

SEQ ID NO: 18370 - protein, 1070 aa, Francisella tularensis subsp. holarctica
MQATNQNIWIQDKFGNFTHLNATHQVYLDFETNSIRFRIQADGFLHGYVIANFNNWQKLEEYKLTWTTDNDDGSLWLTKDVFNISTLNAGTNQYSFILVSLAGEEFKVSINDHDLIPLSFNWQVAKGTLEIKASENYVVSGFNLELIAITKSITGYQNIVDVEWQVSPQNSKITLTNGKLLIDPSVSNLTEVKVSCFAKNNPDLKAERIFTVIKEKRKGSLVHFIKKDQQYKGENFDWDLWNFNKNKPAYSVSLSHRSDFGLYGLCQKKNVIARKRIWDINWHNDWAEQTSCFKISKKHQNYYIVHGDATIYRSLEDVINKTNPRIIHAVMNEASRIIAYLSDIPRIGTSFELWVNSKKVENVGLIVKHRSKQLIFTGLPPINPHDLVEIRANNTFSAAKVLMGEYLNNFYYPNNIGVSFSDELISLRIWSPTAIKVEVLIYNEDLDNNKKQPDVVHELTAERSYGTHHIEICRKNYENKYYIYRLYFEDLDNKGQRCIKTTYAVDPYAYGVGINGRKGFLVDLNNPKVTPEQWQQSHNPNCLNREDAIIYEAHLRDFTISPESGVSEELRGKYLGAVENNTYYIDSATNQKVSTGIDSLVELGVTHIHLLPIFNFSSVDEEKNNEKDNRNWGYDPQNYNAPDGSYSINPYDPLQRIRGARNMILGFHQKGIGVIMDMVYNHMTETSNLDKIVPKYYFRTDALGNFTNGSGCGNELASEKPMVSKFIQDSVIHWVKNYKIDGIRFDLMELIDINTIKNIVSKVKQINPNVIIYGEPWKGGDSPLINGTHRGTQRNQQFSIFNDYFRDAIRGNNNPGSGFINGDPHNPSNIGNVIEGLHGSIYSLTAMPGESVNYIDAHDNYTLWDQVEKSQSHDIPQGYYRKNLPENIFEHRFVRQNALALGIILTAQGIPFIHGGSEFLRTKQGDHNSYKSGDNINAFHWSDKLRYKAFFDYIAGLIRIRKEHPAFRMRDRETIEKHLNITTAHHDSKSGVIISHFKNNTNGDSWQDIIVIYNATSIDGYDVNALMPISAGKIWHIVANHEKAGVDTIQTVNSSELPGLKSYSLMIIHS

SEQ ID NO: 18371 - protein, 655 aa, Streptococcus pneumoniae TIGR4
MSLQSVNAIRFLGVDAINKSNSGHPGIVMGAAPMAYSLFTKHLRITPEQPNWINRDRFILSAGHGSMLLYALLHLTGYKDVSMDEIKNFRQWGSKTPGHPEVTHTSGVDATSGPLGQGISTAVGFAQAERFLAAKYNKDGFPIFDHYTYVIAGDGDFMEGVSAEAASYAGHQALDKLIVLYDSNDICLDGETKDTFSENVRVRYDAYGWHTVLVEDGTDLAAISTAIETAKFSGKPSLIEVKTVIGYGSPNKSGTNAVHGAPLGAEETGATRKFLGWDYDPFEVPEEVYSDFKTNVADRGQEAYDAWASLVSDYKVAYPEVASEIDAIVAGKSPVTITEKDFPVYENGFSQATRNSSQDAINTAAVLPTFLGGSADLAHSNMTYIKADGLQDKYNPLNRNIQFGVREFAMGTILNGMALHGGLRVYGGTFFVFSDYVKAAIRLSAIQELPVTYVFTHDSIAVGEDGPTHEPVEHLAGLRSMPNLTVIRPADARETQAAWHHALTSTTTPTVIVLTRQNLVVEEGTDFGKVAKGAYVVYDTPGFDTIIIATGSEVNLAIKAAKELVLQGGKVRVVSMPSTELFDAQDATYKEDILPSKTRRRVAIEMAATQSWYKYVGLDGAVIGIDIFGASAPAQTVIDNYGFTVENIVAQVKSL

SEQ ID NO: 18372 - protein, 544 aa, Francisella tularensis subsp. holarctica
MAIQTVSTKPFANQKPGTSGLRNKVIAFQQPRYLENFVQSIFNSLDDIEGKTLVVGGDGRYYNDVAIQIIVRMAAANGFAKIIVGQNGIFSTPAVSCVIRKYEAFGGIVLSASHNPGGPKGDFGIKYNVSNGGPAPEKITDRIFSETKKINQYFISDAAKERVDLDKLGIYKIENTTVEVINSVIDYAELMQQIFDFDKVRELFAKGFKVRFDSMCAVSGPYAKYIFETLLKAPAGTVVNAQPLEDFGGFHPDPNPVNAEDLVKHMRSGKYDFGAASDGDADRNMIVGKQIYVSPSDSLAIMAANAHLIPVYSKGIKGVARSMPTSTAVDRVAESLRLSCFETPTGWKFFGNLLDAEKITLCGEESYGTGSNHIREKDGVWAVLFWLNLVAVTGKQVDQLVEEHWQKFGRNFYSRHDYEAIDTAIANSIIDSLRERLSSLVGAQLNDEKVAKADDFSYIDPIDGSVSNHQGIRIIFEDGSRIVFRLSGTGTQGATLRIYLEKYESDSSKFSIPTQQALASLIEIAEDLTNIKSLTGMTEPTIVT

SEQ ID NO: 18373 - protein, 423 aa, Francisella tularensis subsp. holarctica
MDNHNSSHQLYKKAMALVLAGGRGSRLYNLTDTRAKPAVYFGGKFRIIDFALSNCLNSGIRRIGVVTQYKSHSLLRHLQRGWGFLRGELNEFIDLLPAQQRVDEEHWYRGTADAVYQNIDILRSYGPEYVIVLAGDHIYKMDYSIMLRDHAQSGYKCTVGCVEIAKEEAYAFGIMGIDENRKITSFIEKPKKNAPTIPGTTDRCYASMGIYIFNSDYLYDLLEEDITNKESSHDFGKDIIPRVVSENQALAHPFSMSCVPRGEGIEPYWRDVGTIDAFWEANLDLAANMPELNIYDKDWPVWTAQEQLPPAKFVPDRNGNHGVITNTLASGGCIVLGSEISKSLMFSKVRVLAGCKIDQCVIMPEVVVGENCRLKKVVIDKGCDIPAGMVIGEDPIEDAKNFYRTDKGVVLVTKKMIDELKEK

SEQ ID NO: 18374 - protein, 405 aa, Haloarcula hispanica
MTDSDATALAERVRDGELRLYELEDHADPDTAAAARRHLLAEETGADLSAVGDYTFDAADAESNIENMVGAVQVPMGVVGPLPVDGGAAEGDHHLPLATSEGALLASVNRGVSTIRNAGGATARVLKSGMTRAPVFRVEDVAKAGEVSAWVREHVDVLADAAESTTSHGELQDVTPYVVGDSVFLRFSYDTKDAMGMNMATIATEAACDVVESETPADLVALSGNLCSDKKPAAINAVEGRGRTVAADVLIPHEQVEERLDTTSDAIVEANTRKNLVGSAKAGALGFNAHTANVVAAAFLALGQDIAQVVEGNNAITTVDAREDGLYASVTIPFLEVGNVGRGRFPEAFGGLEVGGDNGGGGDPAGSNAEALGEVIAGGALAGELSLLAALSSRHLSSAHAELGR

SEQ ID NO: 18375 - protein, 896 aa, Oryza sativa (japonica cultivar-group)
MGSSRFVLLLLLLLAVAACVARGQGGGNSSSAAAPAPAAGAGPFVPRDDILLDCGATGKGNDTDGRVWSGDAGSKYAPASLGSASAAGQDPSVPQVPYLTARVSAAPFTYSFPLGAGRKFLRLHFYPANYSSRDAADARFSVSVPAANVTLLSNFSAYQTATALNFAYIVREFSVNVTTPTMELTFTPEKGHPNAYAFVNGIEVVSSPDLFDISTPNLVTGDGNNQPFPIDAGTALQTMYRLNVGGQAISPSKDTGGYRSWDDDSPYVFGAAFGVSYPKDDNVTIAYPSNVPEYVAPVDVYATARSMGPDKNVNLAYNLTWIMQVDAGFTYLVRLHFCEIQYPITMINQRVFNIYINNQTAFQGADVIAWTNNNGIGSPVYQDFVVTTVGSGAMDLWVALYPDVQAKPQYYDAILNGLEVFKLPLSNGSLAGLNPVPTVEPSLDGGAVKKSSVGPIVGGVIGGLVVLALGYCCFMICKRRSRVGKDTGMSDGHSGWLPLSLYGNSHSSGSAKSHTTGSYASSLPSNLCRHFSFAEIKAATNNFDESLLLGVGGFGKVYRGEIDGGVTKVAIKRGNPLSEQGVHEFQTEIEMLSKLRHRHLVSLIGYCEEKNEMILVYDYMAHGTLREHLYKTKNAPLTWRQRLEICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPHLKGKIAPQCFKKFAETAEKCVSDEGIDRPSMGDVLWNLEFALQMQESAEDSGSIGCGMSDEGTPLVMPGKKDPNDPSIESSTTTTTTTSISMGDQSVASIDSDGLTPSAVFSQIMNPKGR

SEQ ID NO: 18376 - protein, 151 aa, Oryza sativa (japonica cultivar-group)
MDPYAILKCRSQEQRSSIASVLWCIADEWNDLTVRIIPKECIAMCNFCYVDCGKGSNPEWNENFVFTVSDKATELLIKLLDSDTGSADDFVGEATIPLEAVYTEGSIPPTLYNVVKDEHYCGEIKVGLTFTPEDVRQRGLPEDFGGWKQSR

SEQ ID NO: 18377 - protein, 334 aa, Bordetella pertussis Tohama I
MTTAALPYPLDPQIQRFVERMQADSAAHPRRDLVPVEQAHAISEAVRRPWAEGGPQMARTREIHVPTPHGPVRLRVYTPRAARPGPALLYVHGGGWVLFSLDTHDRLMREYAERAGLTVIGVDYTRAPEARYPRAIEEIVGVIDWLDAHGAELEVDRARLCIGGDSAGANLSVAACLTLRERGAAPLAGMVLNYGVYDANLFRDSTVKYGGGEYLLSTQQMVWFYWNYLRAGDDPRDPRISPVHADLRGLPPAFMAITELDLLHDTNQDMAARLREAGVDVQAKVYPGTVHSFLEAVSLAQVSVAAFDDTAAWLRAVLRPDAAAAAIHTGEHQP

SEQ ID NO: 18378 - protein, 256 aa, Burkholderia pseudomallei K96243
MNKNDHPLSHLFDNNDAWVKRKLADDPQYFSRLADQQAPEYLWIGCSDSRVPANQIIGLPPGEVFVHRNIANVVVHTDLNCLSVIQFAVDLLKVKHVMVVGHYGCSGVNAALHNRRVGLADNWLHHVQDVREKHAALLEDWPLGEARYRRLIELNAIEQVVNVCRTTIVNDAWARGQPLTVHALVYGVHDGRMRNLGMAVSHAEQLDATYRRAVAALSASGAHSADNDVVAADAAQLAGAVDLIAQTIKETKHDGC

SEQ ID NO: 18379 - protein, 119 aa, Treponema denticola ATCC 35405
MSDLIMKIEAQQKAENPPVFRVGDTVKVHFKIVEGKTERIQVYEGLVICFKNSGIGRTFTVRKNSYGVGVERVFPLHSPRIAKVEVVRPGKVRRAKLYYIRDKVGKAAKIKTLITKKNS

SEQ ID NO: 18380 - protein, 180 aa, Salmonella enterica subsp. enterica serovar Typhi str. CT18
MTLKELLVGFGTQVRSIWMIGLHAFAKRETRMYPEEPVYLPPRYRGRIVLTRDPDGEERCVACNLCAVACPVGCISLQKAETKDGRWYPEFFRINFSRCIFCGLCEEACPTTAIQLTPDFELGEYKRQDLVYEKEDLLISGPGKYPEYNFYRMAGMAIDGKDKGEAENEAKPIDVKSLLP

SEQ ID NO: 18381 - protein, 528 aa, Oryza sativa (japonica cultivar-group)
MDNLIGGVNHSWTKKSVSALSVTSNLGVLMAHSHEMTSRKPPGIRLFGGITVLRTYQTLVLVLTFVAYTCFHMTRKIPSIVKSVLDPQTKLGSSPWGRLHTKNTLNIGWLPFNTIDGSALLGEIDVAFLAVYSVGMFFAGHLGDRMDLRIFLTIGMFGTAVFTALFGAGYWLNIHNFYYFLVIQMIAGLFQAIGWPSVVAIVGNWFGKSKRGLIMGIWNAHTSVGNISGSLLAAFLLKFGWGWSFAIPSLIMVAVGLLVFVFLPVSPEVMEIDIDDGEISSVKDTTKEPLLEPGQEVKHNAVGFLEAWKIPGVAPFALCLFFSKLVAYTFLYWLPFYISHTPIGGEYLSDALAGSLSTIFDVGGVLGGVLAGHISDRLNARAVTAASFMYCAIPALFLYRTYGSMSIMWNICLMFITGMFVNGPYALITTAVSADLGTHSSLNGNSRALATVTAIIDGTGSVGAAIGPLLTGYISSSSWSAVFTMLMAAALLAGLLLTQLVCSELKGKATSNASKDVADAQGTYSDEV

SEQ ID NO: 18382 - protein, 395 aa, Oryza sativa (japonica cultivar-group)
MEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNALVVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 18383 - protein, 247 aa, Glycine max
MYIASMGRSFKDSLKLLEADIHHANTLASDFPREYDGACLQMRMSYSPAAHLFLFLVQWTDCNLAGALGLLRILIYKVYADGTTTMSTHERKASIREFYAVIYPSLLQLQKGVTDTEDTKQKAVCMERYRKRDDEEHRQPSDIDIEREEECGICMEMNSKIVLPNCNHAMCLKCYREWRTISQSCPFCRDSLKRVNSGDLWVFTDRRDVVDMATVTRENLRRLFMYIDKLPLIVPDSLFDTYDSHIR

SEQ ID NO: 18384 - protein, 131 aa, Synechococcus sp. WH 5701
MHGSTPGSLTSTLNDPRSLERAASALRCLPFRRAFYGLLSGEAISSEELHRRADRAQFSFAPLSSDRAEDHFIWLIRVGVLRREVDGQGLTERVRLTPMGRELLERWSGEIPRASLLEVIRHGLRRRWPRL

SEQ ID NO: 18385 - protein, 1501 aa, Saccharomyces kudriavzevii IFO 1802
MSSIKNTRDGSNNVATRSSSASYAASEESFSGAAHDKEKQNDTPADKLTRMLTGPARDTVSHVSATVSDMSPDVVSKVESFADALSRHTTRSGAFNMDAGGDDGFDAHAIFESFVRDADEQGIHIRKAGVTIENISAKGVDASALEGATFGNILCLPLSIFRGIKAKKHQKMREIICNVNALAEAGEMILVLGRPGAGCSSFLKVTAGEIDQFAGGVSGDIAYDGIPQKEMMKRYKADVIYNGELDVHFPYLTVKQTLDFAIACKTPALRVNNVSKEEYIASRRHLYATIFGLRHTYNTKVGNDFVRGVSGGERKRVSIAEALAAKGSIYCWDNATRGLDSSTALEYAKAIRIMTNLLKSTAFVTIYQASENIYETFDKVTVLYSGKQIYFGLINEAKPYFAKMGYLCPPRQVTAEFLTALTDPNGFHLIKPGYENKVPRTAEEFETYWLNSPEFAQLRNDIAAYNEKVNTEKTKEVYNESMAQEKSKFTRKKSYYTVSYWQQVNLCTQRGFQRIYGNKSYTVINVCAAIIQSFITGSLFYNTPSSTSGAFSRGGVLYFALLYYSLMGLANISFEHRPILQKHKGYSLYHPSAEAIGSTLAAFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCADTLVPSGGNYSSLSDDYKVCAFVGSKPGQSYVLGDDYLKNQFQYVYKHTWRNFGILWCFLIGYIVLKVVFTEYKRPVKGGGDALIFKKGSKRFVAPVDEESPDNINDIDAKEQFSSESSGANDEVFDELEAKGVFIWKDVCFTIPYEGSTRMLLDNVSGYCVPGTMTALMGESGAGKTTLLNTLAQRNVGIITGDMLVNGRPIDASFERRTGYVQQQDIHIAELTVRESLQFSARMRRPQRLPDSEKMEYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLKKGGQTVYFGDIGKNSAAILGYFEQNGARKCDHDENPAEYILEAIGAGATASVKEDWHEKWLNSPEYKQSQDKVQELINDLSKQETKSEFGDQPSKYATSYIYQFRYVLIRTSTSFWRSLNYIMSKMMLMMVGGLYIGFTFFNVGKSYVGLQNAMFAAFISIILSAPAMNQIQARAIASRELFEVRESQSNMFHWSLVLITQYLSELPYHLLFSTVFFVSSYFPLRIFFEASRSAVYFLNYCIMFQLYYVGLGLLILYMSPNLPSANVILGLCLSFMLSFCGVTQPVSLMPGFWTFMWKASPYTYFVQNLVGIMLHKKPVVCKKKELNYFNPPNGSTCGEYMKQFLEKSTGYIENPDATSDCAYCIYEVGDNYLTHISSKYSYLWRNFGIYWIYIFFNIIAMICVYYLFHVRQSSFLSPAFIIKKIKNARKKKQ

SEQ ID NO: 18386 - protein, 248 aa, Brassica napus
  misc_feature (216)..(216): Xaa can be any naturally occurring amino acid
  unsure (1)..(248): unsure at all Xaa locations
MAGPVSGDTEAQYAGDPSSKPGGWITFPFMMATLLGMSITSFGWVLNLIVFLIEEFNIKSIAAAQISNILNGCLSMLPLVAAILADSFFGNILVISASTFISLTGILLLTLIASLDLLKPIPCATGSILCQSPTALLLGILYIALVLVTTGAGGTRFALASAGANQYDKPKDQGSFFNWYFLTLYAGAITGATAIVYTQDNASWKLGFGLCAAANXVSFVVFVSGKKLYKHEKPMGSPFKSLISVVVA

SEQ ID NO: 18387 - protein, 525 aa, Synechococcus sp. WH 5701
MSNSHEIHWPRRDAAHLVVRSEQMAQLEQQLFASGLPVEALMEKAALAISARLLSKPEALRQGALVLVGPGHNGGDALVVARELHLAGVRVRLWSPFERHKPLTESHWRHAQWLGIERLSSSPDPAGAALWIDGLFGIGQRRPPGEAIESLLGDRARLRPDQLVAIDTPTGLCADSGRLLGSWAARARTTYCLGLLKQGLVQDSALAWVGELVRLDLGLPPALLGQLPPDQPLVLSGLDQTSAPPLEPAPDAAKYGRGRLLVVSGSAAYPGAALLSLLGASASGCGSLRAAVPGPVAHQLWSLLPHVVLGPAPGEPGALDRLDAVLVGPGLGPAASAERPDSPPLWGSLQAFAGLVVIDADGLNQLAAGVAGEAMTWLQGRQGPTWLTPHQGEFARLFPDLAGEQPLEAAAVAASRCGAALLLKGARNVIAAPDGRRWQLLEAAAEAARAGAGDVLAGFAAGQGALALAAGVSPGEASTLAAAALAHAQAGLAARERLGPGQVTPMALAATLGQWCSAGTSPSGG

SEQ ID NO: 18388 - protein, 343 aa, Triticum aestivum
  misc_feature (209)..(209): Xaa can be any naturally occurring amino acid
  unsure (1)..(343): unsure at all Xaa locations
QALGKHQEAGLILIALITVLTLVELSTNFFIVLLQGSEILTGLRELSLLHALTDVPVDEGTLGVHQVKLVVDAGEDLDDTGGVGDHAHSPLDLGKVTAWDDTWWLVVDTTLEASGAPPSSKFRLSHPHLLLFLRFVPSRDGPPPLERLKTGFEKFKTEVYDQKPDLFEPLKAHQSPKYMVFACADSRVCPSVTLGLEPGEAFTVRNIAXAMVPCYCKNKHTGVGSAIEYAVCALKVEFIVVIGHSRCGGIKALLNLKDGADDTFHFVEDWVRIGYPARKKVKDECSEMPFEEQCGVLEKEAVNVSLQNLSTYPFVKEGVANGTLKLVGGHYDFVSGKFDTWTL

SEQ ID NO: 18389 - protein, 329 aa, Setosphaeria turcica
MGAFGLVCSAKDQLTNQAVAVKKIMKPFSTPVLSKRTYRELKLLKHLRHENIISLSDIFISPLEDIYFVTELLGTDLHRLLTSRPLEKQFIQYFLYQILRGLKYIHSAGVVHRDLKPSNILVNENCDLKICDFGLARIQDPQVTGYVSTRYYRAPEIMLTWQKYDVEVDIWSAGCIFAEMLEGKPLFPGKDHVNQFSIITELLGTPPDDVIQTICSENTLRFVQPLPKRERQPLANKFKNAEPEAVDLLENMLVFDPRKRVRAEQALAHPYLAPYHDPTDEPIAEEKFDWSFNDADLPVDTWKIMMYSEILDYHNVDAAAQDAPESNGS

SEQ ID NO: 18390 - protein, 365 aa, Synechococcus sp. WH 5701
MTQEIAATLQPAADGAAQEAVGSHAERLAALYPAGPATVTREEGLTLYRDMTLGRRFEDKCAEMYYRGKMFGFVHLYNGQEAVSTGVIKAMRAQHDWFCSTYRDHVHALSAGVPAREVMSELFGKATGCSKGRGGSMHLFSKEHHLLGGYAFIGEGIPVALGAAFTSRYKRDALGEADSDAVTAAFFGDGTCNNGQFFECLNMAALWKLPILFVVENNKWAIGMAHDRATSDPEIWRKAAAFGMAGEEVDGMDVLAVRAAAQRAVERARAGEGPTLLECLTYRFRGHSLADPDELRSEVEKEFWAKRDPLKALAAHLTSHDLASLEELKAIEKEIDAEVADAVEFAVGAPEPDPGELTRYIWAED

SEQ ID NO: 18391 - protein, 522 aa, Saccharomyces kudriavzevii IFO 1802
MDPFHNGNKRSSISFGPSQRQPYSKSNYLAGANAPPSVAQDLGRGPSPFGMSGNTTSGSNSKRNSGSDLSAAYYTNRSPMYSPLDFSPPVFSPNHSQLQQARNYAANIPVVSNLMNQSMASVCEYQSHYPLFGLDWSVDDYVCLGSYKEDSRNKLQVLHSNDLLSWENVVDANVVYPVSKIQWVPSQLHPRKLATCSDSLRIWNVNPEERHLQEQVNLSLCKYNRQHPTSPATADDMKVIGTFPPITSFDWNTVDTNLIISSSIDTTCIVWDLQSSHYVKTQLIAHDSEVFDVRFLTKSTQLFASCGGDGSVRVFDLRSLAHSTIIYEPPSSPASGPNAGATTPSLKGSDALLRLEPSPYDPNVLATFAADSNKIIILDMRNPESPILNLEGHTCSVNEIKWHPTKRNVLLSCSDDCQALYWDLNNSFMEINGSDSKSPTASGASLEDSDGDTVMADGGAKANQQEDPLNSNNDKQVCRTLDTPNMMYVNKTQEINNIAWRPQRGDWFGCVSGKKFQNVRVF

SEQ ID NO: 18392 - protein, 286 aa, Lactococcus lactis subsp. lactis Il1403
MNINGYTRMAAVVANPIKHSLSPFIHNLAFDLTNENGVYLAWEVEAEKLPAIVDNVRTLDMYGLNISMPYKTEITPFMDELSPAAELIGAVNTVVNQSGKLIGHNTDGIGFFNSLEKYHFNIQNKQMLILGGGGAAIAIIAQAALSGAKKIVVAARKSASYIPLKEKLEKLSVKTGIEILLTDLSEADRLQKELKQTDLLVNATSVGMDGESLPLEKSLVLPEKLLVVDAIYKVRETPFLRWAKGQGAQTENGLGMLIGQAAESFYLWTGKKMPVAEITLEMEKEA

SEQ ID NO: 18393 - protein, 449 aa, Pseudomonas fluorescens PfO-1
MFAFFRPAAHQAPLPEEKIDSTYRRLRWQIFAGIFFGYAGYYLLRKNFSLAMPYLIDEGYSRGDLGLAMSAIAIAYGLSKFLMGLVSDRSNPRYFLPFGLLVSAGVMFIFGFAPWATSSVTMMFILLFINGWAQGMGWPPSGRTMVHWWSQKERGGVVSVWNVAHNVGGGLIGPLFLIGMGLFNDWHAAFYVPAAVALAVAVFAFVTMRDTPQSVGLPPIEKYKNDYPEGYDASHEDEFSAKEIFVKYVLRNKMLWYIAMANVFVYLLRYGVLDWAPTYLKEAKGFTVDKTSWAYFFYEWAGIPGTLLCGWMSDKIFRGNRGLTGMVFMALVTVATLVYWLNPAGNPTIDMIALFSIGFLIYGPVMLIGLQALELAPKKAAGTAAGFTGLFGYLGGSVAASAAMGYTVDHFGWDGGFVLLVGACLLSMAFLAPTLWHKQVASQSREAVA

SEQ ID NO: 18394 - protein, 461 aa, Thermus thermophilus HB27
MKTYDLIVIGTGPGGYHAAIRAAQLGLKVLAVEASEVGGVCLNVGCIPTKALLHAAETLHHLKVAEGFGLKAKPELDLRKLGGWRDQVVKKLTGGVGTLLKGNGVELLRGFARLVGPKEVEVGGERYGAKSLILATGSEPLELKGFPFGEDVWDSTRALKVEEGLPKRLLVIGGGAVGLELGQVYRRLGAEVTLIEYMPEILPQGDPETAALLRRALEKEGIRVRTKTKAVGYEKKKDGLHVRLEPAEGGEGEEVVVDKVLVAVGRKPRTEGLGLEKAGVKVDERGFIRVNARMETSVPGVYAIGDAARPPLLAHKAMREGLIAAENAAGKDSAFDYQVPSVVYTSPEWAGVGLTEEEAKRAGYRVKVGKFPLAASGRALTLGGAEGMVKVVGDEETDLLLGVFIVGPQAGELIAEAALALEMGATLTDLALTIHPHPTLSESLMEAAEAFHKQAIHILNR

SEQ ID NO: 18395 - protein, 451 aa, Thermus thermophilus HB27
MPKEILMPELAESVVEGEILKWLVEEGDYLKKDQPFVEVMTDKVTVELPSPYEGVLLKKLAKEGEVVKVHAPIALIAEPGEAVEGVKEPPPVQAVEERSIVEPGLPAKEEKEDLSLFKPDPTQVAVKNPFLSGEKPQEGARPGRVLAVPAARKLARELGIPIEEVPGSGPLGRVRVEDVRAYAERRKAPPERPEEGPQVLPAGFPPPPKYAPPKGYEHLEERVPLRGIRRTIAQGLWQSHLYTVRTLNVDEADLTELVRLRERLKPQAEAQGVKLTYLPFIVKAVVRALKKFPMLNTSLDEERQEIVYKRYYHIGLAVATERGLIVPVVRDADRKSVLELAQEIAELSQKAREGRLAPEEVTGSTFTITNIGSVGATLSFPIIHLPDAAILGVHSIRKRPWVMPDGSIRPRDIMFLSLSFDHRLVDGAEAAMFTREVIRLLENPDLLLLEM

SEQ ID NO: 18396 - protein, 532 aa, Oenococcus oeni PSU-1
MSENAEGKTRRNHGLIHYANGPSLEEINGTVKVPKGRGFGETLFAYSGPGALVAVGYMDPGNWSTSITGGQNFQYLLMSTILISSLIAMLLQYMAAKLGIVSQMDLAQAIRARTSKSLGIVLWIMTELAIMATDIAEVIGAAIALYLLFHIPLVIAVFITVFDVLLLLLLTKIGFRKIEAIVVALILVILFVFVYQVALSDPNWSGVIAGLVPSAKAFATSPHIGGQTPLTGSLGIIGATVMPHNLYLHSAISQTRKIDHNDEEDVARTVRFSSWDSNIQLTAAFFVNALLLIMGVAVFKSGAVKDPSFFGLFEALSDTSTLSNGILISVAKTGILSTLFAVALLASGQNSTITGTLTGQVIMEGFVHMKMPLWLRRLVTRLISVIPVLICVSMTSGQSAINEHEALNTLMNNSQVFLAFALPFSMLPLLMFTDSDIEMGRRFKNTMWVKVLGWISVLSLTLLNLINLPGANGQIAAFFGDNATKSQLFLANIIAYALIVAIIALLVWTIVEILKGNKRYQLENHSVVGVED

SEQ ID NO: 18397 - protein, 476 aa, Brassica napus
MANIARQFSSVSLRRTFSRQFTGQSSHDPRRNNMRFSFGRQSSLDPIRRSSTPEEGSNRPPHQLAVPDNLDATMQLLFVECGGDVEGVRDLLDDGIDVNSIDLDGRTALHIAACEGHVEVVKLLLTRKANIDARDRWGSTAAADAKYYGNMDVYNILKARGARVPKTKRTPMVVANPREVPEYELNPQELQVRKADGISKSCQGIYQVAKWNGTKVSVMILDKDLYKDNETIEAFKHELTLLEKVRHPNVVQFVGAVTQNVPMMIVSEYHPKGDLGSYLQKKGRLSPSKVLRFALDIARGMNYLHECKPEPVIHCDLKPKNIMLDNGGLLKVAGFGLISFEKLSSDKSKVLNHGAHIDLSNYCVAPEVYRDEIFDRSADSYSFGVVLYEMIEGVQPFHPKPPEEAVKLMCLEGRRPSFKAKTKSCPEEMRELIEECWDVKAVVRPTFSEIIVRLDRIFVQCSKQGWWKDTFKFPWK

SEQ ID NO: 18398 - protein, 324 aa, Thermus thermophilus HB27
MALMTMVQALNRALDEEMAKDPRVVVLGEDVGKRGGVFLVTEGLLQKYGPDRVMDTPLSEAAIVGAALGMAAHGLRPVAEIQFADYIFPGFDQLVSQVAKLRYRSGGQFTAPLVVRMPSGGGVRGGHHHSQSPEAHFVHTAGLKVVAVSTPYDAKGLLKAAIRDEDPVVFLEPKRLYRSVKEEVPEEDYTLSIGKAALRREGKDLTLIGYGTVMPEVLQAAAELAKAGVSAEVLDLRTLMPWDYEAVMNSVAKTGRVVLVSDAPRHASFVSEVAATIAEDLLDMLLAPPIRVTGFDTPYPYAQDKLYLPTVTRILNAAKRALDY

SEQ ID NO: 18399 - protein, 143 aa, Glycine max
  misc_feature (87)..(87): Xaa can be any naturally occurring amino acid
  unsure (1)..(143): unsure at all Xaa locations
MARTKQTARKSTGGKAPRKQLATKAARKSAPTTGGVKKPHRYRPGTVALREIRKYQKSTELLIRKLPFQRLVREIAQDFKQITDIFXTDLRFQSHAVLALQEAAEAYLVGLFEDTNLCAIHAKRVTIMPKDIQLARRIRGERA

SEQ ID NO: 18400 - protein, 78 aa, Medicago truncatula
MDLSDLNSAEMQRFYSEEQQRAMINEMVAKMTSQCWDKCITGTPGNKFSSGETNCLTHCAQRYVEMSMLIMKRFQSMQ

SEQ ID NO: 18401 - protein, 156 aa, Haemophilus quentini
NRSNTPVLVDGKDVMPEVNAVLTKMKDFCQRIISGEWKGYTGKAITDVVNIGIGGSDLGPYMVTEALRPYKNHLNMHFVSNVDSTHIAETLKKINPETTLFLVASKTFTTQETMTNAQSARDWLLKAAKDESAVAKHFAALSTNAKDVEKFGIDTN

SEQ ID NO: 18402 - protein, 380 aa, Bacillus subtilis subsp. subtilis str. 168
MKKQCVAMLLAGGKGSRLSGLTKNMAKPAVSFGGKYRIIDFTLSNCSNSGIDTVGILTQYQPLELNSYIGIGSAWDLDRYNGGVTVLPPYAESSEVKWYKGTASSIYENLNYLNQYDPEYVLILSGDHIYKMDYGKMLDYHIEKKADVTISVIEVGWEEASRFGIMKANPDGTITHFDEKPKFPKSNLASMGIYIFNWPLLKQYLEMDDQNPYSSHDFGKDIIPLLLEEKKKLSAYPFKGYWKDVGTVQSLWEANMDLLKEDSELKLFERKWKIYSVNPNQPPQFISSDAQVQDSLVNEGCVVYGNVSHSVLFQGVTVGKHTTVTSSVIMPDVTIGEHVVIENAIVPNGMVLPDGAVIRSEKDIEEVLLVSEEFVEKELI

SEQ ID NO: 18403 - protein, 600 aa, Salmonella enterica subsp. enterica serovar Typhi str. CT18
MVNNMTDLTAQDAAWSTRDHLDDPVIGELRNRFGPDAFTVQATRTGIPVVWVKREQLLEVGDFLKKLPKPYVMLFDLHGMDERLRTHRDGLPAADFSVFYHLISIERNRDIMLKVALSENDLRVPTFTKLFPNANWYERETWEMFGIDIEGHPHLTRIMMPQTWEGHPLRKDYPARATEFDPFELTKAKQDLEMEALTFKPEDWGMKRGTDNEDFMFLNLGPNHPSAHGAFRIILQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVAHDLPRGWDRLLREFLEWMPKRLDSYEKAALRNTILKGRSQGVAAYGAKEALEWGTTGAGLRATGIDFDVRKWRPYSGYENFDFEVPVGGGVSDCYTRVMLKVEELRQSLRILQQCLDNMPEGPFKADHPLTTPPPKERTLQHIETLITHFLQVSWGPVMPAQESFQMVEATKGINSYYLTSDGSTMSYRTRVRTPSFAHLQQIPSAIRGSLVSDLIVYLGSIDFVMSDVDR

SEQ ID NO: 18404 - protein, 206 aa, Rhodopirellula baltica SH 1
MCDQLAFASQRKPYQHMDLRHHVRDIPDYPKPGILFRDITPLLAHPEALTASVEEMAKPFLDQKIDVVAAAEARGFIFGTPLAMRLNAGFVPIRKPGKLPFDLHSFAYELEYGSDELQIHVDGIKPGQRVLIVDDLLATGGTVEACLRLLEKCDAEIVGCSFLIHLVALGGEARLSPYHVHSVLEYGGDDAEDELSIQNRPPGPSV

SEQ ID NO: 18405 - protein, 546 aa, Ustilago maydis 521
MADGPSKDELVEIFKSLKTTQKGNKAADRSPRHSTTRQVCFDCGAKNPTWASATYAIYICLDCSSVHRNMGVHITFVRSTNLDSWHWSQLRLMKVGGNAAAAEFFNKKGGAHLLAPSTEGKVKYTSSVAQAYKDELQKRALLDAAGQSLNSPVYFPGLAVASTETATPSSSTKAGGDDDDFFDSWDKPASAAKPAASTTAKPAPAPVSTRAPAAAAAAPKTVTSASLRASSSAARKTLGAVSRTSSASSTPGTTTPTGTGPTTTASALGAPSARPARAGKLGLGVKKAAAPIDFAAAERKAKEEEAARAAEAKAEQKAEETAREAQKASAEQAEAERIAREAVKAAVGKTSAATPASASSNANVRGAAGSVPDAFAAAKANGDMDRLGMGFGRLGMKANAHQAKLAAERAAAAANNAAAGSDLDAGGDEPSYARNQFSGQKSISSDQYFQRGSYDPQATSEAQQRLQSFQGQTSISSNQYFGRDEDEEAEQQAVQGSGDFADIEATAREYYQRFMANPDVQSSIDSFRAGALKLSQYLEDMSRNGA

SEQ ID NO: 18406 - protein, 259 aa, Burkholderia pseudomallei K96243
MNAPAPLKVFITGASSGLGLALAAEYARHGATLGLVARRADALAEFAPRFPKASISIYPADVRDADALALAASRFVAAHGCPDVVIANAGISKGAITGEGDLAAFREIMDVNYYGMIATFEPFIAPMTAARRGTLVGIASVAGVRGLPGSGAYSASKAAAIKYLEALRVELRPAQVAVVTIAPGYIRTPLTEHNPYPMPFLMDADRFAKRAALAISQKTAFRVIPWQMGIVAKLLHVMPRWLYDRLFEKAPRKPRAKAG

SEQ ID NO: 18407 - protein, 267 aa, Oryza sativa
  misc_feature (5)..(5): Xaa can be any naturally occurring amino acid
  misc_feature (34)..(34): Xaa can be any naturally occurring amino acid
  unsure (1)..(267): unsure at all Xaa locations
ENVRXYKEEEKNDPEFANDAFGTAHRAHASTEGXFLLQKELDYLVGAVSSPKRPFAAIVGGSKVSSKIGVIESLLEKCDILLLGGGMIFTFYKAQGLSVGSSLVEEDKLELATSLLAKAKEKGVSLLLPSDVIIADKFAPDANSQVVPASAIPDGWMGLDIGPDSVASFSSTLETTQTVIWNGPMGVFEFDKFAVGTEAIAKKLADLSGKGVTTIIGGGDSVAAVEKVGVADVMSHISTGGGASLELLEGKELPGVIALDEAVTVAV

SEQ ID NO: 18408 - protein, 367 aa, Triticum aestivum
MARRHHLVVLLPLLALAVSFVAAAPEGHGDAAAAFIDGAPHRYLRDQQDDQATSMSLDEVSAAVSVLLGFAPPAMLPAPSSAKLNKLLLPKPFDRPRAVFLMQIDGSHDSVDSFVSDAGSIYKTKIEGAQNAATGLTDKDELIVIRSHESSGSDVLDNELTDLATWLEGSYQKADGKLNIPLKSGNSLTLLLNKEVDVEFASSLISLLKTIKRGIQVHEDFSGGIVSPAELLVCRFTGIKALEDEYGSAEIVKQGAEVVQTALTKAFDQLQGAYNGKIVGLVISTKEASTSLASIIDGPSSLHISRRLAEASKTNATASIAAIYLVRLSLAWITGIILLVSTLIGICLLMNMPLTRDTLLYSNVKMD

SEQ ID NO: 18409 - protein, 299 aa, Streptomyces avermitilis MA-4680
MYDYDLLVVGSANADLVIGVERRPAAGETVLGSDLVVHPGGKGANQAVAAARLGARTALLARVGDDAHGRLLLDSQRRAGVDTVGVLVGGAPTGVALITVDPSGDNSIVVSPGANGRLAPRDVRAADSLLRSAAVVSAQLEIPLESVVEVVRNLAPGTRFVLNPSPPRPLPEEVLAACDPLIVNEHEARVIAGGELDGSPEDWAAALLALGPRSVVVTLGAEGALVASAEGTARVPSVRVDAVDTTGAGDAFTAALAWRLGLGESLVRAAAYAARVGASAVTRSGAQASFPTAEEVAAL

SEQ ID NO: 18410 - protein, 484 aa, Triticum aestivum
  misc_feature (415)..(415): Xaa can be any naturally occurring amino acid
  unsure (1)..(484): unsure at all Xaa locations
HYRTSLYKKAGWYRSGIPGISSTHASENLRFVDLSSNLLTGSLPGCLLAAPGKSVLFSANCLSTAGDDSQSQHPSPFCRNQALAVGIVPEQGHKKSGAKAGVVAGIVLVGALVVSAAVVFVVRKASAPKARPARRLVENASSAYPSNLLADARYISQTVKLGALGIPAYRSFSLVELEAATDNFQVSSLMGQDAHGQMYRGRLSNGTPVTIRSLKVNKSQSFTRHIEMISKLRHRHLVSALGHCFQYNLDDSTVTHLYLVFEYVHNGNLRGRISQGTEGRRLSWGQRISTAIGVAKGIQFLHGGIIPGLFANNLKITNILMDQNQVPKIGSYNIPILSETMKSEGGAGSKYPPDRICRVPNGDKIDMYDFGVILLEVISGRPISSIYEVEIMKEQLQSALTAQGPSKRSNLVDPXAVSKGCSDDSMRTVMEICLRCLAKEPTQRPSVEDVLWNLQFAAQVQDDSRSSDESPLSPSQPHAQSAHG

SEQ ID NO: 18411 - protein, 175 aa, Oryza sativa (japonica cultivar-group)
MGNASSMLTQYDIEEVQEHCNYLFSQQEIVSLYERFCQLDRSAKGFISEDEFLSIPEFSLNPLSKRLLRMVDGLNFKDFVSFLSTFSAKASVQQKIELIFKVYDIDGKGKVTFKDLVEVLRDQTGSFMTEEQRERVITNVLEEAGYTRDCTLSLEDFTRIIDHPGLKMEVEVPID

SEQ ID NO: 18412 - protein, 107 aa, Haemophilus influenzae R2846
METLDKIKKQISENPILIYMKGSPKFPSCGFSARASEALMNCKVPFGYVDILQHPDIRAELPTYANWPTFPQLWVEGELVGGCDIILEMYQAGELQTLLAEVAAKHA

SEQ ID NO: 18413 - protein, 548 aa, Saccharomyces kudriavzevii IFO 1802
LRKKTKVFMNEPHYTENFIQAMMESIPNGPDGATLVVGGDGRFYNDVIMNKIAAVGAANGIRKLIIGQGGLLSTPAASHIIRTYEDRCNGGGIILTASHNPGGPENDLGIKYNLRNGGPAPESVTNAIWEASKKLTHYKIVTNFPELDMNKLGKNQNYGPLLVDIIDPARAYVQFLKEIFDFDLIKSFLTEQRRTKGWKLLFDSLNGITGPYGKAIFVDEFGLPAEEVLQNWHPLPDFGGLHPDPNLTYARTLVSRVDREKIAFGAASDGDGDRNMIYGYGPAFVSPGDSVAIIAEYASEIPYFAKQGIYGLARSFPTSSAIDRVAAKKGLNCYEVPTGWKFFCALFDANKLSICGEESFGTGSNHIREKDGIWAIIAWLNILAIYNKHNPEKEASIKTIQDEFWNEYGRTFFTRYDYEHLECEQAEKVVALLNNFVTKPDVVGCQFPGDESLTVADCGDFSYTDLDGSISEKQGLFVKLSNGAKFVLRLSGTGSSGATIRLYVEKYTDNKGNYDETAEIFLKPIINSIVKFLKFEEILGTEEPTVRT

SEQ ID NO: 18414 - protein, 193 aa, Brassica napus
MTLESYNGDVHTVPQSENSPIETEKEREIFVPPLNFAMVDNGIFRSGFPEPVSFSFLQSLRLRSIIYLCPEPYPEVNVEFAKSNAIQVFQFGIERCKEPFVNIPDQVIREALQVLLDTENHPVLIHCKSGKHRTGCLVGCVRKIQRWCLSSIFDEYQRFAASKARISDQRFMELFDISNLRHSPLSFSCSNRC

SEQ ID NO: 18415 - protein, 348 aa, Thermus thermophilus HB27
MKGLILAAGRGTRLRPLTHTRPKPAIRVAGRPIIHYAVENLLEAGVREIGVVVSPETERDLKVALEGYPVRYVLQEEPQGLAHAVDVARDFLGESPFVLYLGDNLFQKGIRRFLEAFKPGVSAVIALVRVEDPRQFGVAVLEGNRVVRLLEKPKDPPSDLAVAGVYVFSPEVLEVVRGLKPSARGEYEITDAIQGLIDRGKTVVGVEVEGWWKDTGRHQDLLDANRLLLEELTPKVEGDVVESQLTGRVVVEKGAKVVRSTVIGPAHIGAGAVVEEAFVGPFTSVGPRARVVRSEVEYSLLEEEAVVEEVRLRLQECILGVRAEVKSRDGLPRAHRLILGDLSQVELA

SEQ ID NO: 18416 - protein, 152 aa, Arabidopsis thaliana
GGIAADLPYGWIDKCLDFCDYFLTEVVEYQKLITRNPIFLERVEGVGIIGGEEAINWGLSGPMLRASGIPWDLRKIDRYESYDEFEWEIQWQKQGDSLARYLVRLSEMTESIKIIQQALEGLPGGPYENLESRGFDRKRNPEWNDFEYRFIS

SEQ ID NO: 18417 - protein, 383 aa, Oryza sativa (japonica cultivar-group)
MPSGEEADLEAFQRHFAASLGELLPGEVEGGGGGGGGGGGGGGEEILSVAWIRRLLEAFILCQEEFRVFVAQARRRGALPAAGEKLVVEFHERAVKALDVCNAARDGVDQVRRWERLADIAASVLLAPGEIHEGQLRRARKALSDLSVLLVDDTAASGSGGVASFLASHRNRSFGRARASPSRASFAGATSSSHFRSLSWSVSRAWSASRQLQAIGAGLAAPRAHEAGLAAPVYAMGCVLHLVAWALVAAVPCPDRSTALQAHHLPAAPARAAFPWAPPLLTLQERLAEEGKRKDRRNSCGLLKEIHVLEKSTQKLTDAIDAAPIPLFGDREADVREAAAELAAVCAAMRDGLEPLERQVREVFHRIVRSRVEGLDSSMRNAD

SEQ ID NO: 18418 - protein, 460 aa, Frankia sp. CcI3
MANSAAGPVDLVILGGGSGGYAAALRAAELDLSVVLIEKDKLGGTCLHRGCIPTKALLHSAEIVDNINESEAFGVRSTLDGIDMAAVNSYKDSVIAGLFKGLTGLIKSRGIEVVEGFGRLVSPTAVAVGDRVIEGRHVLLATGSYSKTLPGLDIDHDKVITSDDALTLDHVPASAVVLGAGAIGCEFASVWRSYGAEVTIVEALPHLVPLEDESSSKLLERAFRKRGIKQHLGARFSGVKSTDQGVTVSLENGTTIEAELLLVAVGRGPVSEGLGYEEVGIATDRGYVLVDRQLRTNIPTVSALGDLRPGLQLAHVGFAEGIFVAEQLAGLGPVPVDYDNVPRVTYSHPEVASVGLTAAVARERYGEIKTVTYNLAGNGKSQILRTSGAVTVIAVPDGPVVGVHMVGDRVGELIAEAQLITNWEAFPAEVAQLIHPHPTLSEALGEAHLALAGKPLHVHG

SEQ ID NO: 18419 - protein, 487 aa, Frankia sp. CcI3
MSVSVTMPRLGESVSEGTVTRWLKQEGERVEADEPLLEVSTDKVDTEIPAPASGVVSSIKVAEDETVEVGVELAVIDDGSAGGGTAPAQATQAPAAPEPEPEPAPEPVKPAAAAPPPPPTPTPAPAPTPAPAPTPAPAPTPAPAPAFARQPELTPVPAQTPAAANGNGGGIGRYVTPLVRKMAAELGVDLGTVAGTGPGGRVTKQDIQDAARPRDAAPAAQETPATPPTAPTAPAVAPTVAPTGAAPVRGQTEKLSRLRALVARRMVESLQISAQLTTVVEADVTRIARLRDRAKSGFQAREGIKLSFLPFFALATCAALREFPQLNSSIDVEAGTVTYHGEENLGIAVDSERGLVVPVIHNAGDLNLIGLARKIDDLASRTRANRISPDELGGGTFTLTNTGSRGALFDTPIINQPQVGILGTGIVTKKPAVVDDPELGEIIAVRSTVYLSLTYDHRIVDGADAARFLAFTKHRLENGAFEAELGL

SEQ ID NO: 18420 - protein, 560 aa, Medicago truncatula
MGCVLGTPASDGDRDQRRQRRTQQRNGSSEVTNNVVRVRERQKNRHTGDFPVNLPALERRKPMLDPLSVNQQGWPSWLMAVAGEAIGDWTPRRANSFEKLAKIGQGTYSNVYKAKDLVTGKIVALKKVRFDNLEPESVKFMAREILVLRKLDHPNVVKLEGLVTSRMSCSLYLVFEYMEHDLAGLSAGQGVKFTEPQVKCFMKQLLSGLEHCHSRGVLHRDIKGSNLLIDNEGILKIADFGLATFYNPNKKQSMTSRVVTLWYRPPELLLGATFYGVGIDLWSAGCILAELLAGKPIMPGRTEVEQLHKIFKLCGSPAEEYWRKHKLPNATIFKPQQPYKRCISETFKDFPPSSLPLIDSLLAIDPDRRGTASAALNHEFFTTEPYACEPSSLPKYPPSKELDVKMRDEEARRQKALNGKANAVDGAKRVRARERGRAIPAPEANAEIQTNLDRWRVVTHANAKSKSEKFPPPHQDGAVGYPQDESSKGPVSFGASDTSFSSGTFNVKPSGPTRSHDGTGLHKGTKTKKEESQMASSWKFMRPFKPSTIGLSMDLLFRSK

SEQ ID NO: 18421 - protein, 490 aa, Bacillus subtilis subsp. subtilis str. 168
MSQTLFIDGEWISAEKEQIRSIINPFNQEEIATVSEGGREDAIKAIAAARRAFDKGEWSSLSGLERGKIVLKIAELIRRDLEELAELESLDTGKTLEESKADMDDIANVFQYYAGLADKDGGEIISSPIPDSESKIIREPIGVCGQITPWNYPLLQASWKIAPALAAGNTIVMKPSEITPLTTIKVFKLMEEAGVPKGVANLVLGPGATVGDELAVNKDVDLISFTGGIETGKKIMRAASGNVKKIALELGGKNPNIVFKDADLEVAVDQALNAVFFHAGQVCSAGSRLLVEDAIHDQFLAELVKRAKRIKLGNGFHAETESGPLISAEHRAKVEKYVEIGIEEGAKLETGGKRPEDPELQNGFFYEPTIFSNCNSDMRIVQEEVFGPVLTVETFSSEEEVIELANDTIYGLAGAVWSKDIEKCERVAARLRMGTVWINDFHPYFAQAPWGGYKQSGFGRELGKIGLEEYTEVKHVYRNTKPAAVNWFNS

SEQ ID NO: 18422 - protein, 269 aa, Clostridium difficile 630
MNFFGLVGEKLSHSVSPQIHKRVFEILNIESAYKNFEISKEDISKLDGAIKLLGIQGVNVTVPYKERIMKYLDFISPEAKRIGAVNTILLRENMLYGYNTDYFGLDSMFKMANIDVQGKVAVILGTGGASKAALTYFIDSGIEKLYVSTRKKDDKKLLNSKAILIDYEELKHIKGDIILNATPVGMYPNVGISPVSKSIIQNFDILIDLIYNPGETEFLRIGNSMGKKTCDGLYMLVGQAIKSQEIWQDTKIDNSILDVIYNELKLEFL

SEQ ID NO: 18423 - protein, 474 aa, Frankia sp. CcI3
MFTKAEDVLRYIRDEDVQFIDVRFCDLPGIMQHFTIPTQVFAESVFTEGLMFDGSSIRGFQAIHESDMLLLPDPHTAFVDPFREHKTLAMTFFIHDPITKEQYSRDPRNIAKKAEAYLRGTGVADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARGRGKTVTFMPKPLFEDNGSGMHVHSSLWKDGEPLFYSPNGYGGLSDTARYYIGGLLHHAPALLAFTNPTTNSYRRLVPGYEAPVNLVYSARNRSACCRIPLSGDSPKAKRVEFRVPDPSCNPYLAFAAILMAGLDGVRNKIDPPDPIDKDLYDLPPDELAAVPQVPGSLEKVLDALEADNEFLREGDVFTADLIETWLDYKRVNEVDAIRLRPHPYEFTLYYDI

SEQ ID NO: 18424 - protein, 235 aa, Oryza sativa (japonica cultivar-group)
MAAAANGGGAALFSEEELRDVSGVRRCEDFVEVTCGCTSHRYGDAVGRLRVYASGDLEVSCECTPGCREDKLTPSAFEKHSGRETAGKWRNTVWVMVQGEKVPLSKTALLKYYSLSHKSANGSNKGRNGRLSHRDEFIHCTECGKERRFRLRSKEECRIYHDALAKPNWTCADLTTDRVTCGDEEERASRKVLRGCSRSTSCTGCVKCVCFGCEICRFTDCGCQTCVDFYHNSKE

SEQ ID NO: 18425 - protein, 290 aa, Arabidopsis thaliana
MAKQVKENGGKYESRPFSVGGYNWTLLIYPVIYIPTDSGGYVSIYVRVDNSSLITNPKDVYAEITFLAYKSSTDKYQISQETEAQRFHLFKQQWGLLQFLPIYYFENPAYGYFFEGESVVFGVDINIVKPFENWEVFSNEQNIRDPIFEWRLTKFSTRFLDSYTSDSFSSGGRNWALKVYPNGVGNATGNSLSLYLLSDQSNDKGYVEAKLRVIDQIQSNNFEKKVAAWPNATENGWGFDRFLSFADIKNTSKGFLVNDTLKLEVQILSFSKTDYYSHQSSLNVLTGDST

SEQ ID NO: 18426 - protein, 572 aa, Ostreococcus tauri
MTTDDMITATVTERTPVGMKHWKFHDVPSTMGKSDEEAMAAYASHAFRASATTESETEALTSCYSRDGMLFACANADKVDVYDASVEPHALKGTMMLRGATALSFSPGQKYLSIYQKQTATGAAKDEKNLTVWNVKEMCSGTAPSKVYEVFQRQFLKAEWPYFQFSEDDSTAVRCVSNEIQIIRPDAGFEKHVRLRVPSVAVAKISPGPTPRVACFVPEVKGAPGSVRIYELAQHTEEGVIENPTPVARKSFFRVTEVDLMWAPDGSAVLILGSSEVDATNKSYYGESCLHYLKADGSFEGAVPLSKEGPVHDAQWSPCSDEFGVVYGYMPAKATIYKAAKCEPKYELGAGPHNTLRWNPFGRFIALAGFGNLPGDIKFFQKMKDGKYKPVGSTRAACSVTLEWSPDGRRLLTSTVAPRLNVDNGWKIWRYNGDLLLHEERAKIYEAFWRPVPKGTFQDRPISPASKRVETASQQASTAKPAGAYKPPHAAKTAYRPPHATSGSGNFSLAKASEEEMKAGKYKPAGAATKSVEDSGPPGAGGQLSVAAAKNAKKRAAKKRAAAAAKEIEQKL

SEQ ID NO: 18427 - protein, 98 aa, Allium cepa
RITGCPNGCARPYMAELGFVGDGPNSYQIWLGGTPNQSTLAKCFMNKVKIQKFESVLEPLFNDWKVNRKTEESFGEFTNRIGFEKLLEVVEQWDSSKN

SEQ ID NO: 18428 - protein, 475 aa, Photobacterium sp. SKA34
MFKQQAFINGQWSDAFSGKTANITNPATNEVIGHVPLMGVEETNIAIDAADKAYRLWSKTTAKHRSMILRQWYELIVSHSDELANILTAEQGKPLAEAKGEIAYAASFVEWYAEEAKRLNGEIIPSHKEDARILVSRQPVGVVAAITPWNFPAAMITRKCGPAFAAGCSVVLKPAPDTPYTAFALAELAHRAGIPAGLFNVITGDAVKIGAELMSNKRVRKVSFTGSTAIGKLLMAQSAATVKKVSLELGGNAPFIVFNDADLSRAIDGVMVSKFRNAGQTCVCTNRIYVHSDVYQQFVEKLAEKVSALTVGNGVDNGVTIGPLINRAAVEKVEKHINDAMMKGANLVIGTRKPSISCFVQPTVLSDVTDNMLVANEETFGPLSAVFKFTDEQDVITRANNTDSGLAAYVYTQSLSRVFRVSEALEYGMVGVNEGLISTELAPFGGIKESGIGREGAHQGLEEYTEMKYTLMGGL

SEQ ID NO: 18429 - protein, 1328 aa, Ostreococcus tauri
MASDATARDGALASFVDHLDRDARARGVPPKVEVRLNDFACTLELDAKKASREIRTVPKVFADAIVSPMRALASAVRGSEDGAKAKTKLEVLRGCGGTFQPGSLTLVLAPPGHGKTTLLKSIAGVNPIASTGSITYSGLTKDELEASGTSLQRLCEYVTQLDEHLPYLTVDETVRFSHENACVVPNGEGKKSHDEKVDKVIELLSLESCRDTIIGNDLIRGVSGGEKRRVTIAEALVKNAQVLCMDEISTGLDAAVTYNIIAGLKQWATRTQGTCIVALLQPTPEVVSLFDEVLLLKEGAPVYHGPIDQVKSYFSGLGFTPPSEKGADLADWLISLLVSPREVLKNVGTKITPEIPTTVDAMVTSWRQSPAYDVKMKSTCTPTDIELKSPFAKSQYSLSYPRSFADHFKSVFVRQYKVTRRNTLFLNARIFGACVTSLILGSVWFDLPLERGFENSACSFSLTFSVEQKYVAFKHLDSKLFPELTYLASWAMVHLPIAIVETLIFSCVLYPMVGLNLAFRNWAFFYLQLVLVNVAMASFFRVIALLAPNMEIAQTYPGPFIAVMILFAGFLISPDKMGGLKFMYWISIFAYCLRSLCQNEFLSSSYDTLVPVDTVAAASFITSNPSYESTSMNDLCTQGLSGFPACGNMGEIILDTIGITSDTSYKWAGPGFCVGFFGLTFLIGLRTLYTVRIQRNIGSSRIEEKAENEDAVIHMGIDVTAAQKAMEFTPMAISWKNLCYTVQVAAATPQSGDKSEDKPDGDKKYNKREKTVSKQLLHNITSAAQPGRMLALMGSSGAGKTTLLDVIAGRKNTGVTTGEVKLNGHEVQKETMIGTAGSDTGLAPGQRKVLTVAVELVSNAPVFFLDEPTSGLDARSALIVMKEVKKVAALGRTVISTIHQPSTEIFMMFDDMLLLQRGGYQVYFGELGQEGSSMVNYLQSLNMSIPLPAGMNPASWMLDVLGGSDSSGTANKSDKQAIINGKGNMRRSSSGIALDGMMLDKKFLESSEGKKAMTLVNEISERGANDPMFSFSSPYARSFKTQLSAILVRTNNAQLRDIGYNCGRIGILTVLYILFGVIYLDLDTSDEAGVQSMVACVFMTTIFTGIICMNSVMPVRVRERAVAFRERSSFMYDAVPFSLAQALIEVPWLIVVSLCTVIPMYFLVGMIPTAERLFFHILINFMVSFTFLSFGQAVACLCSTIETAQAGTSAFIPICFLFGGLYLPLPQIPVYWQWAYYINPVSYSIQAVVAPQFERRGCTGPYPGGNCPTIQAFRGTYFEKIDTLSYVEQKYDIKFSERWIACGYLGIFMFGMQFLHSFFFKTSNVVKR

SEQ ID NO: 18430 - protein, 427 aa, Bordetella pertussis Tohama I
MSTNAELFDRACRSIPGGVNSPVRAFRSVGGTPRFIQRAQGPYVWDAEGKQYIDYVGSWGPAILGHAHPEVVRAVQEAAVHGLSFGAPTEAEVELAEMLIARLPSLEQVRLVSSGTEATMTAIRLARGATGRHKIIKFEGCYHGHSDSLLVKAGSGLLTFGNPSSAGVPPEFVAHTLTLEFNNLAVVDAAFSQHGAEIACVIVEPVAGNMNLIKPAEGFLAGLRELCTRHGAVLIFDEVMTGFRIGPQGVQGLTGVRPDLTTLAKVIGGGMPVGAFGGRADLMTHIAPLGGVYQAGTLSGNPVAVAAGLATMRLIGEPGFYERLSAQTARLAQGLQERARAAGVPFSADAIGGMFGLYFGDRVPASFAEVSACDTEAFKRFFHAMLERGIHFAPSAFEAGFVSATHDDAVIDATLEAAEQVFATLRA

SEQ ID NO: 18431 - protein, 165 aa, Oryza sativa (japonica cultivar-group)
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGEHWDPGDWYNLSDCHPKLMSAWQQLAVMACDAF

SEQ ID NO: 18432 - protein, 429 aa, Streptomyces avermitilis MA-4680
MSDNSVVLRYGDGEYTYPVIDSTVGDKGFDIGKLRAQTGLVTLDSGYGNTAAYKSAITYLDGEQGILRYRGYPIEQLAERSTFLEVAYLLINGELPTVDELSTFKGEITQHTLLHEDVKNFYRGFPRDAHPMAMLSSVVSALSTFYQDSHNPFDEKQRNLSTIRLLAKLPTIAAYAYKKSIGHPFVYPRNDLGYVENFLRMTFSVPAQDYDLDPVVVSALDKLLILHADHEQNCSTSTVRLVGSSQANMFASISAGISALWGPLHGGANQSVLEMLEGIQTSGGDVDTFIRKVKNKEDGVKLMGFGHRVYKNFDPRAKIIKAAAHDVLSALGKSDELLDIALKLEEHALADDYFVERKLYPNVDFYTGLIYRAMGFPTEMFTVLFALGRLPGWIAQWHEMIKEPGSRIGRPRQIYTGEVLRDFVPVEGR

SEQ ID NO: 18433 - protein, 569 aa, Saccharomyces kudriavzevii IFO 1802
MSFQIETVPTKPYEDQKPGTSGLRKKTKVFKDQPNYTENFIQSIMEAIPEGSKGATLVVGGDGRYYNDVILNKIAAIGSANGIKKLVIGQYGLLSTPAASHIMRTYEEECTGGIILTASHNPGGPENDMGIKYNLSNGGPAPESVTNAIWDISKKLTNYKIVKDFPELDLKTIGKNKKYGPLLIDVIDITKAYVDFLKKIFDFDLIKKFIDNQRSTKNWKLLFDSMNGVTGPYGKAIFVDEFGLPAEEVLQNWHPSPDFGGMHPDPNLTYASSLVKRVDREKIEFGAASDGDGDRNMIYGYGPSFVSPGDSVAIIAEYAAEIPYFAKQGIYGLARSFPTSAAIDRVAKAHGLNCYEVPTGWKFFCALFDAKKLSICGEESFGTGSNHVREKDGVWAVMAWLNILAIYNKHHPENEASIKTIQNEFWAKYGRTFFTRYDFEKVESEKANKIVDQLRAYVTKSGVINSAFPADESLKVTDCGDFSYTDLDGSVSDHQGLYVKLSNGARFVLRLSGTGSSGATIRLYVEKYCDDKSQYQKTAEEYLKPIINSVIKFLKFKQVLGTDEPTVRT

SEQ ID NO: 18434 - protein, 573 aa, Saccharomyces mikatae IFO 1815
MAFEENNKPVASEQPQAAEDLVSSFSKDSHLSAQSQKYSNDELKAGEANPEGSESVPMEIPKKPMSEYVTVSLLCLCVAFGGFMFGWDTGTISGFVAQTDFLRRFGMKHKDGTHYLSNVRTGLIVAIFNIGCAFGGIILSKAGDMYGRKKGLSIVVSVYIVGIIIQIASINKWYQYFIGRIISGLGVGGIAVLSPMLISEIAPKHLRGTLVSCYQLMITAGIFLGYCTNYGTKNYSNSVQWRVPLGLCFAWSLFMIGALTLVPESPRYLCEMNRVEDAKHSIAKSNKVSPEDPAVQAELDLIMAGVEAEKLAGNASWGELFSTKTKVFQRLLMGVLVQMFQQLTGNNYFFYYGTIVFKSVGLNDSFQTSIVIGVVNFASTFFSLWTVENLGRRKCLLLGAATMMACMVIFASVGVTRLYPHGKSQPSSKGAGNCMIVFTCFYIFCYATTWAPVAWVITAESFPLRVKSKCMAMASASNWVWGFLIAFFTPFITSAINFYYGYVFMGCLVAMFFYVFFFVPETKGLSLEEIQELWEEGVLPWKSEGWIPSSRRGNDYNLEDLQHDNKPWYKAML

SEQ ID NO: 18435 - protein, 363 aa, Aspergillus nidulans FGSC A4
MFAARNFATPARQCLRSTRVAPNLASTRLQGKYTVTLIEGDGIGPEISQSVKDIFSAANAPIKWESVDVTPILKDGKTAIPDAAIDSVRKNYVALKGPLATPVGKGHVSLNLTLRRTFNLFANLRPCRSVAGYKTPYDNVDTVLIRENTEGEYSGIEHVVVDGVVQSIKLITREASERVLRFAFQYARSINKKKVRVVHKATIMKMSDGLFLNTAREVAKDFPDVEFDAELLDNSCLKITTDPTPYNDKVLVMPNLYGDILSDMCAGLIGGLGLTPSGNIGDECSIFEAVHGSAPDIAGKGLANPTALLLSSIMMLQHMGLNEHASRIQKAIFDTLAEGKTLTGDLGGKAKTHEYADAIIKRL

SEQ ID NO: 18436 - protein, 555 aa, Borrelia burgdorferi B31
MNTSLFKQERQKYIPKLPNILKKDFNNISLVYGENTEAIQDRQALKEFFKNTYGLPIISFTEGESSLSFSKALNIGIILSGGPAPGGHNVISGVFDAIKKFNPNSKLFGFKGGPLGLLENDKIELTESLINSYRNTGGFDIVSSGRTKIETEEHYNKALFVAKENNLNAIIIIGGDDSNTNAAILAEYFKKNGENIQVIGVPKTIDADLRNDHIEISFGFDSATKIYSELIGNLCRDAMSTKKYWHFVKLMGRSASHVALECALKTHPNICIVSEEVLAKKKTLSEIIDEMVSVILKRSLNGDNFGVVIVPEGLIEFIPEVKSLMLELCDIFDKNEGEFKGLNIEKMKEIFVAKLSDYMKGVYLSLPLFIQFELIKSILERDPHGNFNVSRVPTEKLFIEMIQSRLNDMKKRGEYKGSFTPVDHFFGYEGRSAFPSNFDSDYCYSLGYNAVVLILNGLTGYMSCIKNLNLKPTDWIAGGVPLTMLMNMEERYGEKKPVIKKALVDLEGRPFKEFVKNRDKWALNNLYLYPGPVQYFGSSEIVDEITETLKLELFK

SEQ ID NO: 18437 - protein, 351 aa, Saccharomyces cerevisiae
MFKRFSKKKEAPEDPKNLINIDKPIKELPASIAIPKEKPLTGEQQKMYDEVLKHFSNPDLKVYTSEKNKSEDDLKPLEEEEKAWLTRECFLRYLRATKWVLKDCIDRITMTLAWRREFGISHLGEEHGDKITADLVAVENESGKQVILGYENDARPILYLKPGRQNTKTSHRQVQHLVFMLERVIDFMPAGQDSLALLIDFKDYPDVPKVPGNSKIPPIGVGKEVLHILQTHYPERLGKALLTNIPWLAWTFLKLIHPFIDPLTREKLVFDEPFVKYVPKNELDSLYGGDLKFKYNHDVYWPALVETAREKRDHYFKRFQSFGGIVGLSEVDLRGTHEKLLYPVKSESSTV

SEQ ID NO: 18438 - protein, 334 aa, Oryza sativa (japonica cultivar-group)
MDTDGRLRRALAAFGGGADVWDLVDAALASAARDRPAELRARRDGIVERLYATAAGGRCGNCDAPRSAEPEAAAAAAASPASPDEDADVDGLDDDEGGGMESKILAIRDFLEDPDQSEDELVSLLQSLADMDITYKALQETDIGRHVNGLRKHPSGEVRQLVKLLVRKWKEIVDDWVRLHNSGGDGGSSVLTDGDSPDKIQGRSYQNAQVSDFKYSPSPQRHNGLSSERSSNNNGVESMIEKRRTSPAPTYHNNKQNNSIGYSTTSSSAPVRTVREQKDNLMDLEKLDSARKRLQENYQEAQNGNDFMTYCFMFLLQCAMDIEACIEGLIAHCM

SEQ ID NO: 18439 - protein, 133 aa, Saccharomyces mikatae IFO 1815
PLDRGQPDQAYRKKIIKDVPGTPSDKVITFELAKNWNNDSPRNDFSSQESEDEEDDIIKPVQVNKNPFVSDELITQEIRNERKRALLTENPDIEDVVTYVNKKGEVVEKRKLTDEEKRRFKPKALFQSGDREH

SEQ ID NO: 18440 - protein, 229 aa, Oryza sativa (japonica cultivar-group)
MVSSQSEDELVSLLQSLADMDITYKALQETDIGRHVNGLRKHPSGEVRQLVKLLVRKWKEIVDDWVRLHNSGGDGGSSVLTDGDSPDKIQGRSYQNAQVSDFKYSPSPQRHNGLSSERSSNNNGVESMIEKRRTSPAPTYHNNKQNNSIGYSTTSSSAPVRTVREQKDNLMDLEKLDSARKRLQENYQEAQNAKKQRTIQVMDIHDIPKPKNRNAFIRKGGGGLPGKHR

SEQ ID NO: 18441 - protein, 142 aa, Triticum aestivum
  misc_feature (87)..(87): Xaa can be any naturally occurring amino acid
  misc_feature (92)..(92): Xaa can be any naturally occurring amino acid
  misc_feature (102)..(102): Xaa can be any naturally occurring amino acid
  misc_feature (104)..(104): Xaa can be any naturally occurring amino acid
  misc_feature (112)..(112): Xaa can be any naturally occurring amino acid
  misc_feature (119)..(119): Xaa can be any naturally occurring amino acid
  misc_feature (122)..(122): Xaa can be any naturally occurring amino acid
  misc_feature (125)..(125): Xaa can be any naturally occurring amino acid
  misc_feature (134)..(134): Xaa can be any naturally occurring amino acid
  misc_feature (141)..(141): Xaa can be any naturally occurring amino acid
  unsure (1)..(142): unsure at all Xaa locations
MAPAVMASSATTVAPFQGLKSTAGLPVGRRSSGSLSSVSNGGRIRCMQVWPIEGIKNSETLSYLPPLSTGGLPGNRSDYLDSAQKWXPCLRXNKFGFLFPLXNXPPGYYDGXRYWDMLXLPXFRXTGPTQVLNXVEESKKXT

SEQ ID NO: 18442 - protein, 392 aa, Mycobacterium sp. MCS
MRAVTWQGRRKVSVDNVPDPIIKEPTDAVIRVTSTNICGSDLHLYETLSAFMSPGDIIGHEAMGVVEEVGTQTGDLKVGDRVVIPFNISCGTCWMCDHGLQSQCETTQNRDQGTGAALFGFSKLYGEVAGGQAEYLRVPQAQYTHIKIPEDGPDERFVYLSDVLPTAWQGVEYANVPDGGTLVVVGLGPIGSMACRIAAHRNNCRVIGIDLVEERLDRARPYCAEVIDLRTQDADAVVAELTQGRGADSVIDAVGMEAHGSPVAEAAQTASGFLPSSIGRVVMKHAGVDRLAALNSAIALVRRGGTVSLSGVYGGAADPINMMTLFDKQVTLRMGQANVKRWVPDILPLLTADDPLGVENFATHRLPLAEAPGAYETFQKKQDGMVKVVLTP

SEQ ID NO: 18443 - protein, 484 aa, Escherichia coli
MSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 18444 - protein, 481 aa, Escherichia coli
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 18445 - protein, 448 aa, Escherichia coli
MEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 18446 - protein, 157 aa, Zea mays
MANAGMRPVAGLLLVLNFCMYIIVAAVGGWAINHAINYGFFIGAGLQLPAHFSPIYFPVGNAATGFFVIFAVIAGVVGAASALAGFHHVRAWNAESLPAAASAGFIAWTLTLLAMGLAVKEIELHGRNARLICMESFTIILSATQLFYLLAIYGGLR

SEQ ID NO: 18447 - protein, 705 aa, Crocosphaera watsonii WH 8501
MTLKTLPGESYPIGATVEKDGKHGVNFCIFSKEATFIELLLFAGQNDPQPSHTIPLDTKTNRTHYYWHIFVEGLKAGQIYAYRVHGPFDLSQGHRFNPEKVLLDPYAKAIVGSSIYNREAAKQPGDNCAQALRGVVVDTETYDWEGDWTQKPRLRQPYSKSVIYEMHVGGFTRHPNSGVAPEKKGTFAGLIEPEKIAYLKSLGITAVELLPIHYFDVEDVKPGLQNYWGYSTIGFFAPHSYYSSDQSPLGPVNEFRDMVKALHKEGIEVILDVVFNHTAEGDERGPTLNFRGIDNSTYYILEEDHSQYKNYAGCGNTFRGNHPIVGRFILDCLHYWVTEMHVDGFRFDLASILSRDSSGTPLEDLRGTTPDILWIIESDPVLAGTKLIAEAWDAAGLYDVGRFVELADWFAEWNGPFRDDVRCFVKGDDGMVPRLASRILGSPDIYHREDVDINRSINFVTCHDGFTLNDLVSYDEKHNEGNGEDNCDGDNHNNSWNCGVEGETNDSVINTLRLQQIKNFFTILFLSQGTPMILMGDEIKRTQRGNNNVYCQNNELSWFNWDGVESEYDLWCFLRRLIYFTQGLELFNQEERLEVAYNNPNHPHISWHGVKLGEPDWSDYSHCLAFSLRHPEKKEYLHVMLNAYWEPLEFELPWLGDDEHWYRVVDTSLPIDKTICELDVAVEVTTGNYTTNGRSCVVLMAKAKH

SEQ ID NO: 18448 - protein, 452 aa, Frankia sp. CcI3
MDKQQEFVLRTLEERDIRFVRLWFTDVLGYLKSVEIAPAELEGALAEGIGFDGSAIEGFARVHEADMLARPDPSTFQVLPWRGEHPLTARMFCDLVMPDGTPAAADSRWVLRSALARAADAGFTFYTHPEIEFFLLREPPKRGGPVPPPVDESGYFDLTPNDISHDFRQQAISMLERLGISVEFSHHEVAPGQQEIDLRYADALTIADNIMTFRQVVREVALRQGIYATFMPKPFGNQAGSGMHTHLSLFEGDRNAFHDPTDDYQLSKVAKAFIAGLLAHAAEITAVTNQWVNSYKRLIGDQRVGEVLEAPAYVCWGHNNRSALVRVPLYKLHKSNATRVEFRLPDSACNPYLTFALVLAAGLRGVQGGYELPPASADDVWTLTDTQRRERGITALPGSLAEAVKVMEHSALVRETLGDELFDFFLRNKRAEWLEYRRQVTPFEIDRYLPVL

SEQ ID NO: 18449 - protein, 714 aa, Mycobacterium sp. MCS
MAAAPKPNVTPEVWPGKAYPLGATYDGFGTNFALFSEAAERVELCLFDADGEQTACVTLPEVDGFVWHGFIPNIEPGQRYGYRVHGPYDPPNGQRCNPNKLLLDPYAKAIDGTFDWGQPLFSYNFGDPDSRNDDDSADCMPKSVVINPYFDWGTDRPPNHEYADTVIYEAHVKGLTQTHPDIPEQIRGTYSAVAHPVIIDHLKALGVNAIELMPVHHFANDSTLLDKGLSNYWGYNTIGFLAPDPKYSSSLTPGGQVQEFKAMVRTLHEAGIEVILDVVYNHTAEGNHMGPTLSFRGIDNAAYYRLVDDDKRYYMDYTGTGNSLNAGHPHALQLIMDSLRYWVTEMHVDGFRFDLASTLAREFYDVDRLATFFELVQQDPTVSQVKLIAEPWDVGPGGYQVGNFPPQWTEWNGKYRDTVRDYWRGESATLDEFASRLTGSSDLYEHTSRRPVASINFVIAHDGFTLRDLVSYNEKHNEDNGEDNNDGESHNRSWNCGVEGPTDDPQVNALRSRQQRNFLTTLLLSQGVPMIAHGDELGRTQHGNNNVYCQDNELSWIDWSTVDTELMAFTQKVSELRAAHPVFRRRRFFSGRPVRQRGAPGLPDIAWFAPDGSEMTDEDWDSGFAKSIAVYLNGQGIPDLDVRGQRVTDDSFLLCFNAHHEPLEFAMPAAEFARAWLPVINTADDDDARESVTAGAKIEVAERSVLVLQAVNEP

SEQ ID NO: 18450 - protein, 558 aa, Zea mays
  misc_feature (80)..(80): Xaa can be any naturally occurring amino acid
  misc_feature (93)..(93): Xaa can be any naturally occurring amino acid
  misc_feature (436)..(436): Xaa can be any naturally occurring amino acid
  unsure (1)..(558): unsure at all Xaa locations
MGSVDAAIAVPVPAAEEKAVEEKAVVFRSKLPDIEIDSSMALHTYCFGKMGEVAERACLVDGLTGASYTYAEVESLSRRXAASGLRAMGVGKXGDVVMSLLRNCPEFAFTFLGAARLGAATTTANPFYTPHEVHRQAEAAGARLIVTEACAVEKVREFAAERGIPVVTVDGRFDGCVEFAELIAAEELEADADIHPDDVVALPYSSGTTGLPKGVMLTHRSLITSVAQQVDGENPNLYFRKDDVVLCLLPLFHIYSLNSVLLAGLRAGSTIVIMRKFDLGALVDLVRRYVITIAPFVPPIVVEIAKSPRVTAGDLASIRMVMSGAAPMGKELQDAFMAKIPNAVLGQGYGMTEAGPVLAMCLAFAKEPYPVKSGSCGTVVRNAELKIVDPDTGAALGRNQPGEICIRGEQIMKGYLNDPESTKNTIDKDGWLHTGXDIGYVDDDDEIFIVDRLKEIIKYKGFQVPPAELEALLITHPEIKDAAVVSMNDDLAGEIPVAFIVRTEGSQVTEDEIKQFVAKEVVFYKKIHKVFFTESIPKNPSGKILRKDLRARLAAGVH

SEQ ID NO: 18451 - protein, 376 aa, Shewanella oneidensis MR-1
MTAQILKSKAAVAWAVGEPLSIEIVDVMPPQKGEVRVKMIATGVCHTDAFTLSGDDPEGIFPCILGHEGGGIVESIGEGVTSVQVGDHVIPLYTPECGECKFCKSGKTNLCQKIRETQGKGLMPDGTSRFSKDGQIIYHYMGTSTFSEYTVLPEISLAKVNPDAPLEEVCLLGCGVTTGMGAVMNTAKVEEGATVAIFGMGGIGLSAVIGATMAKASRIIVIDINESKFELAGKLGATDFINPKDYDKPIQDVIVELTDGGVDYSFECIGNVNVMRSALECCHKGWGESVVIGVAGAGQEISTRPFQLVTGRVWKGSAFGGVKGRSELPEYVERYLAGEFKLSDFITHTMSLEQVNDAFDLMHQGKSIRTVIHFDK

SEQ ID NO: 18452 - protein, 316 aa, Streptomyces avermitilis MA-4680
MAYDLITMGRIGVDLYPLQTGVPLPQVTSFGKFLGGSATNVAVAAARLGRSTAVVTRTGDDPFGTYIHEALRGFGVDDRWVTQVAGLPTPVTFCEIFPPDDFPLYFYRQPKAPDLEIDAHELDLDEIRAARIFWMTGTGLSEEPSRTATLAALAHRAKSGTTVFDLDWRPMFWADPAQARPFYTEALRHTTVAVGNVDEVEIATGERDPHSAARALLAAGVELAVVKQGPKGVLAVHRDGTTAEVPPLPVKVLNGLGAGDAFGGSLCHGLLDGWDLERLMRYANAAGAIVASRLECSSAMPTPAEVEDALTAGAVL

SEQ ID NO: 18453 - protein, 265 aa, Oryza sativa (japonica cultivar-group)
MEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 18454 - protein, 433 aa, Escherichia coli
MVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 18455 - protein, 428 aa, Oryza sativa (indica cultivar-group)
MIEGSRFQNMLGGAGIGGGIGCRGRQENEMNGFHNMPYYHKVGESSHMSVDNADNLNMMNFVGGSVAMSVDNSSVGSNESRTVMLKHPGLRDMPAPSYSVHNSVIHPNRAMAPTLNEDALARVLMDPSHPTEILSNYEEWTIDLGKLDMGAPFAQGAFGKLYRGTYNGEDVAIKLLEKPENDPERAQLMEQQFVQEVMMLSTLRHPNIVRFIGACRKSIVWCIITEYAKGGSVRQFLARRQNKSVPLGLAVKQALDVARGMAYVHALRFIHRDLKSDNLLISADKSIKIADFGVARIEVQTEGMTPETGTYRWMAPEMIQHRPYDHKVDVYSFGIVLWELITGMLPFTNMTAVQAAFAVVNRGSRPAIPQDCVDSLSKIMTCCWDANPEVRPSFAEIVVMLENAEIEVMRNVRRARFRCCIAEPMTTD

SEQ ID NO: 18456 - protein, 294 aa, Staphylococcus epidermidis ATCC 12228
MTHMFEGVGVALATPFTNNEVDFNALERHVQFLLNNNIQAIIVNGTTAESPTLSDEEKEKVLATVVKLVNHSVPVIAGTGTNNTYKSIQASIRAKEIGADAVMLITPYYNKTNQRGLIQHFETIANEVKLPVILYNVPSRTNMTIEPETVGILSHNPYIVALKDATNDFDYFDQVKQRINTNEFALYSGNDDNVVKFYQRGGNGVISVIANVIPQEFQYLYDQRQNETDITNYFKPIEKLLEALSLDVNPIPIKVLTAYLGYGHYEVRLPLVPLEEAQCKQVERAFEQFKAGEQ

SEQ ID NO: 18457 - protein, 421 aa, Staphylococcus epidermidis ATCC 12228
MVVNYNDNGELTMGGTSLKTIAQSFGTPSIVYDEDQIRNQIRRYHKAFEASGLSYNISYASKAFTCIQMVKLIDEENLQLDVVSEGELYTALEAGFDSKRIHFHGNNKTKREIQYALDNQIGYFVVDTLEEIELIDKYADSNVDVVLRVNPGVEAHTHEFIQTGQEDSKFGLSIKHGLALNAVNKVKATKHLQLKGIHFHIGSQIEGTEAMIKTAKIVLNWLASERIEVSLLNIGGGFGIKYVEGDESFPIEQGISEITEAIKETAQALQYNIPEIGIEPGRSIVGEAGITLYEVGTIKDIPGVNKYVSVDGGMSDHIRTALYGAQYEALLVNRNEKANESVTIAGKLCESGDIIVRDAPLPSSVHRGDYLAILSTGAYHYSMASNYNQMQKPPVFFLKDGKAREVIKRQSLRQLIINDTK

SEQ ID NO: 18458 - protein, 434 aa, Bacillus halodurans C-125
MKKNDETSRNLIGLDQQHFIHPTSSMQQQQQHGPAHIFVRGKGVYLYDHDGKAYLDGMSSLWNVNVGHGRRELGEVAKKQMDTLAFSSCFATFSNKPAIELAAKLARVSPPSLRATFFTSGGSEANDTAFKLARHYWKVKDQPKKRKIIARMKSYHGVAMGATSATGLKPFRDFAPSLAPDFLHVDHMSIEALRALIDREGPETIAAFVCEPIQGAGGVHVAPDSYLCDIRSICDEYELLFIADEVITGFGRTGAYFGCDHANISPDMMCIAKGITSGYAPLGGVMLSKSLHEQLTAHSHGTLLHGYTYSGHPTSCAVALKNIQIIEEENLIDHAATMGEKLLLGFRTIQEQYSEIHDARGRGLMAALAFSHNGKNEPLAPKVVQAADQRGLILRAVTFDQQDVLVCAPPLIINEEELNQLLSILESSVQAVVS

SEQ ID NO: 18459 - protein, 513 aa, Vibrio angustum S14
MSAKKPLALVILDGWGYREDNADNAIANAQTPVMDGLLAQNPNTLISASGIDVGLPDGQMGNSEVGHTNIGAGRVVYQDLTRITKAISDGEFFENEALVTAIDKAVNAGKAVHILGLLSPGGVHSHEDHIAAAIEMAAKRGAEKIYLHAFLDGRDTPPRSAKNSLVRFNELFAKLGKGRTASLIGRYYAMDRDNNWDRVEKAYDLITAAKAEFTVANAVDGLAAAYERDENDEFVQATEVRAEGQEAAIVADGDSVIFMNYRADRAREITRAFEPGFTDFARAQFPQLSDFVMLTQYAADIELTTAFKPASLDNTLGEWLSKKGKKQLRISETEKYAHVTFFFNGGKEDEFDGESRQLVASPKVATYDLQPEMSAPELTDKLVAAIKGGEFDMIICNYPNGDMVGHTGVYDAAVKACEALDTCLGKVVAAIKEMDGQLLITADHGNAEMMVDPSTGGIHTAHTNLPVPLIYVGSKDLELKSGGKLSDLAPTMLSLTDMEIPAEMSGQVLYNLK

SEQ ID NO: 18460 - protein, 275 aa, Triticum aestivum
  misc_feature (23)..(23): Xaa can be any naturally occurring amino acid
  unsure (1)..(275): unsure at all Xaa locations
KAAEGESRRRAAKGDGEKKEVAXISSYWGIEQSKKLVREDGTEWKWSCFRPWETYTADTSIDPTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 18461 - protein, 490 aa, Thermotoga maritima MSB8
MKEIDELTIKEYGVDSRILMERAGISVVLAMEEELGNLSDYRFLVLCGGGNNGGDGFVVARNLLGVVKDVLVVFLGKKKTPDCEYNYGLYKKFGGKVVEQFEPSILNEFDVVVDAIFGTGLRGEITGEYAEIINLVNKSGKVVVSVDVPSGIDSNTGKVLRTAVKADLTVTFGVPKIGHILFPGRDLTGKLKVANIGHPVHLINSINRYVITREMVRSLLPERPRDSHKGTYGKVLIIAGSRLYSGAPVLSGMGSLKVGTGLVKLAVPFPQNLIATSRFPELISVPIDTEKGFFSLQNLQECLELSKDVDVVAIGPGLGNNEHVREFVNEFLKTLEKPAVIDADAINVLDTSVLKERKSPAVLTPHPGEMARLVKKTVGDVKYNYELAEEFAKENDCVLVLKSATTIVTDGEKTLFNITGNTGLSKGGSGDVLTGMIAGFIAQGLSPLEASTVSVYLHGFAAELFEQDERGLTASELLRLIPEAIRRLKE

SEQ ID NO: 18462 - protein, 220 aa, Triticum aestivum
  misc_feature (85)..(85): Xaa can be any naturally occurring amino acid
  misc_feature (104)..(104): Xaa can be any naturally occurring amino acid
  unsure (1)..(220): unsure at all Xaa locations
MGSAASPPRALDAATQEDLKRVSAHRAVDMVESGMTLGLGTGSTAAHALDRLGALLRTGALGGGPGVPTSPQREPPPGRLGIPLXGLPDPAKIPLSIKGPKDVXPEPNPLKGRGGSLFREKLWGARPPFGFFCGRVQALPRPGCGGSRPGGVLPFGGGLKGGLYRVGVRKLGGFPARVRARNIYGGGMEGGGFSPGRGAPGGEVFWGGGIWGTRGKIRHG

SEQ ID NO: 18463 - protein, 311 aa, Zea mays
MSIPTSHIPIHIHPPTPTRPPTVFLVFTFLTQFTHPLTISPIDHRCHIPNPLPVVFGVFPAAAVAAVVHHTVPLVVISMRERNSSIDQEHQRGSSSRSTMPFAASRTSQQQHSRVATNGRAVAVCAGHAGVPDEVARHHEHAVAAGQCCAAMVQSIAAPVDAVWSLVRRFDQPQRYKRFIRSCHLVDGDGAEVGSVRELLLVSGLPAESSRERLEIRDDERRVISFRVLGGDHRLANYRSVTTVHEAAPSQDGRPLTMVVESYVVDVPPGNTVEETRIFVDTIVRCNLQSLEGTVIRQLEIAAMPHDDNQN

SEQ ID NO: 18464 - protein, 209 aa, Ostreococcus tauri
  misc_feature (1)..(1): Xaa can be any naturally occurring amino acid
  unsure (1)..(209): unsure at all Xaa locations
XRSRAALDAYAREIDRRDSRFGSTLIVEKIDDDAPFDAFAGRVLLTRADAPDAILSEYSERAGEVGAGGVFDAFSLLPATTGGAMIGILGLGGGTCARAMARHHPAVRMIGWELDPAIVELARRHFGVDELERSGTLRCETGDAFGGCAAYDGLFDGLVVDCFDENSTVVACLRDRETWAALLTHDWHYFSAPPGALAGSNWLANTLGL

SEQ ID NO: 18465 - protein, 465 aa, Salmonella enterica subsp. enterica serovar Typhi str. CT18
MTDSIMQNYNQLREQVINGDRRFQHKDGHLCFEGVDLDALARQYPTPFYVFSEPEIIRNIHEIQQAFAAHKNTKTFFASKTCSVMGVLKAIRDAGICAEANSQYEVRKCLEIGFRGDQIVFNGVVKKPADLEYAIANDLYLINVDSLYELEHIDAISRKLKKVANVCVRVEPNVPSATHAELVTAFHAKSGLDLEQAEETCRRILAMPYVHLRGLHMHVGDQVPESEPFAKATKVLVDESRRLEEVLGIKFDLINVGGGIPVPYKYDDENGDPLKDNMYAGITAQDFADAVIREVHKWRTDVEICIEPGRKVTGSAAVLLTEVSCEKRKTNYDLNGNVECHVEWKFVDAGYSVLSDSQHFDWFFYVYNASRMTAAHDAWIKLAGPLCDGGDYFHMGVKGEEFLLPKETHVGDIVAFLDAGAYTIESQTVYNNRPRTGVVMIDKNGETRLIRREDSYEDMVKYDIY

SEQ ID NO: 18466 - protein, 725 aa, Fusobacterium nucleatum subsp. nucleatum ATCC 25586
MNNYWEQLLDKAKANHLNLDFDKIKLALGFAEESHQGQYRKSGDDYIIHPVEVAKILMDMKMDTDTIVAGLLHDVVEDTLIPIADIKYNFGDTVATLVDGVTKLKTLPNGTKNQAENIRKMILAMAENIRVILIKLADRLHNMRTLKFMKPEKQQSISKETLDIYAPLAHRLGMAKIKSELEDIAFSYLHHDEFLEIKRLVDNTKEERKDYIENFIRTIIRTLSDLDIKAEVKGRFKHFYSIYKKMYQKGKEFDDIYDLMGVRVIVEDKATCYHVLGIVHSQYTPVPGRFKDYIAVPKSNNYQSIHTTIVGPLGKFIEIQIRTKDMDDIAEEGIAAHWNYKENKKSSKDDNIYGWLRHIIEFQNESDSTEDFIEGVTGDIDRGTVFTFSPKGDIIELPVGATALDFAFMVHTQVGCKCVGAKVNGRMVTIDHKLKSGDKVEIITSKNSKGPSIDWLDIVVTHGAKGKIRKFLKDENKETVTKIGKDNLEKEASKLGMTLKELENDLTLKKHMEKNNIPNLEEFYFYIGEKRSRLDVLITKIKTSLEKERAASTLTIEEVLKKKEEKKKEGKNDFGIVIDGINNTLIRFAKCCTPLPGDDIGGFVTKLTGITVHRKDCPNFHAMVEKDPSREILVKWDENLIETKMNKYNFTFTVVLNDRPNILMEIVNLIANHKINITSVNSYEVKKDGDRIVKVKISIEIKAKTEYDYLINNILKLKDVISVER

SEQ ID NO: 18467 - protein, 170 aa, Fusobacterium nucleatum subsp. nucleatum ATCC 25586
MDLKNYVASIENYPKEGIIFRDITPLMNDGEAYKYATEKIVEFAKDHHIDIVVGPEARGFIFGCPVSYALGVGFVPVRKPGKLPREVIEYAYDLEYGSNKLCLHKDSIKPGQKVLVVDDLLATGGTVEATIKLVEELGGVVAGLAFLIELVDLKGRERLDKYPMITLMQY

SEQ ID NO: 18468 - protein, 324 aa, Zea mays
ARDHYLEHPNRKDLIPYPCAAHLPFPAWSHSLAPFFPSPDLPIPEITPDTPHPRTPRPHLAMGSAAASPPPSGKLTQEELKRVAAHRAVEFVEPGMTLGLGTGSTAAHALDRLGDLLRAGALPGVAGVPTSLKTEAHAARAGIPLLPLPGARIALSIDGADEVDPDLNLVKGRGGSLLREKMIEGAGARFVVIVDESKLVPRLGCTGAIPVEVIPFGALHTLGLIRGLFDGLPGFHARLRTVPAAPAKGGEDSDSESEQPFVTDNGNYIVEMFFEDGIRGDLRDISDRLLRITGVVEHGMFLGMATTVIVANKDGTVSVMDRKK

SEQ ID NO: 18469 - protein, 164 aa, Sulfitobacter sp. EE-36
MANTDYTRHAKYFLLQDFYQGLKLGIKYMFKPKATINYPHEKGPLSPRFRGEHALRRYPNGEERCIACKLCEAVCPAQAITIDAEPRDDGSRRTTRYDIDMTKCIYCGFCQEACPVDAIVEGPNFEFSTETREELFYDKAKLLDNGERWEAEIARNLELDAPYR

SEQ ID NO: 18470 - protein, 467 aa, Oryza sativa (japonica cultivar-group)
MAALLHLQSSATAAAAPSFLLLRRRGGGVTAPAGSSRRRRACFRVEAKIREIFMPALSSTMTEGKIVSWTASEGDRLAKGDPVVVVESDKADMDVETFHDGFLAAVLVPAGESAPVGSAIALLAESEDEIPAAQSKAASLSSSSSSSPPPPPPQESTPPPPPPPPPAPVAAAVSAPAPPSPASQGGLRVVASPYARKLAKDLNVDLNSITGSGPGGRIVAKDVEAAAAAPKKAAPVAAARPDVPLGSTVPFTTMQGAVSKNMVESLAVPTFRVGYTFTTDALDALYKKIKPKGVTMSALLAKATAMALVQHPVINSSCRDGKSFTYNSSINIAVAVAIDGGLITPVLPDADKLDIYSLSRKWKELVDKARAKQLQPHEYNSGTFTISNLGMFGVDRFDAILPPGTGAIMAVGSSQPTLVGTKDGSIGIKNQMQVNVTADHRVIYGADLAAFLQTLSKIIEDPKDLTF

SEQ ID NO: 18471 - protein, 90 aa, Glycine max
MASKQEPKLSLTLLVDKERNCVVVAEASGDLIDILFSFLTLPLGTIIRLVSKKQGHDEADEIGCINNLYQSLENSGDEVFWNHICKRMLL

SEQ ID NO: 18472 - protein, 295 aa, Zea mays
MFPIPPPVIPAPATVVGRFQIVSVGASNYIEELNRIGFLLQMFPYVAIDTEYPGTLHGAPAGPALTTAARYYAFVKANVDELPALQLGLTLCDEGGKLPEAIDDYGRSVQLAWEFNFSDFDIARGRHAPESVRFLMSQGFHFDVAREYGVPSAYFADWLAGVLARLPHWCQPPTWVAFGGAFDFAYMVKMLSGGQPLPDTPEELVARARYLLRGPVFDAKCMAEHCGRPELCGAGLRTVAAVLGVPQLDPAPPRLAGPKSHTACRIYTVMRTTLVHGGDGYAYAYAYEGLIDGIY

SEQ ID NO: 18473 - protein, 390 aa, Oenococcus oeni PSU-1
MKTIVVLGAGYAGLRVVRELVDHKANAKIVLINKNSYHYESTQLHEVAIGSKSPNDISLNIRDVIGNQVDFIEDEVVKIDRQNKKVELKSKSTVSYDYLVTCLGFESETFGIKGADEFGLPIIDIDTALVAKKHLEETLARFQSSHDENDLHIAVCGAGFTSIEYIGELLHRLPDFVKRFNLPAEKIKIYCIEAAPKVLPMFDPKLVDYAVNYLKNQGVEFYTETPITEVKKGAVISKDKAFNANTIIWTTGVKGSHVINDSGYTQKRNRVAVQNDLSSSDDPNEFIIGDVSAVPSPDGRFYPTTGQISVAQATLAASNIIAKLNNQKTSPFTYHSLGTVCSLGPTNGVAELSFMGHWKLKGHKVAPLKRIVNDRTVFELVGFKAMMSSK

SEQ ID NO: 18474 - protein, 114 aa, Zea mays
  misc_feature (67)..(67): Xaa can be any naturally occurring amino acid
  misc_feature (83)..(83): Xaa can be any naturally occurring amino acid
  unsure (1)..(114): unsure at all Xaa locations
RAVRVVDKSGDRIVYFGVEYIGIAHGHWGLSVCEAPFLYRALQNKFLATFPFPFTKRGLLIKFKLLXGGGSLMKFVRASAYGXDILWIKKGPQRCGRTRSHPPRSKLRFSHCTV

SEQ ID NO: 18475 - protein, 1131 aa, Sorghum bicolor
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHIREAGMSTFILTAELAAAPSAVGQ

SEQ ID NO: 18476 - protein, 405 aa, Magnetospirillum magnetotacticum MS-1
MFRTIDSFDVKGKRVLVRADLNVPAKDGKVTDTTRIDRSAATLKELAGKGAKVIVLTHFGRPKGRDAKYSQKLLVEPLARAVGQPVLWADDCIGVEVEQMIAKMKDGEIALLENVRFYENEEENDIGFAKMLAGLGDIYVNDAFSTAHRAHASTEGVAHLLPCAAGRLMQAELEALGKALEHPEKPVAAIVGGAKVSTKLDLLGNLVARVDYLIIGGGMANTFLFAQGKQVGKSLCEKDLADTAREILEKAKAAHCHIVLPVDAVVAGEFAENAANQVVSVDAVPADKMILDAGPASAEAIIDRLGGCKTLVWNGPLGAFEIAPFDKATNAVAQWAAERTVQGKLLTVGGGGDTVSALAKAGVEDKFSYISTAGGAFLEWLEGKVLPGVAALEVKNCGSGCGCGG

SEQ ID NO: 18477 - protein, 211 aa, Photobacterium sp. SKA34
MSDFALTHRETNKFSERLAYKITQLLKYSLNIFYGKKYAKRAVILETIAAVPGMVAGMFNHLKALRRMKDDEGWIKELLSEADNERMHLMIFLDIAKPSWVERGLVLLGQAVFICVYSIIYLTSSKIAHRVVGYFEEEACKSYTEFLEKIDSGELENVAAPQIAINYYELHDDAKLRDVVLRIREDEAKHRDRNHNFADCYQNKELPAHQA

SEQ ID NO: 18478 - protein, 891 aa, Arabidopsis thaliana
MLEPRGADIPILFLVLVVLPVVAYILLGKWSNISEKRVRANLLAQMAAEEALRAETVVNADRGVRFESVATENRAQRTRTKTVSAGGGAVRAEFDAGARETVAEQRSDSVTATCGVTVVAPVNNNELHVCARCFGPAKTRCSRCKSVRYCSGKCQIIHWRVAHKDECVPVESCSSSSERVSFEKDSVLYDHGMDSTMYSNNTTQAAKGKTSKSSVDFASLGISQNDITPQINTQGRKSVGKQHSSKANRESCRRDSATVFDSSDEAASAGGDNKTSHIKHKSRGNSYAAETNPRRHSVDSSAVQMNGQSFVSGMQESHKHENNLGVRSSFGCPNTQYPSNETVRSKDTGISEESNGISSTMGIMKMMGLRNSTKHDDRYKNLKMLFPYEEFLKFFQCEVFDLSPRGLVNCGNSCYANAVLQSLTCTKPLVAYLLRRSHSRSCSGKDWCLMCELEQHVMMLRESGGPLSASRILSHMRSINCQIGDGSQEDAHEFLRLLVASMQSICLERLGGETKVDPRLQETTLVQHMFGGRLRSKVKCLRCDHESERYENIMDLTLEIYGWVESLQDALTQFTRPEDLDGENMYRCSRCAGYVRARKELSIHEAPNILTIVLKRFQEGRYGKINKCISFPEMLDMIPFMTRTGDVPPLYMLYAVIVHLDTLNASFSGHYISYVKDLRGNWYRIDDSEIHPVPMTQVMSEGAYMLFYMRSYPRPQRGEHNGKAPVHHSQPRNEMKEQRKPVNRFKPRADHKNTESSSSEWSLFTSSDEASFTTESTRDSFSTIDYTDVCHVVDSSSPFAIFNNVYHNVEPSPHNTVACRMFSGTKPETRYFVEQETNHNNTVVLDATPSLYPIPAPYPPHDYYDQSMYVNYETNPEFNNGQDQDRTYSYW

SEQ ID NO: 18479 - protein, 495 aa, Bacillus subtilis subsp. subtilis str. 168
MSSLTMQVTKRLETFLQGTKKLYIDGKFVPSASGATFDTPNPATGETLMTLYEAQAADVDKAVKAARKAFDQGEWRTMSPASRSRLMYKLADLMEEHKTELAQLETLDNGKPINETTNGDIPLAIEHMRYYAGWCTKITGQTIPVSGAYFNYTRHEPVGVVGQIIPWNFPLLMAMWKMGAALATGCTIVLKPAEQTPLSALYLAELIDQAGFPAGVINIIPGFGEDAGEALTNHEAVDKIAFTGSTEIGKKIMSTAAKSIKRVTLELGGKSPNILLPDANLKKAIPGALNGVMFNQGQVCCAGSRVFIHKDQYDEVVDEMASYAESLRQGAGLHKDTQIGPLVSKEQHERVLSYIQKGKDEGAKAVTGGSCPFEAGYFVAPTVFANVEDEMTIAKEEIFGPVLTAIPYETVDEVIERANHSEYGLAAGLWTENVKQAHYIADRLQAGTVWVNCYNVFDAASPFGGYKQSGLGREMGSYALDNYTEVKSVWVNLED

SEQ ID NO: 18480 - protein, 407 aa, Sulfitobacter sp. EE-36
MDGTKGFEDALTGEQKIRNFNINFGPQHPAAHGVLRLVLELDGEIVERCDPHIGLLHRGTEKLMESRTYLQNLPYFDRLDYVAPMNQEHAWCLAIEKLTGVEVPRRASLIRVLYSEIGRILSHLLNVTTQAMDVGALTPPLWGFEEREDLMIFYERACGARLHAAYFRPGGVHQDLPPALLDDIEAWTHKFLSGFMVDVDQLLTENRIFKQRNADIGIVSEQDIQDWGFSGVMVRGSGLAWDLRRAQPYECYDEFDFQIPTGVNGDCYDRYLVRMEEMRQSTYIIQQAIEKLRAPEGQGDVLARGKITPPSRTAMKTDMESLIHHFKLYTEGFHVPAGEVYCAVEAPKGEFGVYLVADGSNKPYRAKLRAPGYLHLQAMDYVAKGHQLADVAAIIGTMDIVFGEVDR

SEQ ID NO: 18481 - protein, 417 aa, Bacillus subtilis subsp. subtilis str. 168
MAEIKVPELAESISEGTIAQWLKQPGDYVEQGEYLLELETDKVNVELTAEESGVLQEVLKDSGDTVQVGEIIGTISEGAGESSAPAPTEKTESKESVKEEKQAEPAAQEVSEEAQSEAKSRTIASPSARKLAREKGIDLSQVPTGDPLGRVRKQDVEAYEKPASKPAPQQKQQPQAQKAQQSFDKPVEVQKMSRRRQTIAKRLVEVQQTSAMLTTFNEVDMTAVMNLRKRRKDQFFEQNEVKLGFMSFFTKAVVAALKKYPLLNAEIQGDELIVKKFYDIGIAVAAVEGLVVPVVRDADRLTFAGIEKEIGELAKKARNNKLTLSELEGGSFTITNGGTFGSLMSTPILNSPQVGILGMHKIQLRPVAIDEERFENRPMMYIALSYDHRIVDGKEAVGFLVTIKNLLEDPEQLLLEG

SEQ ID NO: 18482 - protein, 201 aa, Sulfitobacter sp. EE-36
MSEQLNELGAYIEAKRPDCILGWDIAFDELNMDVTQANLPGLVEFIKSDATCRFSSLVDITAVDYPGRAKRFDVVYHFLSMYQNQRIRLRVAAREEDMVPSIVDIHPSANWFEREVFDMFGIIFAGHPDLRRLLTDYGFRGYPLRKDFPTTGYTEVRYDETEKRVVYEPVSLVQEYRQFDFMSPWEGGEYILPGDEKPEAK

SEQ ID NO: 18483 - protein, 442 aa, Escherichia coli W3110
MAMFGFPHWQLKSTSTESGVVAPDERLPFAQTAVMGVQHAVAMFGATVLMPILMGLDPNLSILMSGIGTLLFFFITGGRVPSYLGSSAAFVGVVIAATGFNGQGINPNISIALGGIIACGLVYTVIGLVVMKIGTRWIERLMPPVVTGAVVMAIGLNLAPIAVKSVSASAFDSWMAVMTVLCIGLVAVFTRGMIQRLLILVGLIVACLLYGVMTNVLGLGKAVDFTLVSHAAWFGLPHFSTPAFNGQAMMLIAPVAVILVAENLGHLKAVAGMTGRNMDPYMGRAFVGDGLATMLSGSVGGSGVTTYAENIGVMAVTKVYSTLVFVAAAVIAMLLGFSPKFGALIHTIPAAVIGGASIVVFGLIAVAGARIWVQNRVDLSQNGNLIMVAVTLVLGAGDFALTLGGFTLGGIGTATFGAILLNALLSRKLVDVPPPEVVHQEP

SEQ ID NO: 18484 - protein, 340 aa, Lactococcus lactis subsp. lactis Il1403
MKAAVVRHNPDGYADLVEKELRAIKPNEALLDMEYCGVCHTDLHVAAGDYGNKAGTVLGHEGIGIVKEIGTDVSSLQVGDRVSVAWFFEGCGHCEYCVSGNETFCREVKNAGYSVDGGMAEEAIVVADYAVKVPDGLDPIEASSITCAGVTTYKAIKVSGVKPGDWQVIFGAGGLGNLAIQYAKNVFGAKVIAVDINQDKLNLAKKIGADVIINSGDVNPVDEIKKITGGLGAQSAIVCAVARIAFEQAVASLKPMGKMVAVALPNTEMTLSVPTVVFDGVEVAGSLVGTRLDLAEAFQFGAEGKVKPIVATRKLEEINDIIDEMKAGKIEGRMVIDFTK

SEQ ID NO: 18485 - protein, 1131 aa, Sorghum bicolor
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAENAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHLREAGMSTFILTAELAAAPSAVGQ

SEQ ID NO: 18486 - protein, 1131 aa, Sorghum bicolor
MSSSRPAHSSSSSSRTRQSSRARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHLREAGMSTFILTAELAAAPSAVGQ

SEQ ID NO: 18487 - protein, 211 aa, Staphylococcus aureus
PSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEAEQAF

SEQ ID NO: 18488 - protein, 1131 aa, Sorghum bicolor
MSSSRPAHSSSSSSRTRQSSRARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGNIRHLREAGMSTFILTAELAAAPSAVGQ

SEQ ID NO: 18489 - protein, 466 aa, Vibrio angustum S14
MALHEVTRKTGNDPIYGSDTIHNVAATTKLPQQEQAPNVIYQMIRDELYLDGNARQNLATFCQTWEEDEVHKLMDLSIDKNMIDKDEYPQSAEIEGRCVHILADLWNSPESVTTVGTSTTGSSEACMLGGLAALWRWREKRRALGQPTDKPNMVCGPVQVCWEKFARYWDIEMRETKMADGHYCMTPEDMLELVDANTIMVVPTFGQTFTGLYERVKPLSDALDTYEHDTGNSIDIHVDGASGAMLAPFCAPEIDPWDFRLERVKSISTSGHKFGLAPLGCGWVVWRSKEDLPEGLVFHVNYLGGDMPTFALNFSRPAGQIIAQYYNFLRLGYEGYKRIHDASYDVCEYLVKELNKFNLFEFLFDGNREKGIPAISWRLKNDADVSFSLYDLADRLRTRGWLVPAYSLPANAQVLVVQRILVKQGLTIDLANLLIADFKRSIDFLNTHAQAKCTAEDVKTFDHSGR

SEQ ID NO: 18490 - protein, 1131 aa, Sorghum bicolor
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGNIRHLREAGMSTFILTAELAAAPSAVGQ

SEQ ID NO: 18491 - protein, 314 aa, Vibrio angustum S14
MSCCKKDVAAIMQQAFDLHKGNKDGANASYIPFLASVPSDLCGLAFVSVTGEVIKIQDVDYKYAIESISKIMTLGLALEQSGADAIHSKVGAEPTGLPFNSVMALELHNGKPLTPLVNAGAMATVSLIEADDKEQRWQKILAFQSALAGANIELSEDVNQSEQTTNAHNRAIALLLESSNRIYSDPLEACDVYTRQCSTLFNTVELATVGATYANGGKNPISGQQLVSPENASHILAEMMMEGLYDTSGDWAYDVGLPGKSGVGGGLVTIIPNVGALAAFSPRIDQFGNSVRGQLMIKHVAQTMGWNLFNSKQH

SEQ ID NO: 18492 - protein, 132 aa, Brassica napus
LCLRALTSQFDSLSSSISMGEQVDKRFTWVLKNFSDLQDEPSFSRPFVFAGCNWHIIAYPKGYEKCRHLSLYLGIVNPESLPSGWRRVLKFRLTLVNKVWRSETKVLEGQRWFDASSSVWGFKEFIPLSTVR

SEQ ID NO: 18493 - protein, 205 aa, Griffithsia japonica
MTIVQVQTPFTEMPTLKRVHKWVYSFGEGKADGDKSMRELLGGKGAGLAEMSGLGLPVPPGFTISTSVCTVFSNNAGQYPVGLLSQVKQALSVVEKQMGASFGGKDHPLLVSVRSGSRASMPGMMDTVLNLGLNDQTVKGLATHSGNPRFAYDCYRRFIQMYSNVVLGVDIDHFEEILESHKRKNGVKLDTELTYDNLKEVIIDY

SEQ ID NO: 18494 - protein, 511 aa, Oryza sativa (japonica cultivar-group)
MDLAAWFGPVNSGLVLLILTMLLRNLQNFQLMQTFVARQLNRRARRLAALIDPYLSITIHEYDAGRMTRSDVFAETKAYLDGAVGTRDDVRHLNAEDARGGGGGGGAGEGGGGGAGSSSSKGLVLSMADGEEVEDHFRGATLWWSAHCEQDDDKGRRGGGGRASQRRSYRLVFHECHRDLVRSAYLPHVRDQGRAFMAMSRQRKLYTNIPSSRWGDDGSYMCSLWTEVVFKHPKTFETLAMDPEKKREIIDDLDMFKNGKEQHRRVGKAWKRGYLLHGPPGTGKSTMVAAMANYLGYDVYDMELTSVHTNTDLRKLLIQTTSKSIIVIEDVDCSSNLTGRRKATGDGEDDDDDAKTTTKKVIDRGGGGGGVGGDSKVTLSGLLNFIDGLWSAFGEERLIVLTTNHVEDLDPALIRTGRMDKKIEMSYCDFETFKSMAKIHLDVDDHEMFAAVERLLPEVDLVPADVGEHLTAKNPRDDAGACLARLVNALQEAKAKKDAAERQDEDNGVVV

SEQ ID NO: 18495 - protein, 518 aa, Debaryomyces hansenii CBS767
MIDNDIFQSKIQRSGQIIRKYASFIGPGIMVSVAYMDPGNYSTAVSSGAMYEYKLLFIIFMSNLFAVVLQCLCVKLGTVTGLDLAEMCRMNLPYALNLSLYACAELAIIATDLAEVVGTAIALEILFNIPLVYGVLITVIDVLIVLMAYHKDGTMRQTRLFEIMVTVLVLATCMCFILELFKCDFEEGAVGSIIKGFLPMNMEIFREKNALFLSCGIVGSTVMPHSLFLGSALVQSRLKEYDIQNGILIEQDEVDGELIDVQPELPATTSKFRSISDGSSLAGKYRPSYRAIQYCLNYSYIELVLSLFLIAVFVNSAILIVAGSTLYGKPDAEDADLLSIYEMLSYYISPAAGLIFALSMLFAGQSAGIVCTMAGQIVSEGFINWTIKPWIRRIITRILAIIPVLVVIIILGREGISKIMNSSQVVLSFILPVVSAPLIWFTCKKEFMVVYDTSDLNQLANENTALLNTDESYPQSVHVRKITFENGHFLTIAAGLTWLIISFLNLYLIYAFANGADI

SEQ ID NO: 18496 - protein, 379 aa, Arabidopsis thaliana
MIGGRSCVGNLVFLRRDLATCRAVPAKSKENSLVNGIGQDQTVMLNLRQESRKPISLETLFEVVADDLQRLNDNLLSIVGAENPVLISAAEQIFSAGGKRMRPGLVFLVSRATAELAGLKELTVEHRRLGEIIEMIHTASLIHDDVLDESDMRRGRETVHELFGTRVAVLAGDFMFAQASWYLANLENLEVIKLISQVIKDFASGEIKQASSLFDCDVKLDDYMLKSYYKTASLVAASTKGAAIFSKVESKVAEQMYQFGKNLGLSFQVVDDILDFTQSTEQLGKPAANDLAKGNITAPVIFALENEPRLREIIESEFCEPGSLEEAIEIVRNRGGIKKAQELAKEKAELALKNLNCLPRSGFRSALEDMVMFNLERID

SEQ ID NO: 18497 - protein, 590 aa, Burkholderia pseudomallei K96243
MSFTLHGIPVSRGIAIGRAYLIAPAALDVAHYLIEAERIEAEIERFRTALGAVRRELDVLRADLTDDTPTEVAAFIDVHAMILGDAMLVQETIDLIRTRRYNVEWALTEQLDVLAGHFDDIEDEYLRERKADIEQVVERVLKALAGAPSAAQALDRAAGNGRDEMIVVAHDIAPADMMQFKTQSFQAFVTDLGGRTSHTAIVARSLGIPAAVGVQHASALIRQDDLIIVDGDQGIVIVDPAPIVLEEYSYRQSEKALEQRKLQRLKFSPAQTLCGTKIDLLANIELPDDAKAAVDAGAVGVGLFRTEFLFMSKVRMPEEEEQFAAYKRAVELMHGMPVTIRTIDVGADKPLDVHDEGYETAPNPALGLRAIRWSLSEPQMFLTQLRAILRASAFGQVKILVPMLAHAQEIDQTLDLINEAKRQLDAAGLAYDPNVRVGAMIEIPAAAIALPLFLKRVDFLSIGTNDLIQYTLAIDRADNAVAHLYDPLHPAVLHLIAFTLREAKRAGVPVSVCGEMAGDPALTRLLLGMGLTEFSMHPSQLLVVKQEILRAHLKALEKPTADVLASFEPEEVQAALARLASAEPRADVAA

SEQ ID NO: 18498 - protein, 486 aa, Bordetella pertussis Tohama I
MEDLRNHEFKNYIGGQWVACAAGKTYPNVNPADTDDIVGRFQASQAEDAAAAVAAAQAAFDGWRNLAVSKRAALMQRAADYLEAHAEQFGRELTREEGKALNLAKDEVLRSAQTIRFYAAEGQSFSGETFVNDDPDMVVYSQREPLGVVTVISPWNFPVSIPARKIAPALITGNTVVFKPSSDAPLSGLRLVEAFEQAGLPPGVLNLVTGSASAIGAAITQASQVRAVSFTGSTAAGEQIHRSVDMTTRTQMELGGKNPLIVMADADLDRAVDLVVKGGFSLSGQACTGTSRVLVDAPVKAAFTEKLLAKVKALKVGNSLEGSFDLGPLATARQLESVMRYIEVGKQEARLLCGGERLEGPGYERGYYLTPAVFADVTQQMRIAREEIFGPVIALIEVNGYEDAIAKANDTEYGLAAAIATTNAQYAHRFARDIQAGTVKINRTTTGNLINAPFGGLKRSSTSTFRESGRIGLEFYTQIKTVYRAG

SEQ ID NO: 18499 - protein, 267 aa, Glycine max
QRKDYIKIKVIVSKSQNKILFVEADGDFVDFLVSFLTMPLGSIMYLVNGKLSLGSIDKLYTSVKNLDPSWLIASSTKSLLNPKVARHFGCGSNPLNASEEDTGKYWYGTGIVKDNRGRIICEKNMISKKKDMLKDPKDIKLLDPRSSDGARKSDVGFMKRPCLFVVSDNLEVKAMTTSSSIPCPFMENDRLLDDLEEHLVKIRKSQALNILMASLTSNKAAFTRSLSHLLWNWKCHRCIPCRGLLGRMKISHRKKKKKKKIESEEEI

SEQ ID NO: 18500 - protein, 200 aa, Thermosynechococcus elongatus BP-1
METVLRVGVAGPVGSGKTALVDALCKALRDRYRLAVVTNDIYTQEDAQFLVRSQALPPERILGVETGGCPHTAIREDASLNLAAIQQLETAFRPLDLIFVESGGDNLAATFSPELVDLTIYVIDVAAGDKIPRKGGPGITKSDLLVINKIDLAPYVGADLEVMKRDTLKMRGDRPYVMTNLKTGLGLDQVIAFLTVHLAA

SEQ ID NO: 18501 - protein, 733 aa, Nocardioides sp. JS614
MQVWPGRAYPLGATFDGSGTNFALFSEVADRVELCLFDAEGSEGYRETRVELTEVDAYVWHCYLPAVQPGQRYGYRVHGPWDPENGQRCNPNKLLLDPYAKATSGEIDWDQSLFSYNFGDPEDSDARNDEDSAPHMTHGVVINPFFDWEGDRRLDYDYNESIIYEAHVKGLTQLHPDIPEELRGTYAALGHPAITEHLTKLGVTAIELMPVHQFIQDSTLLDKGLRNYWGYNTLGFFAPHADYAATGQPGQQVQEFKSMVKAMHAAGIEVILDVVYNHTAEGNHLGPTLSFKGIDNAAYYRLVEDDQRYYMDYTGTGNSLNVRHPHSLQLLMDSLRYWVTEMHVDGFRFDLASTLAREFYDVDRLSTFFELVQQDPVVSQVKLIAEPWDIGPGGYQVGGFPPQWTEWNGKYRDTVRDFWRGEPSLGEFASRLAGSADLYEHSGRRPVASINFVTAHDGFTLRDLVSYDEKHNEANGEDNNDGESHNRSWNHGVEGPTDDPEILEFRAREQRNFIATLLLSQGVPMLLHGDEMGRTQQGNNNTYAQDSELSWVHWDEADKPLVEFTAALSRLRRAHPTFRRKRFFTGGTVRVPDGGDGDRLNDIVWLHLDGRPMEDNDWTQSDSGAGAQALGMYLNGHGIAGRDERGGPIVDNHFLLYFNADGPAEVTLPPDEYADAWDVVVDTGGLVDDQTALAAGSTCSMASRSLIVLREHREPEAEVDHSVAASVAQARRG

SEQ ID NO: 18502 - protein, 97 aa, Glycine max
AFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 18503 - protein, 270 aa, Oryza sativa (japonica cultivar-group)
MAMEPLPLGFGDGLDATLLSSLWAFQDDLQPQESMEELKQSLMATTLELDAAKEELKKKEQSIAKLADLVRHVAKERDDARDQLQRLLAAAAAKPPPLVTSSVTDSDGGSLVSSPAADNPFFDPVTSSDKRCCAIASPPPAAKQQHAAAAGADAVLDMLAMKKPLPQRGRLLQSVMEAGPLLQNLLVAGLLPRWRNPPPVALDTLPVGVRAGGAVYPGASLSPGITSSAAVIGYGGGANACGKRPMAAAAAAVAASCSPAAFSAKRHRLH

SEQ ID NO: 18504 - protein, 339 aa, Arabidopsis thaliana
MQSEFLELRQRIKESIRTKMQSGDTIIAPTSQTQLHQSKSNLPYDFGSFFGPSQTVIASRVLQESKPLLENETSAAKMLNSIQNKKSSVLMNDASGTKNANEVKRKAEKLKDGRDYSFLFSDDAQLPVSIKEPPTSRPSSTESQMQPRPGSSNNVQAHTREDSAINSQKRKSMNKKGQPSSKLGHQRPLSSTKPLRHDSKQQRVEQRNVSLELTRSQLPPAKHQLISKPPLKRVKKKPVKMSEDDLALQMVRKMCKTDRFAGRDEDYDDRCMEANFDDIMREEKRSERLAKKEDAEQLRLVEEEERVRRQKKQKLSHLKNCGLGLKNLRVSNFKVTFLL

SEQ ID NO: 18505 - protein, 1131 aa, Sorghum arundinaceum
MSSSRPAHSSSSSSRTRQSSRARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGNIRHIREAGMSTFILTAELAAAPSAVGQ

SEQ ID NO: 18506 - protein, 1131 aa, Sorghum arundinaceum
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGNIRHIREAGMSTFILTAELAAAPSAVGQ

SEQ ID NO: 18507 - protein, 211 aa, Staphylococcus aureus
PSADMLFEPSFVNDIDVNENDIVHFCSVDLVDSPMRDAHYQLITKTLNANGTVVFDPNVRLPLWDNAEDLRQTIHTVLPLAHIVKVSDEELEFITGIHDENEAIQSLFTGNVTVVIYTMGADGAAVYLKNGINHYHSGYKVKPVDTTGAGDAFIGAVISRILATDVLNLTQLFENEGEEILEFSNRVAAIVTTKYGAINSLPTLQEVEQAF

SEQ ID NO: 18508 - protein, 1131 aa, Sorghum arundinaceum
MSSSRPAHSSSSSSRTRQSSRARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGDIRHLREAGMSTFILTAELAAAPSAVGQ

SEQ ID NO: 18509 - protein, 382 aa, Zea mays
  misc_feature (310)..(310): Xaa can be any naturally occurring amino acid
  unsure (1)..(382): unsure at all Xaa locations
MALSIYTPTSSSLVPPSIQEVRLTSRPPKPATFSLRRPHLAARAAAGNAPTSPVREVVTELDAVAGFSEIVPDTVVFDDFERFAPTAATVSSSLLLGITGLPDTKFKSAIDTALADGECNALEKAEDRMSCYLTKALANVGAELAHQVPGRVSTEIDARLAYDTQGIIHRVHELLNLYNQHDVSTDRLLFKIPATWQGIEASRLLESEGIQTHLTFVYSFAQAAAAAQAGASVVQMFVGRLRDWARHHSGDPEIDEALKNGEDAGLSLAKKVYAYIHRNGYKTKLMAAAIRNKQDVFSLLGIDYIIAPIXDVKYGYVPKLTPAIGKTYNFTEEELVKWDQLSLSAAMGPAAEELLASGLEGYVNQARRVEELFGKIWPPPNV

SEQ ID NO: 18510 - protein, 162 aa, Pseudomonas syringae pv. tomato str. DC3000
MGVSSCGKSAVGAEIARNSGGRLIEGDAFHPQANIDKMSAGTPLTDEDRAGWLTRLGEELAAALAKGEHPVLTCSALKLIYRERLRAAVPGLGFVFLELSKELATERCANRTGHFMPASLVDSQFATLEPPIGEPLTLVVDASKPIDVIGEQAAAWWKGSHA

SEQ ID NO: 18511 - protein, 211 aa, Staphylococcus aureus
PSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVITKYGAINSLPTLQEVEQAF

SEQ ID NO: 18512 - protein, 346 aa, Rhodopirellula baltica SH 1
MKALLLTEYKNMQVTDVDEPEVGPDDVLVQVEACGICGSDIHGYDGSTGRRIPPLVMGHEAAGVVVQVGENVRDLELGARVTFDSMVSCGNCEFCREGHGNLCDNRMVLGVSCGDYRRHGAFAERISVPRRIVYRLPDTLPFEHAALVEAVSVAVHAAEVTPIKLGDTAVVVGAGMIGLLAVQAVRAAGATQVIAVDLNDKRLETAGTLGADVLLRADQVDVPEKVRELTGGRGADVALEVVGATPTVKTAIESVRKGGAVTLVGNVSPTIELPLQSVVTREIRLQGTCGCNGEYPQCIDLMNRGVINVEPLITAKISLADGPKWFDRLHAGDAEQMKVLVCPRSE

SEQ ID NO: 18513 - protein, 800 aa, Arabidopsis thaliana
MDEDVEQASLMSFNDRPRAFPNMRSKTYSPLIFRIIRKLNVRVLSIILLFCFGAIFYMGASTSPIIVFVFTVCIISFLLSIYLTKWVLAKDEGPPEMVEISDAIRDGAEGFFRTQYSTISKMAILLAFVILCIYLFRSLTPQQEAAGLGRAMSAYITVAAFLLGALCSGIAGYVGMWVSVRANVRVSSAARRSAREALQIAVRAGGFSALVVVGMAVIGIAILYSTFYVWLGVGSPGSMNVTDLPLLLVGYGFGASFVALFAQLGGGIYTKGADVGADLVGKVEQGIPEDDPRNPAVIADLVGDNVGDCAARGADLFESIAAEIISAMILGGTMAKKCKIEDPSGFILFPLVVHSFDLIISSIGILSIKGTRDASVKSPVEDPMAVLQKGYSLTIILAVITFGASTRWLLYTEQAPSAWFNFALCGLVGIITAYIFVWISKYYTDYKHEPVRTLALASSTGHGTNIIAGVSLGLESTALPVLTISVAIISAYWLGNTSGLVDENGIPTGGLFGTAVATMGMLSTAAYVLTMDMFGPIADNAGGIVEMSQQPESVREITDLLDAVGNTTKATTKGFAIGSAALASFLLFSAYMDEVSAFANVSFKEVDIAIPEVFVGGLLGAMLIFLFSAWACAAVGRTAQEVVNEVRRQFIERPGIMEYKEKPDYSRCVAIVASAALREMIKPGALAIASPIVVGLVFRILGYYTGQPLLGAKVVASMLMFATVCGILMALFLNTAGGAWDNAKKYIETGALGGKGSEAHKAAVTGDTVGDPFKDTAGPSIHVLIKMLATITLVMAPVFL

SEQ ID NO: 18514 - protein, 207 aa, Legionella pneumophila str. Lens
MSDLDINSLDWQKMNGLLPAIIQNAENGKVLMLGYMNQEALIATLTTGQLTLYSRSRKRLWRKGESSGNSMALQHISADCDNDSLLIQVIPKGPACHLGYSTCYQPHNNYTLGFLDGLIELINERAEEKNPNSYTAQLLDSGVNRCAQKLGEEAVETVIAAVSNNKEELINETSDLIYHLLVLLKACELSFYDVLLCLQARDRSVHT

SEQ ID NO: 18515 - protein, 249 aa, Burkholderia pseudomallei K96243
MYKLVLIRHGESTWNKENRFTGWVDVDLTEQGNREARQAGQLLKEAGYTFDIAYTSVLKRAIRTLWHVQDQMDLMYVPVVHSWRLNERHYGALSGLNKAETAAKYGDEQVLVWRRSYDTPPPALEPGDERAPYADPRYAKVPREQLPLTECLKDTVARVLPLWNESIAPAVKAGKQVLIAAHGNSLRALIKYLDGISDADIVGLNIPNGVPLVYELDESLTPIRHYYLGDQEAIAKAQAAVAQQGKSAA

SEQ ID NO: 18516 - protein, 107 aa, Triticum aestivum
MAKLMCLCFIILTIVVAVSADECEGDRQAMIKECAKYQQWPANPKLDPSDACCAVWQKANIPCLCAGVTKEKEKIYCMEKVAYVANFCKKPFPHGYKCGSYTFPPLA

SEQ ID NO: 18517 - protein, 300 aa, Xanthomonas campestris pv. campestris str. 8004
MSSAKNQYAMQNPLTQFPQPTFPEQTQEAPGTIHELQPKADHGEQSYQGFGRLQGRKALITGADSGIGRATAIAYAREGADIVLNYLPEEERDAAEVVQLIQAEGRKAIAVPGDLKDEAFCNQLVERAVKELGGLDLLINIAGKQTAIKDIADITTEQFDATFKTNVYAMFWLCKAAIPHLPPGASIINTGSIQSYQPSPTLLDYASTKAAIVNFTKGLAQQVAEKGIRVNAVAPGPVWTPLQPSGGQPPEKIPEFGSETPMKRAGQPVEMAPLYVLLASQESSYVTGEVFGATGGLLLS

SEQ ID NO: 18518 - protein, 447 aa, Bordetella pertussis Tohama I
MKLQSLDDFLRRVAARDPQQAEFMQAVQEVMLSLWPFIEKHPHYAEHALLERLVEPERVIQFRVCWTDDQGQAQVNRAFRIQHSSAIGPFKGGMRFHPTVNLSVLKFLAFEQTLKNALTTLPMGGGKGGSDFDPKGKSDAEVMRFCQALMLELHRHLGPDTDVPAGDIGVGAREVGFMAGMMKKLSNSAASVFTGKGLCFGGSLIRPEATGYGTVYFAQEMLQRAGLSFDGMRVSVSGSGNVAQYAIEKAMALGAKVVTISDSCGTVIDEAGFTHEKLLALMHIKNDLRGRLDTYASQFGLRYEAGVRPWHVPVDVALPCATQNELDENDARTLIRNGVKCVAEGANMPATLDAAKAFIAAEVLYAPGKASNAGGVAVSGLEMSQNSARLPWTREQVNARLHAIMRDIHENCVRHGHGAGNYVNYVDGANIAGFVKVADAMRQQGLY

SEQ ID NO: 18519 - protein, 200 aa, Oryza sativa (japonica cultivar-group)
MAEGAELVGESAHQDMPRVVAALAGILERVAGRNDAAATPAELAAAPASPSRATAKPGISVRAPACYVVAYIYLDRLLRRGRRCLALALAVDSYSVHRLLITAVLSAVKFMDDICYNNAYFAKVGGISLAEMNYLEVDFLFGVGFDLNVTPETFADYCAVLQSEMLCAAPPTRLHYCCLSEDDAGSSSSSSLREAAMEAS

SEQ ID NO: 18520 - protein, 263 aa, Triticum aestivum
  misc_feature (252)..(252): Xaa can be any naturally occurring amino acid
  unsure (1)..(263): unsure at all Xaa locations
MPPPQKKTKVEDEVPRATVASAVVSLTNWMRERAAEAPPNLLADERDDVVVLQLSLRRVPPKPTTKPHLLPLPHPVVAHSAASVCVISDDRAGSGSPAAAPILDAARSLELPVSEAIPFYALRTDYRPYESCRRLAASYDLFLADRALLPILPCLLGKSLYSTKKAPLAVDFTRAGWPEQVHNVLSSTCVYLRSGTCSGIKVGRLDMEEEEIVENVMAAVEAAVEKVPEKWANVRALHLKAVDSVALPIYHXVPELGMKIEVC

SEQ ID NO: 18521 - protein, 202 aa, Spiroplasma citri
MQALIFQGKKKIEWAETNERIIKKATDIIVKIEGFTFSHADYRPYLGYDNSVVPNTIMGHEGVEIVTAIGDDVTKLKIGDRVAIGCVTHCNICQWCEQKAFANCTNGGFILGTKINGTHAEYVRVPYGENSVIKIPKKMNLTDALMLRDVLPTGYENVIKKINLKQINNVAIIGDEPIGLGILLLLNKYNKKLIFMVIIVKN

SEQ ID NO: 18522 - protein, 1131 aa, Sorghum arundinaceum
MSSSRPAHSSSSSSRTRQSSRARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGDIRHIREAGMSTFILTAELAAAPSAVGQ

SEQ ID NO: 18523 - protein, 373 aa, Oryza sativa (japonica cultivar-group)
MADEWWSASQRSHGTSACSAAPSPLTADRVSCGWTSPAAAAAAESTSSITFQDPSRSSAAHHQPLSDAASSLGDPHMVDWTQAFLSGRSDASFQAVLQDDMAASTRPFRAQPTAADEAVMTNPFRDMGVGQGLLLDQASAPLHGLSFDAGEPAVAPATHSITTSFGDYQHSASYDAAAAVMQFSQTPRAPSLPAAAQMQFLSGSYQLPFGGAPPLPSQLLLQAMQPKPSCSSNANTLLAKSNSGSAQQICSSEGRKSVSDSPAAAKRPRIEVPSPLPTFKVRKEKLGDRITALQQLVSPFGKTDTASVLHEAIEYIKFLHEQVAGSESTKDAEQPKPDLRSRGLCLVPVASTYTVASETVPEFWHPTFGGTFR

SEQ ID NO: 18524 - protein, 1130 aa, Frankia sp. CcI3
MPKHEDLSSVLVLGSGPIVIGQACEFDYSGTQACRVLRAEGLRVILVNSNPATIMTDPEIADATYVEPITSDIVAKIIERERPDAILATMGGQTALNTAVALHDAGVLDRFEVRLIGANIDAIRAGEDRQAFKDIVAAVGGETARSAICHTVAECLTAGEEFSYPVVVRPSFTLGGAGSGFAHDSGELRRMAADGLAASPSTEVLVEESVLGWKEYELELMRDRADNVVVVCSIENVDPMGVHTGDSITVAPAMTLTDREYQRMRDMAIAVMRAVGVDAGGCNIQFAVDPATGRQVVIEMNPRVSRSSALASKATGFPIAKISAKLALGYTLDEIPNDITRTTPAAFEPALDYVVVKVPRFAFEKFPGADPTLTTTMKSVGEAMGVGRSFAEALQKALRSMEAPGSVFSFVPPEADAADLLEAARVPHDGRLRTVQQALLAGADPDEVTRVTGIDPWFVDQLVFLNETAAMISRNPAGIRRAKRAGFSDVQLAEILGTSEDVVRAFRHRTGIRPVFKTVDTCAAEFASETPYHYSAYDAETEVAPSKRPRVIVLGSGPNRIGQGIEFDYACCHAVMALSDAGYETVMVNCNPETVSTDYDTADRLYVEPLTVEDVLEVVHAEQQAGPLAGVIVQLGGQTPLGIAAALAEAGVPVVGTPPKAIHLAEDRGLFGRVLARAGLPSPPHGVATSFAEARTVAERIGYPVLVRPSYVLGGRGMEIVYDDTMLRDYIDRATAISPEHPVLVDRFLDDAVEIDVDALYDGETLYLAGVMEHIEEAGVHSGDSACALPPITLGRSELDRIRTSTEAIAKGVGVRGLLNVQYALQSDVLYVLEANPRASRTVPFVSKATTVPLAKAAARVMLGATIDELRAEGLLPRSGDGGTLPLDSHISVKEAVLPFGRFRDAGGRGVDTVLGPEMKSTGEVMGIDDGFGTAYAKSQAAAYASLPTYGRVFVSVANRDKRAMVFPIKRLADLGFVVYATEGTADVLRRNGVKAVVLGKHWAPTEGLLDCVEMITSGQIDLVINTPWGVGPRLDGYEIRTACVSAGVPCITTIQGAAACVQGVEALVRGELGVRSLQEYHAALRQAWGGGQPGGSPPESSGSAASESAASESAAPESAVFGPAARRSG

SEQ ID NO: 18525 - protein, 1131 aa, Sorghum propinquum
MSSSRPAHSSSSSSRTRQSSRARILAQTTLDAELNAEYEESGDSFDYSKLVEAQRSTPSEQQGRSGKVIAYLQHIQRGKLIQPFGCLLAFDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDARYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGREEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAEKAQFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGDIRHLREAGMSTFILTAELAAAPSAVGQ

SEQ ID NO: 18526 - protein, 352 aa, Legionella pneumophila str. Lens
MKKILFIDRDGTLVEEPFDFQVDSLDKIKLTSGVIPALLQLQKAGFTFIMVSNQNGIGTVAFPEEDFAVCHEFILDLFSSQGILFDEIFICPHTPEDNCICRKPKTGLLESYLKETAFAKQYSWVIGDRDTDKEFADNLGVNFLPISKTHTWEMVASAIINDARKASVQRKTKETAVDLSVQLDSDQTSVIDTPIPFFTHMLEQVAKHGGFDLRLQASGDLEVDEHHLIEDTAIALGEAIRTALGDKWGINRYGYTLPMDESLATIAIDISGRSFCDFKGQFTREFIGGMATEMIPHFFQSLSSALGATIHIEVTGINHHHMIEACFKVLGRALRQACSRTNNYLPSTKGVL

SEQ ID NO: 18527 - protein, 971 aa, Arabidopsis thaliana
MASVSLLDVAIAIICLFFFYYMYFKKPHGQVFRNWPVIGMLPGFLMVLHRIYNFGVEALEMSHLTFLFKGPWFAEMDMLFTVDPANIHYILSSNFSNYTKGADFKEVFDVFGEMIFSSDSELWKNQRKAAQFMLNHQGFQKLSLSATRSKLYDGLVPLFNQCCEEEKVVDLQQVFQRFTFDTTFFIVTGFDPKSLSIEMPEVEYAKALDDLGEGIFYRHIKPKFFWKLQNRFGLGQEKRMTEADATFDRVSAKYILAKREEIRSQGIDHHANGESEDLLTSHIKLDTTKYELLNPSDDKFLRDTILAFNLAGRDTTSSALSWFFWLLSENPQVVTKIRKEIIDKNISKDGRNGQENLDKLVYLHAALYESMRLYPPVAFQRKSPIKPDVLPSGHKVEANSVIIIFLFALGRMRAVWGEDATEFKPERWVSESGGLRHAPSFKFLSFNAGPRTCPGKQLAMTLMKTVVVEILQNYDIDVIKGQKIEPEPGLMLHMKHGLRVTITKRCLLVVLHRIYDYIVEILEISDLTFSFKGPWFAGMDTLLTVDPANIHHMMNSNFSNYIKGSDFKEVFDVFGDGIITTDSELWKNLRKSYQEMLHHQAFQSFSLSTTRSKLKDGLVPLLNHFAEEGTTVDLQDVLGRFTFDTILILITGSDPRSLSIEMHEDELAKALDVVGEGIFFRHVKPKFLWKLQNWMGFGHEKKMIEANATFDRVCAKYISDKRGEIIRSQRFSDISYGEPEDLLSSFMKLDTTKYNLLNPSDDKFLRDTILAFILAGRDTTASALTWFFWLLSENAQVVSKIRQEIINTNPSKNGNGQENLDKLVYLHGALCEAMRLYPPVSFGRKSPIKSDVLPSGHKVQANSKIIICLYALGRMRAVWGDDALEFKPERWVSDKGSLRHEPSFKFLSFNSGPRTCLGKHLAMTQMKMVAVEILHNYEIKVIKGQKIKPVLGFILSMKHGLRITITKRCPY

SEQ ID NO: 18528 - protein, 546 aa, Glycine max
MGNCCSQGNVADGPADDSAAANDKGEANQQGSNNHANDNNDNSTNPTTAPTTTSKPPPTVTPPTSKPSKPAAMGPVLGRPMEDVRATYTIGKELGRGQFGVTHLCTNKATGQQFACKTIAKRKLVNKEDIEDVRREVQIMHHLSGQPNIVELKGAYEDKQSVHLVMELCAGGELFDRIIAKGHYTERAAASLLRTIMQIIHTFHSMGVIHRDLKPENFLMLNKDENSPVKATDFGLSVFFKEGETFKDIVGSAYYIAPEVLKRKYGPEVDIWSVGVMLYILLSGVPPFWAESEHGIFNAILRGHIDFTSDPWPSISNAAKDLVRKMLTTDPKQRLTSQEVLNHPWIKEDGEAPDKPLDNAVLNRLKQFRAMNQFKKVALRVIAGCLSEEEIMGLKEMFKGMDTDNSGTITIEELKQGLAKQGTKLTEQEVKQLMEAADADGNGTIDYDEFITATMQMNRMNREEHLYTAFQYFDKDNSGFITTEELEQALREYNMHDGRDIKEILQEVDGDNDGRINYDEFAAMMRKGNPEVMTKKRRDSLPLPLP

SEQ ID NO: 18529 - protein, 143 aa, Ehrlichia ruminantium str. Gardel
MLERTLSILKPDVVKRNIAGQVNSYIENSGLKIIIQKMCLLTRYQAEKFYEIHKSQVFFVPLINFMISGPVVVQVLEGENAISLYREVMGATDPKKANSGTIRGDFAENIDANCVHGSDSLENAIREIRFFFSEYELLSLYEC

SEQ ID NO: 18530 - protein, 402 aa, Ustilago maydis 521
MSNAPLNGVKLNPLDDPNKVIKVLASDGKTGEQREIAYTNCKVIGNGSFGVVFQAKLVSQGSEPAEGSSKESDEVAIKKVLQDKRFKNRELQIMRIVKHPNVVDLKAFFYSNGDKKDEVFLNLVLEYVPETVYRASRHYAKLKQTMPMLLIKLYMYQLLRSLAYIHSIGICHRDIKPQNLLLDPPSGVLKLIDFGSAKILIAGEPNVSYICSRYYRAPELIFGATNYTTNIDIWSTGCVMAELMQGQPLFPGESGIDQLVEIIKVLGTPSREQIKTMNPNYMEHKFPQIRPHPFSKVFRPRTPPDAIDLISRLLEYTPSARLTAIEALCHPFFDELRTGEARMPNGRELPPLFNWTKEELSVRPDLISRLVPQHAEAELLSRGIDVHNFQPIPLESLKVTLD

SEQ ID NO: 18531 - protein, 756 aa, Magnetospirillum magnetotacticum MS-1
MQSAGMTSVSRRLLGRLRDVMAGSGSAQDRLDKVVKLIAADMVAEVCSCYVMRAGEVLELFSTEGLKKESVHQTRLRVGEGLVGDIAAHARPLALADAQIHPNFVFRPETGEEIFHSLMGVPIIRGSRVVGVLVVQNRTMRHYTDEEIETLETVAMVLAELLVSGELVNRAELVPVDGNALLPLRMEGVKLNGGVGVGVAVLHRPRITIQRLVAEDPDAELERLKKALTGIKLALEELFSRPEMRDGEHRDVLETYRMFAEDKGWLNRISEAIRTGLTAEAAVQKVHDDTRARMNQITDPYLRERMHDFEDLANRLLQHLAGGDDQRPGAADLPEGAILIGRNLGPMELFDYDPKRLRGLVLEEGSATSHVAIVARALDIPVVGRVKDVLDKIEPLDPVICDGDNGQVFIRPPDDIRETYIDAISQRQMRLAVYARLREMPAVTRQGVRIGIHMNAGLLLDLQHLHDSGADGIGLYRTELPFMARSSLPDVAAQTLLYKKILDQAEGKPVVFRTLDVGGDKVLPYWNPYEEDNPALGWRSIRITLDRPAVMRSQLRALLRAAQGRELSVMFPMIAEVSEFVQARHILDKELEHERQIGNPLPSKLKVGTMLEVPALALQLDALLPMVDFVSIGSNDLTQFLFAVDRGNPRIAERYDSLAPAMIRFMRYVSVKCAQYKVSLSVCGEMAGRPLEAMALIGAGIRHLSLSAPNIGPVKTMVRSLDIAALEAYLNSLLKSPDHSLRNKLKTFALDHGVVL

SEQ ID NO: 18532 - protein, 173 aa, Oryza sativa (japonica cultivar-group)
MAAEGEKKMITLKSSDGEEFEVEEAVAMESQTIRHMIEDDCADNGIPLPNVNSKILSKVIEYCNKHVHAAAAAASKAADDAASAAAAVPPPSGEDLKNWDADFVKVDQATLFDLILAANYLNIKGLLDLTCQTVADMIKGKTPEEIRKTFNIKNDFTPEEEEEIRRENQWAFE

SEQ ID NO: 18533 - protein, 302 aa, Xanthomonas oryzae pv. oryzae KACC10331
MSIATFWHGVLPAITTPFTANGEIDHDFLGTHANQLVDAGCTAIVPLGSLGEAATLSVEDKLAILRTLVTALNGRVPVVPGIASLATGEAVALAKAAKDIGCGGLMVLPPYVYSTDWREMGAHVRAVIAATDLPVILYNNPVAYKTDFGPAQIAELAAEFPNLQAVKESSGDVRRFAALQELLGDRLALLVGMDDAIVEGLSMGAKGWIAGLVNAYPKESVRLFELARDGGYPAAKELYHWFLPLLRLDTVPTFVQLIKLVQAKVGMGSEQVRAPRLVVAGAERDAALKVIDHAIATAPKLS

SEQ ID NO: 18534 - protein, 140 aa, Brassica rapa subsp. pekinensis
MSRLSICLLVLLCAFAAKTAAQSANVRATYHFYNPAQNGWDLYRVSAYCSTWDGNQPLEWRQRYGWTAFCGPAGPRGRDSCGRCLRVTNTGTQAQATVRIVDQCSNGGLDLDEAVFKQIDTDGQGYARGNLNVNYEFVNC

SEQ ID NO: 18535 - protein, 1178 aa, Sorghum bicolor
MASGSRATPTRSPSSARPEAPRHAHHHHHHHSQSSGGSTSRAGGGGGGGGGGGGTAATATATATESVSKAVAQYTLDARLHAVFEQSGASGRSFDYSQSLRAPPTPSSEQQIAAYLSRIQRGGHIQPFGCTLAVADDSSFRLLAFSENAADLLDLSPHHSVPSLDSAAPPPVSLGADARLLFSPSSAVLLERAFAAREISLLNPLWIHSRVSSKPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGINELSSVAREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEKQMSKIVKDATLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFACPGEGLPADIVQDMFSNSQWSTQEGVGLSTCRKILKLMGGEVQYIRESERSFFLIVLELPQPRPAADREIS

SEQ ID NO: 18536 - protein, 447 aa, Salmonella enterica subsp. enterica serovar Paratyphi A str.
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSACVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYAREFGLTYLEGQQPWSVPVDIALPCATQNELDVDAARILIANGVKAVAEGANMPTTIEATDLFLEAGVLFAPGKAANAGGVATSGLEMAQNAARLSWKAEKVDARLHHIMLDIHHACVEYGGDNKHTNYVQGANIAGFVKVADAMLAQGVI

SEQ ID NO: 18537 - protein, 1178 aa, Sorghum bicolor
MASGSRATPTRSPSSARPEAPRHAHHHHHHHSQSSGGSTSRAGGGGGGGGGGGGTAATATATATESVSKAVAQYTLDARLHAVFEQSGASGRSFDYSQSLRAPPTPSSEQQIAAYLSRIQRGGHIQPFGCTLAVADDSSFRLLAFSENAADLLDLSPHHSVPSLDSAAPPPVSLGADARLLFSPSSAVLLERAFAAREISLLNPLWIHSRVSSKPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGINELSSVAREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEKQMSKIVKDTTLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFACPGEGLPADIVQDMFSNSQWSTQEGVGLSTCRKILKLMGGEVQYIRESERSFFLIVLELPQPRPAADREIS

SEQ ID NO: 18538 - protein, 346 aa, Frankia sp. CcI3
MPEIVPAGTTPARRRPPECRRRPMEPPATVAATAPPSGPTRAAVLGAPVDHSLSPLLHAAAYAKLGLAVTYTAVHCDETGLAAMLTRVRTDPGWVGLSLTMPLKTVALDLLDEVDATAAVIGAVNTVVVGPAGRLRGYNTDVDGIGMALRRVMRGAVPGQPLVLGAGGTARAAVAAVAAAGCTRLGVVARRPAAVAEVAEIGSRLGVEVTALPWELLAAGLPAGPDLVISTTPAGATDGLATGPWPPACQLVELLYHPWPTALAAAAYRAGARVAGGLEILAAQAVGQVEHFTGQVVPTSVLLAAGQAALDERTRGNRPPAVEVGVPGGHGLAGSGPRGRGGPAGG

SEQ ID NO: 18539 - protein, 438 aa, Medicago truncatula
MSPTPSAGVHVPLLTGSNPAAVPGSIPGAVFNVATSIIGSGIMSIPAILKVLGVLPSFALILIVAVLAEVSVDFLMRFTHAGVTTTYSGVMKEAFGSVGALSAQVCVIITNFGGLVLFLIIIGDVLSGKESGGEVHLGLLQQWFGIHWWNSREVALFITLVLVMLPLVLYKRVESLKYSSGISTLLAVAFVTICSGLAIVALVQGKTQTPKLVPRLDYQTSFFDLFTAVPVVVTAFTFHFNVHPIGFELASPSHMKTAVRLAIMFCAVVYFTIGLFGYLLFGDSTQSDILINFDQNADSAVGSLFNSLIRVSYALHIMLVFPLINFSLRANIDELLFPKKPLLATDNKRFVIITLVLLVFSYLAAIAIPDIWYFFQFLGSTTALSLAFVFPGTIVLRDALGISTRQDKIIALVMIILAVVTSVIAISTNIYNALSSKS

SEQ ID NO: 18540 - protein, 334 aa, Oryza sativa (japonica cultivar-group)
MECSISRTNLNCISLGDPDTKKSVALLKQACLDSGFFYVVDHGISQELMDDVFAQSKKFFDLPINEKMELLRDEKNRGYTPMLDEILDPENQVNGDYKEGYYIGIEIPEDDPQANRPFYGPNQWPSDEVLPRWRKVMEQYHSEALRVAKSIARIIALALNLEEDFFDKPEMLGEPIATLRLLHYEGGQKTGKVSNPAEGVFGAGAHSDYGLITLLATDDVVGLQICKDRNAQPQVWEYVAPVKGGFIVNLGDMLERWSNCIFRSTLHRVVLDGRERHSIAFFVEPSHDCVVECLPTCKSESNPPKFPPITCSAYLSQRYKDTHADLTAYSSNKA

SEQ ID NO: 18541 - protein, 309 aa, Leptospira interrogans serovar Copenhageni str. Fiocruz L1-130
MKFFSLCKGSFAFITRFAMSWINSYNLKDDTFAGSGGSKIFYRTYQPKEGRKGNRVIVVQHGIGEHSGRYEFLVEALSGTGTAFYLIDSQGHGRSEGKRGAIDSFSDFLFDLDQLISIAKEKEKVPKVTLLGHSMGAAISTFYAEEGTNQGNLNALMISALPIRVKTDLVMKVKKGIAPLMSDLLPNLTLPTGLNIHFLSHDKSVVEAYRKDPLVHGMASAYLGNMLLNSEEPILANAGKIKIPIYIFHGKEDQIADYTGSETFFEVVGSADKSMKIYEGLYHETMNERIEDRTKVLTDLKKWFESHSN

SEQ ID NO: 18542 - protein, 393 aa, Nocardioides sp. JS614
MTDRFQVASRANVPPFHVMDLLAASAERQRTHGDVLNLLAGQPMTGAPAPVREEAKRLLDSGDPLGYTPAAGIRELREAIAGHHRRAHGIEVDPDHVVVTTGSSGGFLLAFLAAFEVGDRVAMARPGYPCYRNVLTALGCEVVEIPTGPETRFQPTVEQLDGLADIRGLVVASPANPTGTMLLPSELAALAAYCEERGIQLISDEIYHGIEYAPLSGAEPLARSAWETSREAVVFSSFSKYFSMTGWRIGWMLAPDRLRRAVDVLTGNFTICPPVIAQRACLAAFDDASYAELDGHVARYAENRRILLDGLPKLGITELAPADGAFYVYADVGHLTDDTMRFARDLLARTGVAVAPGVDFDTVVGPRFVRLSFAGPGADIELALERLSTVLDR

SEQ ID NO: 18543 - protein, 421 aa, Mesorhizobium loti
MADLKRTQPLARDAMAYVLAGGRGSRLKELTDRRAKPAVYFGGKTRIIDFALSNALNSGIRRLGVATQYKAHSLIRHLQRGWNFLRPERNESFDILPASQRVSETQWYEGTADAVYQNIDIIEAYGPEYMVILAGDHIYKMDYELMLRQHVDAGADVTVGCLEVPRMEATGFGVMHVDAKDNIIAFVEKPADPPGIPGNPEFALASMGIYVFKTKFLMEQLRRDAADPGSSRDFGKDIIPYIVQHGKAIAHRFTKSCVRSTMENEAYWRDVGTVDAYWEANIDLTDVTPELDLYDRDWPIWTYAELKPPAKFVHDEDGRRGSAVSSLVSGDCIVSGASLKKSLIFTGARINSYSALEEVVMLPDVHVGRNAKLKRVVIDHGVRIPEGLVVGEDPVLDAKRFRVSEKGICLVTQDMINKLGL

SEQ ID NO: 18544 - protein, 289 aa, Xanthomonas campestris pv. campestris str. ATCC 33913
MTGPRVRTVTAAALRAQPLPAPGGDKEQRGRVLIVGGSARVPGAVMLAGEAALRAGAGKLQLATAASVAPGMALAMPEALVLGLGENGQGEIVRGHRALDAAMSACDAAVIGPGMASTNTTAALVKRAIDQAVCTLVLDAGALSPRLRAPLGRPFVLTPHAGEMAALAGDDKAAVEAAPADYALAFAKKMRSVVIVKGADSFVAGPDGALWVHRGGVPGLGTSGSGDTLAGLIAGFAARGCDALTAALWGVFVHATAGKQLAKRIGTVGFLAREIPPEVPGILDRLPRG

SEQ ID NO: 18545 - protein, 341 aa, Triticum aestivum
  misc_feature (40)..(40): Xaa can be any naturally occurring amino acid
  misc_feature (94)..(94): Xaa can be any naturally occurring amino acid
  unsure (1)..(341): unsure at all Xaa locations
MDHAAEAQRTDLMTITRHALNEQGRHPESRGDFTILLSHXLGCKFVASAVNKAGLAKLIGLAGETNVQGEEQKKLDVLSNEVFVKALVSSGRTXCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRVLYEVFPMSFLMEQAGGQSFTGKQRALEIVPAEIHQRSPIFLGSYDDVEEIKSLYASESSTA

SEQ ID NO: 18546 - protein, 404 aa, Arabidopsis thaliana
MEPIPNDLILEIFSRLPAKSVIGFRTLSKHWASILRSPVFTELFLTRSSNRPRLLFAAERNGEWLFFSSPQPQNRYEKSSHLDYHTKFSGDVSRFICSYVSGLLCFPDLWLSKDASPVICNPTTGMYESLPDLMRYKNARGFLGFDPIGKQFKVLSEAYPFSDQREHHEILTLGTEELSWRSNIISCPAYDRSLSEGICINGVLYYLAQTLGVPSCVIICFDVRSEEFKYFDAGCFNDQLDDTSGLILVNYEGKLSGINWKYGQAGERRTVELRMWVLEDAEKHEWVKYVYTLPENEVLDSCDFSVAGVTTRGDIVLCMKYTCKPFYVFYFNPERNTLQSVEIQDFGANLEAVENCGRVYAFVNHVEDLRVNKGKQLKSSISQVKHLCSCCNKVSQPDYHYQKA

SEQ ID NO: 18547 - protein, 541 aa, Mesorhizobium loti
MIRTVPTKPYADQKPGTSGLRKKVPVFQQEHYAENFIQSIFDALDGFKGKTLVIGGDGRFYNREVIQKAIAMAAANGFGKVMVGQGGILSTPAASHVIRKYKTFGGIILSASHNPGGPHEDFGIKYNAGNGGPAPEKLTDAIAKTKAISSFKTSDIDPIDMDTIGTVKAGGMTVEIIDPVADYAELMESLFDFDALRRLFKSGFRMRFDAMHAVTGPYAKEILENRLGAPNGTCRNFKPLPENGGHHPDPNLVHAKHLYDEMMGPDAPDFGAASDGDGDRNLIIGKGIFVTPSDSVAMLAANAKLAPGYKDGLKGIARSMPTSGAADRVAEKLGIGIYETPTGWKFFGNLLDAGMATICGEESAGTGSNHVREKDGLWAVLLWLNILAARGESCKQVVTEHWATYGRNYYSRHDYEEVESDRANALVDELRAKLGSLPGTSVNGLKIAKADDFAYHDPVDGSTSEHQGIRIRVRSGSRVVFRLSGTGTSGATLRVYIERYEPDKARHDLDTQAALADLIAAADDIAGIKSHTGRNKPSVIT

SEQ ID NO: 18548 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDLRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVRYKLKDDANVNWTLYDLADRLQMRGWQVPAYPLPKSLENIIIQRYVCRADLGFNMAEEFIQDFQASIQELNNAHILFHDTQQSGVHGFTH

SEQ ID NO: 18549 - protein, 449 aa, Oryza sativa
MELSLITFTATGAAAAFTSPKIKRRMRMAPTMASKPGAKVKVSAGCKTCRGKGAVECPGCKGTGRNKKNGNIFERWKCFDCQGFGLKSCPSCGKEGLTPEQRGETRCILPCKSAQKEYTRKCLNFVGKASPPPESTVLHVDHLSRNVNEDHLKEIFENYGEVVNVELSMDRVVNLPRGYGYVEFKNRADAEKALLYLDGGQIDGNVVKVRFALPPQQQRAAASPKALHPSPKRDVVDHNKVGPSAEKATKQQPRKPSPQRKPAPSPRRRSPPSRRVESPRCRPDSPPIRRRTAPSPIRHGGTPSRRPGSPIRRRSPSPPPRRLRSPRHLSPRRDRGSPIRRRSPLPRRRLTPPRRMWSPPRRPQSLRHRSRSPIHRPIRSPSRSISPRRGRGPPVRRGRSSSSYSDSPTPPRRGPRRVLRSRSPRRPLRGRSASSYSRSSSSSGSPIRN

SEQ ID NO: 18550 - protein, 300 aa, Xanthomonas campestris pv. campestris str. ATCC 33913
MSSAKNQYAMQNPLTQFPQPTFPEQTQEAPGTIHELQPKADHGEQSYQGFGRLQGRKALITGADSGIGRATAIAYAREGADIVLNYLPEEEQDAAEVVQLIQAEGRKAIAVPGDLKDEAFCNQLVERAVKELGGLDLLINIAGKQTAIKDIADITTEQFDATFKTNVYAMFWLCKAAIPHLPPGASIINTGSIQSYQPSPTLLDYASTKAAIVNFTKGLAQQVAEKGIRVNAVAPGPVWTPLQPSGGQPPETIPEFGSETPMKRAGQPVEMAPLYVLLASQESSYVTGEVFGATGGLLLS

SEQ ID NO: 18551 - protein, 369 aa, Bradyrhizobium japonicum USDA 110
MKTRAAVAFEAKKPLEIVEVDLEGPKAGEVLVEIKATGICHTDAYTLDGFDSEGIFPSILGHEGAGIIREIGPGVTSVKPGDHVIPLYTPECRQCKSCLSQKTNLCTAIRATQGKGVMPDGTSRFSYKGKPIYHYMGCSTFSNFTVLPEIAVAKIREDAPFDKSCYIGCGVTTGVGAVVNTAKVEPGANVVVFGLGGIGLNVIQGAKMAGADKIIGVDVNDSKEDWGRRFGMTHFVNPKKITGDIVPHLVNLTDGGADYTFDCTGNTTVMRQALEACHRGWGTSIIIGVAEAGKEIATRPFQLVTGRNWRGTAFGGARGRTDVPKIVDWYMNGKIQIDPMITHVLKLEEINKGFDLMHEGKSIRSVVVY

SEQ ID NO: 18552 - protein, 151 aa, Oryza sativa
MALEQTFIMIKPDGVQRGLIGEVIGRFEKKGFYLKAMKLINVEKSFAEKHYADLSSKPFFGGLVEYIVSGPVVAMVWEGKQVVSTGRKLVGATNPLAAEPGTIRGDFAVDIGRNVIHGSDSVENARKEIALWFPEGIAEWRSKQDPWIYEG

SEQ ID NO: 18553 - protein, 1178 aa, Sorghum bicolor
MASGSRATPTRSPSSARPEAPRHAHHHHHHHSQSSGGSTSRAGGGGGGGGGGGGTAATATATATESVSKAVAQYTLDARLHAVFEQSGASGRSFDYSQSLRAPPTPSSEQQIAAYLSRIQRGGHIQPFGCTLAVADDSSFRLLAFSENAADLLDLSPHHSVPSLDSAAPPPVSLGADARLLFSPSSAVLLERAFAAREISLLNPLWIHSRVSSKPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQAQLGELELRGINELSSVPREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEKQMSKIVKDATLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFACPGEGLPADIVQDMFSNSQWSTQEGVGLSTCRKILKLMGGEVQYIRESERSFFLIVLELPQPRPAADREIS

SEQ ID NO: 18554 - protein, 443 aa, Shewanella sp. MR-7
MSQQNPGLKQSLSLWQVVVMGLAYLTPMAVFDTFGIVSEITSGHVATSYLLALAGILFTAFSYGHLVRKYPYAGSAYTYAQKTFSPNVGFMVGWSSLLDYMFMPMINMLLAKIYLTAMFPNVEPWIFIFGLVAVMTVLNLRGIDLVANFNGVIVFVQIAIILVFIGLMAHSLSLGEGEGVIASVRPFYSEEISLAPLFTGATILCFSFLGFDGLSSLSEETKDAKRVIPRAIVLTALIGGVIFVSVSYFLQLFFPDISRFQQLDAVLPEIALYVGGNLFQSVVLVATTIAVLASGMAAHAGVARILYVMGRDNMLPNKGFGYIHPKWRTPAFNVILVGLLALSAVSFDLEMALALVNFGALVAFTFVNLSVIVQFYIKEKRNQSLKDHFQYFALPLCGAATIGVLWLNLEPQSLELGLIWAAVGVLYLALRSLRLRKAVELQN

SEQ ID NO: 18555 - protein, 293 aa, Thermococcus litoralis
MPMFEGVFVPHITPFDDEEEINEEMLRDLVHYFADAGLNGLVTLGSNGEFPYLSFEEKLRVLKIVRDESPVPVIAGVAENSTKETIRLAKEAWDIGVDALLIAPPYYFKPDKRELFAHYSRIAYEVEAPILLYNVPKFTTINIDLDVFEKLVEEHSNIVGIKDSSGSIGRIAELVRRVGDKINILAGTADVMYPSWMLGAHGAVVAVANVAPRLCVELYNAFLEKRYERARKLQLMINYLNEVVVKKYNQISAIKEAMRMLGFEVGYPRMLALPLDEKALEDIERALIEIGLL

SEQ ID NO: 18556 - protein, 218 aa, Pseudomonas syringae pv. tomato str. DC3000
MALSALLFDLDGTLIDTDELHLNAYNQLLARWDRSTDIEYYKAHVMGFPDDMIFGGLFPDIPASQYAGLAAEKETMFRAQLGETIPVAGVLRILDHAQKAGLRTAVVTNAPRENAVAMLTGLGIVDRFEAIVIGGELQRGKPHPIPYLTALELLGVKADQAIAFEDSLAGVQSAHAAGIHTFGVLSGLQEHQLRQAGARDVIRDFNADALWQFLQTAD

SEQ ID NO: 18557 - protein, 523 aa, Arabidopsis thaliana
  misc_feature (80)..(80): Xaa can be any naturally occurring amino acid
  unsure (1)..(523): unsure at all Xaa locations
MPAGGFVVGDGQKAYPGKLTPFVLFTCVVAAMGGLIFGYDIGISGGVTSMPSFLKRFFPSVYRKQQEDASTNQYCQYDSXPTLTMFTSSLYLAALISSLVASTVTRKFGRRLSMLFGGILFCAGALINGFAKHVWMLIVGRILLGFGIGFANQAVPLYLSEMAPYKYRGALNIGFQLSITIGILVAEVLNYFFAKIKGGWGWRLSLGGAVVPALIITIGSLVLPDTPNSMIERGQHEEAKTKLRRIRGVDDVSQEFDDLVAASKESQSIEHPWRNLLRRKYRPHLTMAVMIPFFQQLTGINVIMFYAPVLFNTIGFTTDASLMSAVVTGSVNVAATLVSIYGVDRWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVVVMSIFVYIFLPETKGIPIEEMGQVWRSHWYWSRFVEDGEYGNALEMGKNSNQAGTKHV

SEQ ID NO: 18558 - protein, 430 aa, Methanopyrus kandleri AV19
MGYEDEFPESLELFKRAERVMPGGVSSPVRRFDPYPFYVERAEGSRLYTVDGHVLIDYCLAFGPLILGHAHPEVVEAVVERVREGFHYGTPTLPELKLAEKVVELVPNVEKVRLVNTGTEATMSAIRLARAYTGREKIVKFEGCYHGAHDAVLVRAGSGASELGAPDSPGIPESVAENTLVCPFNDVEAFVETVERFDEEIGAVIVEPVLGNAGCVPPDEEFLKVLREYCDGTERLLIFDEVITGFRLELGGAQEYYGIDADLVCLGKILGGGLPIGAFGGPEEYMSRVAPEGKVYQAGTFNGNPVSATAGLVTLEVLERERPYDELSSKAERLASALEDGLEDRGIEGVVNRVESMFQVYFGIEEVRDYADVNSADHDAFKRFHRELLEHGVWIAASNYEAWFLSIAHTETDLERTEEAFEEALDRLTG

SEQ ID NO: 18559 - protein, 773 aa, Mycobacterium bovis AF2122/97
MIGNGGAGGSGAPGAIGGAGGPAGLIGVGGAGGAGGDSAVAGVIGGAGGAGGAALLFGAGGAGGAGGSGGSGAAGGAGGAGGAGGLFASGGSGGFGGFASTGTGGAGGTGGAGGLFASGGVGGTGGGAGSGGTGGVGGTGGAGGLFASGGAGGAGGSGGTGGAGGTGGAGGLFGAGGAGGLGGQGNHTGGHGGAGGSAGLLALGDGGAGGAGGAATTGTGGAGGAGGKAGLLFGSGGAGGSGGAAGTFGDTGNSGGAGGAGGKAGLLFGSGGAGGSGGAGGFANGSTGGAGGAGGGAGLIGNGGNGGSGGTSVATGGAGNGGAGGAGGGAGLIGNGGNGGSGGMGDAPGGTGVGGIGGLLLGLDGANAPASTNPLHTAQQQALAAVNAPIQAVTGRPLIGNGANGAPGSGAPGGHGGWLFGGGGTGGSGVSGGAGGDGGAGGILFGAGGAGGAGGAVTGTGATGGSGGAGGGALLFGAGGAGGAGGSSGIGGFAAGGAGGPGGAGGLFNGGGAGGAGGSGVSGGAGGEGGAGGAGGLFAGGGIGGAGGFGGFRGGEGGAGGAGGLFAGGGAGGAGGSGNNVGGAGGAGGVGGLFGAGGAGGSGGGGSVAGDGGAGGNAGLLAPGLAGGAGGGGGQGFDTGGAGGPGGDAGLLVGSGGVGGAGGFGLTTGGPGAAGGDAGLLFGSGGAGGAGGSGRTDLGGAGGAGGKAGLIGNGGNGGAGGAGGAGGPGGAAFGLGNGGNGGNGGTGTSAGSPGAGGAGGSLIGAEGLPGLLP

SEQ ID NO: 18560 - protein, 562 aa, Pseudomonas aeruginosa UCBPP-PA14
MIENFWKDKYPAGIAAEINPDQYPNILSVLKESCQRFATKPAFTNLGKTLTYGELYKLSGDFAAYLQQHTDLKPGDRIAVQLPNVLQYPIVVFGAMRAGLIVVNTNPLYTARELEHQFNDSGAKAVVCLANMAHLVEGVLPKTGVKQVIVTEVGDILPPLKRFIVNFVVKHIKKMVPAYSLPQATNLTDALARGAGKSFQEAAPQADDVAVLQYTGGTTGVAKGAMLTHRNLVANMLQCKALMGANLNEGCEILIAPLPLYHIYAFTFHCMAMMLTGNHNILITNPRDLPSMLKDLGQWKFTGFVGLNTLFVALCNNETFRKLDFSALKLTLSGGMALQLATAERWKEVTGCAICEGYGMTETAPVVSVNPFQNIQVGTIGIPVPSTLCKVIGDDGQEVPLGERGELCVKGPQVMKGYWQRQEATDEILDADGWLKTGDIAIIQEDGYMRIVDRKKDMILVSGFNVYPNELEDVLATLPGVLQCAAIGIPDEKSGESIKVFVVVKPGATLTKEQVMQHMHDNLTGYKRPKAVEFRDSLPTTNVGKILRRELRDEELKKAGQK

SEQ ID NO: 18561 - protein, 327 aa, Xanthomonas campestris pv. campestris str. ATCC 33913
MHRTHPAHVVISGASSGIGQATAEAFAERGARLVLAARGEEALQQVAERCRARGAEVLVVPTDVKQADQVQALATSARSFLGRIDLWFGNVGVGAVGTFHEVPIEASTAVVQANLIGRMHDAHAAIPIFVEQGHGVFVNMISLGGFAATPYAAAYSASKFGQRGFSEALRAELIDHPKVHVCDVYPYFVDTPGLSHGANYVGRRVTGPPMMLDTRTVAQAVVRLLDRPRNTVVIGPAVQAMRVGHALAPNLFARAMSRFFQRYFAQAPRVGRSSGNVFGPPAIAGGIDGGFRRRPAVRARAGRNTLAIGAAVAALATVAVLAAKRAR

SEQ ID NO: 18562 - protein, 175 aa, Triticum aestivum
MGNASSMLTQYDIEEVQEHCSYLFSQQEIVSLYERFCQLDRSAKGFVSEDEFLSIPEFSTNPLSQRLLRMVDGLNFKEFVSFLSTFSARASLQQKIELIFKVYDIDGKGKVSFKDLVEVLRDLTGSSMSEKQREQVLTKVLEEAGYTQDSTLALEDFVTIIDHPGLKMEVEVPID

SEQ ID NO: 18563 - protein, 326 aa, Fusobacterium nucleatum subsp. nucleatum ATCC 25586
MIEILLKEWIERVKYYIHLIADYSIKESQVGAVLDDVLNLSGKMLRSKLLLLCAFLGTNWKNNKEKICKLAAMVELTHLASLIHDDIVDDSPYRRGKVSIQGKYGKDAAVFAGDFLIARIFYYGAVENLNEAVSILSKTVEYMCIGEIEQDLCRYQENISEKKYFENIERKTAALFQAASYIGAKEAGCSEEIIQKLELFVKNLGLMFQLKDDILDFTSNSKELGKETHKDFQNGIYTFPVIMALKNPKAREVLLPIMRKNKEEKLSLAEILQLQNYIIQFGGIEASYEKIKYLSNINRQLIKELGQNSKITVYLEKILNDLEVEN

SEQ ID NO: 18564 - protein, 418 aa, Oryza sativa (japonica cultivar-group)
MADHQEMIHAAAAPAMYGGGAAAGGATTTTGSHGGGGGDWWSAAVSSCSAPAPETMQGFGGWSAAVVAVDGGGNTSRSAAGNTASSESPGSLATGSSITFQEPAGGVADPAAIAVHAQTVAGGGGGGWNQQPFLDGSGFHGYMSSSRNDHHTNHHHHQINTPSLMSNSSSNNGVMLQEHQHDQNYQFLSNLGFELLSSPTSPYGGGGGFRSSLLRSLTEPAAAAKPNDSPGFQQYHHHQPAMNLQPPAAAAGREPLQFTNSTAAPFWNPSSRFTVAAEGTALGGAGASPAQPTPASLAAKVRKEKLGDRVTALQQLVSPFGKTDTASVLHETIEYIKFLHDQVGALSAPYLKNRQQVPHLKNSTGVDNDGGGGGGEATAASKRDLTGRGLCLVPISSTFAVASETPVDFWTPFGAAFR

SEQ ID NO: 18565 - protein, 199 aa, Penicillium marneffei
MASGPATQSLKCVVTGDGAVGKTCLLISYTTNAFPGEYIPTVFDNYSASVMVDGRPISLGLWDTAGQEDYDRLRPLSYPQTDVFLICFSIVSPPSFDNVKAKWFPEIEHHAPGVPIILVGTKLDLREDRATAEALRAKKMEPVSYEQALAVAKEIRAHKYLECSALTQRNLKSVFDEAIRAVLNPRPQPKNKAKRCTIL

SEQ ID NO: 18566 - protein, 338 aa, Arabidopsis thaliana
VADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYDVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYSSRVVDLIVHMSKA

SEQ ID NO: 18567 - protein, 1178 aa, Sorghum arundinaceum
MASGSRATPTRSPSSARPEAPRHAHHHHHNHSQSSGGSTSRAGGGGGGGGGGGGTAATATATATESVSKAVAQYTLDARLHAVFEQSGASGRSFDYSQSLRAPPTPSSEQQIAAYLSRIQRGGHIQPFGCTLAVADDSSFRLLAFSENAADLLDLSPHHSVPSLDSAAPPPVSLGADARLLFSPSSAVLLERAFAAREISLLNPLWIHSRVSSKPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGINELSSVAREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEKQMSKIVKDATLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFACPGEGLPADIVQDMFSNSQWSTQEGVGLSTCRKILKLMGGEVQYIRESERSFFLIVLELPQPRPAADREIS

SEQ ID NO: 18568 - protein, 393 aa, Helianthus annuus
MTVPSTRKDLMIVNMGPHHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFMADIGAQTPFFYIFRERELIYDLFEAATGMRMMHNFFRIGGVAADLPHGWIDKCLDFCDYFLTGIAEYQKLITRNPIFLERVEGVGIIGGEEAINWGLSGPMLRASGIEWDLRKVDHYECYDEFDWEVQWQKEGDSLARYLVRISEMTESIKIIQQALEGIPGGPYENLEIRRFDRVKDTVWNEFDYRFISKKPSPTFELSKQELYARVEAPKGELGIFLIGDKGVFPWRYKIRPPGFINLQILPQLVKRMKLADIMTILGSIDIIMGEVDR

SEQ ID NO: 18569 - protein, 166 aa, Helianthus annuus
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 18570 - protein, 334 aa, Mycobacterium bovis AF2122/97
MTRTSEGLAAFVVDQLEELYRRMWVLRLLDMALEQLRIEGLINGPLQGGFGQEAVSVGAAAALGEGDVIITTHRPHAQHVGTDAPLGPVIADMLGATAGDLEGADEDAHIADPRAGLPAAIRVVKQSPLLAIGHAYALWLRDTGRVTLCVTQDCDVDADAFNEAADLAAVWQLPVVILVENIRGALSVHLGRYTHEPRVYRRAVAYGMPGVSVDGNDVEAVRDCVANAVVRARAGGGPTLVQAITYRTTDFSGSDRGGYRDLAGSEQFLDPLIFARRRLIAAGTTRGRLDEQERAACQQVADAVAFAKDRARPNGGGPISRPTSGWHQQPKTRF

SEQ ID NO: 18571 - protein, 637 aa, Oryza sativa (japonica cultivar-group)
MRSSWADSVANAEESAPATGAAPTPVANHQNSRPTRSAYVPPHLRGQAPTTTAAPAPAPGPAAVQPSASVQPSGYAAIVGGSRWAGPASGDGTGAVGGPRQSVGGRGGGGGGGGGWNSRPGWDRRDREPNPFANSEAEEATEVDFDTANTGINFDAYEDIPVETSGHDVPPPVNTFAEIDLGDALNENIRRCKYVKPTPVQRYAIPISIAGRDLMACAQTGSGKTAAFCFPIISGIMSSRPPQRPRGSRTAYPLALILSPTRELSVQIHEEARKFAYQTGVRVVVAYGGAPIHQQLRELERGVEILVATPGRLMDLLERARVSLQMVKYLALDEADRMLDMGFEPQIRKIVEQMDMPPRGVRQTMLFSATFPKEIQRMASDFLADYIFLAVGRVGSSTDLIAQRVEFVLEADKRSYLMDLLHAQKANGTHGKQALTLVFVETKRGADALENWLYTNGFPATSIHGDRTQQEREYALRSFKSGATPILVATDVAARGLDIPHVAHVINFDLPNDIDDYVHRIGRTGRAGKSGLATAFFNEGNLSLARPLCELMQEANQEVPQWLERYSARSSFGGGGGRNRRSGGARFGGRDFRRDNRGGGGGGYGGGGGGYGGGGYGGGGGYGGGYGGGQGSTSSWD

SEQ ID NO: 18572 - protein, 571 aa, Legionella pneumophila str. Lens
MLDFSLNRDPQTGELYIETSLCGKPLLTTPQLNKGTAFTQEERKDFGLLGKLPHRVETLDEQVKRAYLQYSSYTTRLQQHIYLNNLHDKNQIVFYKLLSRHLGEMLPIIYTPIVGAAAKRFSHEYRQPRGLYIAHSDKNQLEEIINNRSNPDIDLVVVTDGEGVLGIGDQGIGGMDIPVAKLMVYSLCGGIDPTRTLPIFLDVGTNNQELLNDPMYLGCRHPRIKSSEYDDFIKTFVNKIHKQFPNAFLHWEDFGRGNARRILDQFQDELCTFNDDIQGTGAVTLAAILAACDVTGLPLHEHRIVVFGAGSAGTGISDQIVDAMVKNRLSLTDAYDRFWLIDKQGLLLATDQELTDAQKPYARNPIDIQSWEINNKQHPSFTDTIRHVKPTILIGCSAQTGAFSQDIVETMSTACERPIIFPLSNPDEKCEAQPSDILAWSKGRALIATGTAFAPIEYQNRMVQIAQCNNALVFPGIGLGVLAVSASRLTKDMILAAAQTLSKFAPSKKDSFLPLLPSLDNAQIVAKEIAIAVAQCAIDSGYAQKNQDKELPRLIDELFWEPRYLPFRKRG

SEQ ID NO: 18573 - protein, 129 aa, Ehrlichia ruminantium str. Gardel
MEIYMSNLLKEFNEQQIKLLSNREIPKFKSGDTLRVTMKIFDSAGERIQTFEGVCIKKRNNGLHSSFTLRKISYNESIQLQIFLYSPTIESIEVVKFGKVRRAKLYYMLSLFGKSARIKERIDRSKKSS

SEQ ID NO: 18574 - protein, 525 aa, Escherichia coli CFT073
MPPQFLSLTPLPRKNWHSTSMCLDSFMNINGCFLLWRAKGETLMSAIDSQLPSSSGQDRPTDEVDRILSPGKLIILGLQHVLVMYAGAVAVPLMIGDRLGLSKEAIAMLISSDLFCCGIVTLLQCIGIGRFMGIRLPVIMSVTFAAVTPMIAIGMNPDIGLLGIFGATIAAGFITTLLAPLIGRLMPLFPPLVTGVVITSIGLSIIQVGIDWAAGGKGNPQYGNPVYLGISFAVLIFILLITRYAKGFMSNVAVLLGIVFGFLLSWMMNEVNLSGLHDASWFAIVTPMSFGMPIFDPVSILTMTAVLIIVFIESMGMFLALGEIVGRKLSSHDIIRGLRVDGVGTMIGGTFNSFPHTSFSQNVGLVSVTRVHSRWVCIASGIILILFGMVPKMAVLVASIPQFVLGGAGLVMFGMVLATGIRILSRCNYTTNRYNLYIVAISLGVGMTPTLSHDFFSKLPAVLQPLLHSGIMLATLSAVVLNVFFNGYQHHADLVKESVSDKDLKVRTVRMWLLMRKLKKNEHGE

SEQ ID NO: 18575 - protein, 363 aa, Thermococcus kodakarensis KOD1
MKVLVLGAGNVGRAVAWDLRDEFEVYVGDIDGEKLKAVGEFATPLKVNAANFEELVEVMKSFDLVVGTLPGRFGYGSIKAAIKAGVDMVDVSFMPENPLELKEGAEKANVTVIFDAGFAPGLSHILMGRIWNQLDTLEEGRIWVGGLPKDPKPPLYYRITWSPKDLIEEYTRPARVIRNGAVTTVDPLGEIREVNINGMEFEAFVSDGLRSLLESVRAETLEEWTLRWPGHLEKMRVLRELGFFREENLDFTLKVISPLMSFESPDFSIMLVEGEGVENGERKRMSYLLYDEEKDGFTSMSRVTGFTAAIIARIVAEGSCIYGVIPPEILGMRIDTFSRIVGEIRERGITLEEVEGNASPDNS

SEQ ID NO: 18576 - protein, 210 aa, Gerbera hybrid cv. 'Terra Regina'
MGRGKVQLKRIENKINRQVTFSKRRGGLLKKAHEISVLCDAEVALIVFSAKGKLFEYSTDSCMENILDRYEQYSNIDRQHVAVDTDSPIRWTQECNKLKSRAELLQRNLRHYMGEDIESLGLREIQNLEQQLDTALKRIHSKKNQLLHQSISELQKKEKAIQEQNNTLIKNIKEKEKTITQKAQWEPHNYGPNTTPLLFSLPPHSSLNIG

SEQ ID NO: 18577 - protein, 908 aa, Leifsonia xyli subsp. xyli str. CTCB07
MTVNDQDPYSMSNIDSDPEETAEWQESLDALVAAHGHERAREIMLSLLKRSKELHLGVPMVPTTDYINTISPENEPDFPGDEDIERRYRAWIRWNAAILVHRAQRPGIAVGGHISTYASSAALYEVGFNHFFRGQDHPGGGDQIFVQGHASPGTYARAFLEGRLSADQLDGFRQEKSHAGGGLSSYPHPRLMPEFWQFPTVSMGLGPINAIYQAQLNKYLTNRGIKDASDQHVWAFLGDGEVDEVESRGQLQVAANEQLDNLTFVINANLQRLDGPVRGNGKIIQELESYFRGAGWNVIKVIWGREWDDLLARDADGALVNLMNQTPDGDYQTYKTENGAYVRENFFGRDPRTLELVKDFSDDEVWNLKRGGHDYRKVYAAFKAAVEHKGQPTVIIAKTIKGYGLGPSFEGRNATHQMKKMTLDNLKTFRDAMRIPVTDAQLEENPYLPPYYNPGPQDEAIQYLHERRRALGGYLPERRATYTQVSLPDDSAYAIAKKGSGTQEIATTMAFVRLLKDLLRAKDFGHRIVPIIPDEARTFGMDAFFPNAKIYNPNGQHYTSVDRELLLAYKESPQGQIIHVGINEAGALAAFTNVGTSYATQGEPLIPVYVFYSMFGFQRTGDAIWAAGDQMARGFMIGATAGRTTLTGEGLQHADGHSLVLSNTNPAVVSYDPAYGYEIGHIVRSGLERMYGKSHPEPNVMYYLTVYNEPIVQPAEPENVDVDGIVRGIHKLSEGEGGGPKAQLLASGVSVPWALEAQHLLQQDWGVSADVWSVTSWGELRRDGLKAEEHNFLHPQQEKQVPYVTRKLEGAEGPFVAVTDYMHAVPDKIRPFVPGEYATLGADGFGFSDTRAAARRFFKIDGPSLVVRTLELLAAQGKVDPNAPAWAIEKYLLHDVNAGTTGTAGGDA

SEQ ID NO: 18578 - protein, 104 aa, Debaryomyces hansenii CBS767
MVSQHTTDKVQQLIKTKPVFIASKSYCPYCAKTKNTISSITKDAYIIELDEVEDGSEIQEALYELTGQKTVPNVFIGGEHIGGNSDVQELSSGDKLESKIKAVL

SEQ ID NO: 18579 - protein, 826 aa, Bacteroides fragilis NCTC 9343
MKIIIIGGVAGGATTAARIRRSDETAEIILLEKGKYISYANCGLPYYIGDVIEEREKLFVQTPEAFGVRFRVDVRTENEVIFIDRKKKTVTVRLKSEDTYEESYDKLLISTGASPVRPPLPGIDSTGIFTLRNVADTDRIKAYVNNRPPRRAVVIGAGFIGLEMAENLHALGAQVSIVEMGNQVMAPIDFSMAALVHQHLMEKGVNLYLEQAVASFEQAGKEVKVVFKNGQSILADIVILSIGVRPETTLARAAELTIGEAGGIAVNDYLQTSDESIYAIGDAIEFRHPITGKPWLNYLAGPANRQGRIVADNLLGAQIPYEGAIGTSIAKVFDMTVASTGLPGKRLKQAGIVYASSTTHPASHAGYYPDAMPMSIKITFDPQTGKLYGGQIVGYDGVDKRIDELSLVIKHEGTIYDLMKVEQAYAPPFSSAKDPVAIAGYVAENIILGRVKPVYWRDLRDIELKDVFLLDVRTPDEFALGSLPGAVNIPLDEIRDRIAELPSNKPIYTFCAVGLRGYLVYRILIQHGFKEVYNLSGGLKTYRAATAPIILHENEETDDTPSAQDSPAEPSVAAEAPQTTTAANPKTIRVDACGLQCPGPVLKMKKTMDTLVPGERVEIVATDPGFSRDAAAWCNSTGNKFISKDSTGGKSVVVIEKGEPQACNLTTTCDSKGKTLIMFSDDLDKALATFVLANGAAATGQKVTIFFTFWGLNVIKKLHKPKVEKDIFGKMFGTMLPSSSLKLKLSKMSMGGMGGKMMRYIMHRKGIDSLESLRQQALENGVEFIACQMSMDVMGVKREELLDEVTVGGVATYMERADNANINLFI

SEQ ID NO: 18580 - protein, 159 aa, Brassica napus
  misc_feature (31)..(31): Xaa can be any naturally occurring amino acid
  unsure (1)..(159): unsure at all Xaa locations
GSSSASGSKPSSDSTSTHEIEKKLNALKLKXPSSSSPTPKIKNAVKLYRHIGGNTPKAKWITAEKLTSYKFVKTSSLEGEDVNDYDDGEESNEKGESFWFLGVGGSKVKARVSSDMQLKMFADQRRVDFVSNGVWALKFLTDEEYRRFVTRFQDYLFEN

SEQ ID NO: 18581 - protein, 392 aa, Acinetobacter calcoaceticus
MHPIVIIGSGMAGYTLAREFRKLNPEHELVMICADDAVNYAKPTLSNALSGNKAPEQIPLGDAEKMSTQLKLQISSDTWVKAINPETHELKLEKNGQETIQPYSKLVLAVGANPTRLAIAGDGSDDIHVVNSLIDYRAFRENLAKRQDKRVVILGAGLIGCEFANDLQHTGHQVTVIDLSPRPLGRLLPAHIADAFQKIWRKRIHFVLSTTVEKVSKINDGQDYAVTLANGQTLVADIVLSAIGLQPNIDLAKHAGVHTSRGILTNSLLETNLEDIYAIGDCAEVNGTLLPYVMPIMQQARALAKTLSGETTHVHYPAMPVAVKTPAAPLTVLPVPVDVDVNWETEEFEDGMLAKAIDNTDTLRGFVLLGATAGKQRLTLTKLVPDLIPAQL

SEQ ID NO: 18582 - protein, 456 aa, Arabidopsis thaliana
MEEENEVVKTFAELGVREELVKACERLGWKNPSKIQAEALPFALEGKDVIGLAQTGSGKTGAFAIPILQALLEYVYDSEPKKGRRPDPAFFACVLSPTRELAIQIAEQFEALGADISLRCAVLVGGIDRMQQTIALGKRPHVIVATPGRLWDHMSDTKGFSLKSLKYLVLDEADRLLNEDFEKSLNQILEEIPLERETFLFSATMTKKVRKLQRACLRNPVKIEAASKYSTVDTLKQQYRFVAAKYKDCYLVYILSEMPESTSMIFTRTCDGTRFLALVLRSLGFRAIPISGQMTQSKRLGALNKFKAGECNILVCTDVASRGLDIPSVDVVINYDIPTNSKDYIHRVGRTARAGRSGVGISLVNQYELEWYIQIEKLIGKKLPEYPAEEDEVLSLLERVAEAKKLSAMNMKESGGRKRRGEDDEESERFLGGNKDRGNKERGGNKDKKSSKKFKR

SEQ ID NO: 18583 - protein, 328 aa, Streptomyces carzinostaticus
MTMPADTMTLAKALNRSLRKALEDDPGVLVMGEDVGRLGGVFRVTDGLQKDFGEDRVMDSPLAESGILGTAIGLALGGYRPVVEIQFDGFVFPAYDQIVTQLAKLHARSHGTIRMPVVVRIPYGGGIGAVEHHSESPEALFAHVAGLKVVSPSNPSDAYWMLQQAIRSDDPVIFFEPKRRYWDTGEVDEAAAPAPLHRARVVRPGTDLTLVAYGPMVRLCLEAAEAAAEEGRSLEVVDLRSVSPVDFDTVQDSVSKTHRLVVVHEAPVFFGAGAEIAARITTRCFYSLEAPVLRVGGHHAPYPAARLEEHYLPDLDRVLAAVDHALAY

SEQ ID NO: 18584 - protein, 1177 aa, Sorghum x drummondii
MASGSRATPTRSPSSARPEAPRHAHHHHHHSQSSGGSTSRAGGGGGGGGGGGGTAATATATATESVSKAVAQYTLDARLHAVFEQSGASGRSFDYSQSLRAPPTPSSEQQIAAYLSRIQRGGHIQPFGCTLAVADDSSFRLLAFSENAADLLDLSPHHSVPSLDSAAPPPVSLGADARLLFSPSSAVLLERAFAAREISLLNPLWIHSRVSSKPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGINELSSVAREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEKQMSKIVKDATLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFACPGEGLPADIVQDMFSNSQWSTQEGVGLSTCRKILKLMGGEVQYIRESERSFFLIVLELPQPRPAADREIS

SEQ ID NO: 18585 - protein, 442 aa, Streptomyces carzinostaticus
MTDTAGRLLEFRMPDVGEGLTEAELLTWYVRPGDTVVDGQTVCEIETAKAVVELPIPFDGVVRELRCAEGETVPVGTVVITVAQARAPDPSPAPPAREPVLVGYGVASGPTSRRRRTAVPPPIRPAEPGSGPVLAKPPVRKLAKDLGVDLTRVVPSGPQGVILRADVHAAAHTAGTVVAPAPAPAAPSVPQESAPGPDGEPMETRGTGQPRETRVPVRGVRRATAAAVTASAFSAPHVTEFVTVDVTRTMKLVRDLRREPRFADRRVGPLLLVAKALLVAVERNPEINASWDDGAQEIVRKHYVDLGIAAATPRGLIVPAVKDAHTLSLAELAGALDDLVDAARAGRTSPAALSGGTVTLTNIGVFGVDSGTPILNPGEAAILAVGAITPRPWVHKGKVVPRQVVSLSLSFDHRLVDGELGSKVLADVAAVLERPHRLIAWS

SEQ ID NO: 18586 - protein, 338 aa, Glycine max
DVHTRIMKRNYEQVPEWWFVSILLLMIVVSLITCEGFGKQLQLPWWGVLMSLVIALVFTLPIGVIQATTNTQVGLNVITELIIGYIYPGRPLANVAFKTYGYISMSQALGFLQDFKLGHYMKIPPKSMFVVQLVGTIVASGVYFGTAWWLLTSIPHICDDTSLPAGSPWTCPGDEVFYNASIIWGIVGPQRMFTKDGIYPGMNWFFLIGLLAPVPVWMLSRKFPNHKWIELINMPLIIAGSGGIPPARSVNYITWGMVGILFNFYVYNKFKAWWARHNYILSAALDAGVAFMGVILYFALQYYDIFGPTWWGQDADDHCPLAKCPTAPGIISHGCPVL

SEQ ID NO: 18587 - protein, 1177 aa, Sorghum propinquum
MASGSRATPTRSPSSARPEAPRHAHHHHHHSQSSGGSTSRAGGGGGGGGGGGGTAATATATATESVSKAVAQYTLDARLHAVFEQSGASGRSFDYSQSLRAPPTPSSEQQIAAYLSRIQRGGHIQPFGCTLAVADDSSFRLLAFSENAADLLDLSPHHSVPSLDSAAPPHVSLGADARLLFSPSSAVLLERAFAAREISLLNPLWIHSRVSSNPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGINELSSVAREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEKQMSKIVKDATLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFACPGEGLPADIVQDMFSNSQWSTQEGVGLSTCRKILKLMGGEVQYIRESERSFFLIVLELPQPRPAADREIS

SEQ ID NO: 18588 - protein, 138 aa, Cryptococcus neoformans var. neoformans JEC21
MARTKQTARKSTGGKAPRKQLATKAARKQAPSQVSGGVKKPHRYRPGTVALREIRRYQKSTELLIRKLPFQRLVREIAQDFKTDLRFQSSAIGALQEASEAYLVSLFEDTNLAAIHAKRVTIQPKDLQLARRLRGERS

SEQ ID NO: 18589 - protein, 363 aa, Ralstonia solanacearum GMI1000
MHNKDKRMTKIAVLPGDGIGTEIVAEAVKVLKTLGETFEMETAPVGGAGYEAKGHPLPEDTLKLAKEADAILFGAVGDWKYDTLPRELRPEQAILGLRKHLQLFANFRPAICYPELAGASSMKPEIVAGLDILIVRELTGDIYFGQPRGVRAAPDGLFAGAREGFDTMRYSEPEIRRIAHVAFQAAAKRGKKLCSVDKANVLETFQFWKDIVTDVHKEYPEVELSHMYVDNAAMQLVKAPKNFDVVVTGNMFGDILSDEAAMLTGSIGMLPSASLDANNKGLYEPSHGSAPDIAGKGIANPLATILSAAMMLRYTLGKAEQADRIENAVKKVLAQGYRTGDILTPGCKQVGTVEMGDAVVAAL

SEQ ID NO: 18590 - protein, 265 aa, Pyrococcus horikoshii
MVLYFIGLGLYDERDITVKGLEIAKKCDYVFAEFYTSLMAGTTLGRIQKLIGKEIRVLSREDVERNFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLHIVEAEYLVEIAGAPREILRVNV

SEQ ID NO: 18591 - protein, 270 aa, Corynebacterium diphtheriae NCTC 13129
MVNLVDRNTVLCVSLAARPSNHGVRYHNWLYDQLGLNFIYKAIAPADITAAVAGIRGLNIRGAGVSMPYKQDVIPLIDALHPSAQRIHAVNTIVNDDGVLTGYNTDYVAVASLLKSHEIPADMSVAVRGSGGMANAVVAALADHGMTGTVVARNAETGSALAQRYGWEHSTEVPAKTSMLVNVTPLGMCGDHEHVQAFSNAEIDAAQVIFDVVAYPVETPLIKAAESKGKKIINGGEVICLQAAEQFALYTGVTPSAAFVRAAEDYAQQG

SEQ ID NO: 18592 - protein, 776 aa, Oryza sativa
MNYRFHNLLGAPYRGGDAVFAGDSSVLLSAVGNRVASTDLSASSSLTLPFESSSNVTRLAVSPSGDFLLSVDDAGRALYANLGRRAVLHRIAFKSAPSAVRFSPDGNLIAVAVGKLVQIWRSPAFRKEFFPFHLLRTIPGFAAGVTAFDWSPDSSFLLASCKDLTARLLPVKKGLGGKPFLFVGHRAAVVGAFFATDKKTGRVTGAYTITKDGAIFTWNLVEGSDDSPPPSPGTPEQEAVQDGEAELDGDEPELDGGSRKRKSFGESEEPDTTPLHFTRWELQKKDFFMQSPAKLTACDYHRELDMVVVGFSNGVFGLYQMPDFVCLHLLSISREKITTAIFNSLGNWLVFGCAKLGQLLVWEWRSESYILKQQGHYFDVNCIAYSPDSQLLATGADDNKVKVWTVSSGFCFITFSEHTNAVTAVHFMANNHSLLSASLDGTIRAWDLFRYRNFKTFTTALPRQFVSLTADQSGEVICAGTLDSFEIFVWSMKTGRLLDILSGHQGPVHGLMFSPINAILASSSWDKTVRLWDVFESKGAVETFQHSHDVLTLAYRPDGRQIACSTLDGLIHFWDPFDGLLMYTIEGRRDIAGGRLMTDRRSAANTSIGKYFTTLCYSADGTYILAGGNSKYICMYDVGEQVLLRRFQITRNLSLDGVLDFLNSKKMTDAGALDLIDDEDSDVEEGIDQQTRGNLGLGLPGSMANRGRPIARTKCVKFAPTGRSFAAATTDGVLLYSVDDSLFLIQQILTLMLPLRKWKKLLRKTNSKEPFYSASG

SEQ ID NO: 18593 - protein, 376 aa, Prochlorococcus marinus str. MIT 9313
MTLCQVWAASSSGTAESATYFCMIGGHFPCGFPVFVMTLRVAINGFGRIGRNFMRCWLSRGANTGIDVVGINVTSDPKTNAHLLKYDSILGQIKDAEIGYTDDTFVINGKTIKCFSDRNPLNLPWKEWGIDLVIESTGVFNTDVGASKHIEAGAKKVILTAPGKGDGVGTYVVGVNADQYRHGDFNVLSNASCTTNCLAPIVKVLDQTFGINKGLMTTIHSYTGDQRILDNSHRDLRRARAAAMNIVPTSTGAAKAVALVYPQMKGKLTGIAMRVPTPNVSAVDLVFESGRSTTAEEVNAALKSASQGGMKGIIKYGDLPLVSSDYAGTNESTIVDEDLTMTIGDNLVKVVAWYDNEWGYSQRVVDLAEIVAKNWK

SEQ ID NO: 18594 - protein, 357 aa, Methanopyrus kandleri AV19
MAEVRLEPVKEVSPPLLRVVRKGVEERELVINTSKCAACGICEAACPVGAISVAPPSAVVRKGEDPIDVDESKCVLCGICAFVCPYDVIQLLVNGKPMTEAGLPNLPKSVEVDEEECVYCSLCADTCPQEAITVEREVPTPGDLVMGEIEIDEEKCIYCKACEEACPADAITVERPKPSAADPEPEFTIEVDEDKCVYCGVCMRTCPVDAIKVGCMVCYGTTRGEIPAKGEVDGSVDVDPSSCVYCGWCGFVCPVDAIEVIKPYEGTLEVDDEECVGCGLCVEVCPCGALEFEKGGKAGKTKIVAHPETCAYCGACARACPVNAITVVREGVTAMPELPTKAWKKALDRVLGPVEKE

SEQ ID NO: 18595 - protein, 257 aa, Triticum aestivum
MAANFWTSSHSKQLLDPEEVDVVPAQDRERGVTPVEFRLVKIHMSFHIWRLAQQVKVRQRVIATAITYFRCVYTRKSMTEYDPRLVAPACLYLASKVEESTVQARLLVFYIKKMCGSDDKYRFEIKDILEMEMKLLEALDYYLVVYHPYRPLLQLLQDAGITDLTQFAWGLVNDTYKMDLILIYPPYMIALACIYIASVLKDKDTTSWFEELRVDMNIVKNISMEILDFYDTYKIDPQRGLQEDKIIPVMNKLPSKA

SEQ ID NO: 18596 - protein, 249 aa, Triticum aestivum
MRTMGLGLGAPFFLLVLLLLAAGSGAMPQDKRVRRNYVLLDLDTIEIRPNDKEEITSSKIPVSVESGSTVCSTCENLTNKAVSYLSEKQTQDEIMEILHGACSQTFSLEQKCLEMVDSYATLLFAKITEIKPDEFCKQYGLCRDVSFLSVAKSESTCAFCHHLVDEVLSKMKDPDAQFEILQLLIKECNKVKGHVQECKRMVLEYVPLILVNGEKLLEKKDVCTLMQACDASKTRAGGSFFDGELRSDA

SEQ ID NO: 18597 - protein, 305 aa, Prochlorococcus marinus str. NATL1A
MKQLQVLLVAGTHGNEINGIWLFDEWKKSSFLINTHGIKTFQVIGNPEAKKAGKRYIHHDLNRSFKEGSFIKINPLNCERTRASELVNLYGEAGENPCQIALDFHTTTASMGSCIVVYGRRDADLALASLIQNQLGLPVYLHESDQKQTGFLVESWPCGLVVEIGPIGQGLLNSRIISQTKLILETLMEQIHEVKNLNLFFPNKLIIHRHIKSIDFPRDEEGNIDGYVHSLRQSKDWQELKKNDELFCKLNGEIIRFEEDEPYIPVFINEAAYVEKNIAMSFTKRELWNFKKEWKQALIDLIHQK

SEQ ID NO: 18598 - protein, 363 aa, Brassica rapa subsp. chinensis
MVRFKHIKIKYYFTKMSGVRMLASSPMLLFLLSLLMAYNFDTTAGQIGVCFGQMGNNIPKPSEVVAMFKQYSIPRMRMYGPNPDALNALRGSNIEFILDVPNGDLKRLADSQAEANTWVRDNVQKYNDVRFKYISVGNEVKPGEPGAAALIQAMQNIDRALSAAGLSNIKVSTTTFMGAFADTYPPSRGRFKDEYRNFLQPVIGFLVNKRSPLLVNIYTYFGYMNRDVSLQFALLQPNSNNEFTDPNNQLRYLNFFDANLDSVYAALEKSGGGSLDVVVSESGWPTQGGPGASVPNAEAYVNNLRLHVNKNGSPKRPGKAIETYIFAMFDENGKQTSPNDEYEKYWGMFSPTTRQLKYGVKFN

SEQ ID NO: 18599 - protein, 225 aa, Acidovorax sp. JS42
MPDDELLQRLRRFHLDAFPQYREQFQTLVDEGQHPTTLFIGCSDSRLLPYLLTGAGPGELFLVRNVGAFVPPYDGSYGHHGTAAAIEFAVLELHVSRIVVCGHSHCGAIKALYGEVSPEARNLQRWLDLGREAALPVQPGPEALRRTEQRAVVLQLERLMEYPMVRRRVEDGSIALHGWHYVIEEGEVHVFDVATGGFVAASKAKSSGTGPYAPYVEHDGQVLVD

SEQ ID NO: 18600 - protein, 433 aa, Ralstonia solanacearum GMI1000
MTPSDVKATLSFSDGSPSVELPIYTGTVGPDVIDIRKLYGQTGKFTYDPGFMSTASCNSKITYIDGDKGELLYRGYAIDDLAGKCDFLEICYLLLKGELPNAKQKDEFNSTVMNHTMVHEQMQFFLRGFRRDAHPMAVLTGLVGAMSAFYPDAANINDSREREISQIRLIAKLPTLVAMAYKYNIGQPLIYPQNNLSYTGNFMRMMFATPCEDYKVNPVLERALDRIFILHADHEQNASTSTVRLAGSSGTNPIAAIAAGIACLWGPAHGGANEAALNMLEEIGSVDKIDEFIKQVKDKNSGVRLMGFGHRVYKNYDPRAKLMRETCHEVLQELGLENDRLFKLAMALEKIALEDEYFVSRKLYPNVDFYSGIVQRALGIPTSMFTCIFALARSVGWIAQWEEMITDPEYKIGRPRQLFNGAATRAVPELGKR

SEQ ID NO: 18601 - protein, 265 aa, Pyrococcus horikoshii
MVLYFIGLGLYDERDITVKGLEIAKKCDYVFAEFYTSLMAGTTLGRIQKLIGKEIRVLSREDVEQNFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLHIVEAEYLVEIAGAPREILRVNV

SEQ ID NO: 18602 - protein, 623 aa, Oryza sativa (japonica cultivar-group)
MATPSRTSWADVADADPAPAPAPAANGPARPDRSSYVPPHLRNRGASSGGGAAAPPPSSSSSSAPPPRAAPGLLAPRPAAAGMGRMGGGGGGGGFGGPRRWDREPNPFGNDGDAAAGAGDEPEVFDAHQNTGINFDAYEDIPVETSGREVPPPVGTFAEIDLGQALNDNIRRCKYVRPTPVQRYAIPISLAGRDLMACAQTGSGKTAAFCFPIISGIMRGPPAQRPQRGGMRTACPLALILSPTRELSMQIHEEARKFSYQTGVRVVVAYGGAPINQQLRDLERGVDILVATPGRLVDLLERARVSLQSIRYLALDEADRMLDMGFEPQVRRIVEQMDMPPPGARQTMLFSATFPKEIQRMASDFLENYIFLAVGRVGSSTDLIVQRVEFVQEADKRSHLMDLLHAQRDSATPGKPTLTLVFVETKRGADSLEHWLCMNGFPATSIHGDRNQQEREYALRSFKSGHTPILVATDVAARGLDIPHVAHVVNFDLPNDIDDYVHRIGRTGRAGKSGLATAFFNENNSSMARSLAELMQESNQEVPAWLSRYAARPSYGGGGGRNRRSGGGSRFGGRDFRRDSSSGRGGGDYYGGGSSGGAGGYGGSSAYGGGGYGGGAGAPSAWD

SEQ ID NO: 18603 - protein, 265 aa, Pyrococcus horikoshii
MVLYFIGLGLYDERDITVKGLEIAKKCDYVFAEFYTSLMAGTTLGRIQKLIGKEIRVLSREDVEANFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLHIVEAEYLVEIAGAPREILRVNV

SEQ ID NO: 18604 - protein, 265 aa, Pyrococcus horikoshii
MVLYFIGLGLYDERDITVKGLEIAKKCDYVFAEFYTSLMAGTTLGRIQKLIGKEIRVLSREDVELNFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRMYMTANEAMELLLRVEDMKKGGVFTDDTLVVVLARAGSLNPTIRAGYVKDLIREDFGDPPHILIVPGKLHIVEAEYLVEIAGAPREILRVNV

SEQ ID NO: 18605 - protein, 214 aa, Triticum aestivum
  misc_feature (185)..(185): Xaa can be any naturally occurring amino acid
  unsure (1)..(214): unsure at all Xaa locations
MFNNETNGEVVKEETSQRLSPPHSLKSSIDNQSYQMAEKKKCDPISVKTDEIPVDNTAWCEAFAMRKAKGKAKEFSPPDAALLIQITYRAHLIHRSRVLRCLRDLAVAKAKLKELRTLFNSLSYRRRVSSDHEECQRFSEKIIVLLLTVDEIEGIDTMLRNAKRPVMEELNAMLDIMDPQPPRKXRSFSRRKFDLPGALLQFREFNLDHPFDLI

SEQ ID NO: 18606 - protein, 421 aa, Sulfolobus solfataricus
MEEVLSSSLYTQQVKKLYKVGELLGLDNETLETLSQPERIIQVKIQIRGSDGKLKTFMGWRSQHNSALGPYKGGVRYHPNVTQDEVEALSMIMTWKNSLLLLPYGGGKGGVRVDPKKLTREELEQLSRKYIQAIYKYLGSELDIPAPDVNTDSQTMAWFLDEYIKITGKVDFAVFTGKPVELGGIGVRLYSTGLGVATIAKEEAANKFIGGVEEARVIIQGFGNVGYYAGKFLSEMGAKIVGVSDSKGGVINEKGIDVGKAIEIKEKTGSVINYPEGRKVTNEELLISDCDILIPAALENVINKFNAPKVKAKLIVEGANGPLTADADEIMRQRGIAVVPDILANAGGVVGSYVEWANNKMGEIISDEEAKKLIVDRMNNAFNTLYDYHQKKKLEDHDLRTAAMALAVDRVVRAMKARGIL

SEQ ID NO: 18607 - protein, 492 aa, Aspergillus oryzae
MQWQPPSAPRGPSKPELQPILRPDRVIQEDGLAHIKAGTWSPETPRRPWLRTTLITVLLFIMSIISLLAFFSLALGINGLPHARSSSPSYGKPVNPIKDTPIKNVVVLVEENLSFDVFAGGLTYNAKIDGLVNREYCNPSNASDPFSEKVCAKPIAKNVAPDDPDHSITGGNQQVYSTYHPNAKNDMPGMQGFVTEQIVSYGLGSDLSRAAEVINYYTPDHVPVFNAMAENFVLFDRWFAAVPGPTNPNRAYLTSGTSHGHGQNDHDFDISNLPQVSIFEQLSAAGISWINYSNTTGFLPDSLFYQWTAKSGKGTTNVKSIDQFFNDAKAECCSYMSFHPPSPINMGEGFIKSIYEALRSSPQWNETLFILTFDEHGGFADHVSPPENVPAGDNLTYTETAKDGQEATFHFDRLGIRVPTVLMSPWVGKGVVQNSPADQPNEFTHTSILKYVAELWNLDILTPRVDWSPSFRGLITNTFRETPEKLPEPADF

SEQ ID NO: 18608 - protein, 382 aa, Ehrlichia ruminantium str. Gardel
MSKSDYYDLLGLSKNATPEEIKKAYRKMALKYHPDKNPGDKAAEEKFKELSEAYDVLIDKDKRAAYDRYGHSAFSDGSGRGGFDFNSGFSTDFSDIFNDLFGGGFRGGRSSSKRQDGGTVGSDLRLDIEITLEDSFNGTKVPINYVTHVKCSSCSGSGSEGSVKSVQCNTCHGAGNTRTQQGFFTIERTCHVCNGEGEIIKNKCKKCSGSGRVRDEVNLLVTVPKGIESGDKIRLNGKGEAGYRGAQSGDLYVYPNIKKHKFFTRNGADLYCNVPIKMILATLGGHIEMPSIDGTWTKVKVPEGSQNGDKLRLKEKGMPVINSSRRGDMYIQITVETPINLTKQQKELLKKFDEEPNTVECNPQSTGFFQKVKSFWNDIRSS

SEQ ID NO: 18609 - protein, 685 aa, Methanopyrus kandleri AV19
  misc_feature (132)..(132): Xaa can be any naturally occurring amino acid
  unsure (1)..(685): unsure at all Xaa locations
MARMRFVPQVCPFCGCGCGILVGTDGEEIKLLEPWRRHPVNEGRQCVKLWELPEAVQKDRLERPVRMTESGEPRELSWNRALEEVAEVLSTHEPEEVYFVTSAKATNEDNYVAQKLARTLGTNNVDHCARLXHAPTVVALSELLGSGAMTNSIPDLVEADCYLVAGSNTAEQHPIVYRRILQGLEENDADLIVLDPRRTQIAELADIHLQVRPRTDLIVFLYMAKVIVEEGLHDGTFIEERTTGFESFEEYVREAVSEGDVRRIAGVDPEDVRKAAVRYAEAERGCILYCMGLTHHDIATRTVRALCALALLTGNVGRPGTGVNPLRGQNNVQGACDVGALATHFPGYRPINTETANEMSKIWSFEVPDEPGLKLTEAFDADEITVMYVVGENPAVSEPNTRHAVEKLESLEFLVVQDLYLTETGELADLVLPAAGWAERTGTFTATDRRVQLAEKAVEPPGEARPDWWILEAVARRLGLKGFGHRSPREVFEEIRRVVPQYRGITYERLRRRPGGIHWPCPSEDHPGTPILHTEEFATEDGKARFPKPEDVEYREPERDVDEEYPLILTTGRVYAHYHTRTITRRSRLLSEEVPESFVEIHPKDAERYGVRDGELVVVETPYGEWRCRARVTDRVREGTIFTPFHFGENVLTPHDVRDPESGIPEYKYVPARVRPDSRGSASRG

SEQ ID NO: 18610 - protein, 341 aa, Triticum aestivum
  misc_feature (58)..(58): Xaa can be any naturally occurring amino acid
  misc_feature (199)..(199): Xaa can be any naturally occurring amino acid
  misc_feature (232)..(232): Xaa can be any naturally occurring amino acid
  unsure (1)..(341): unsure at all Xaa locations
MSSSSMRIFSPQEGDEKTNQELYQQFTNLVSSWPCSPALSNYQLYRHDNSWHSSLAPXMVGTMVADACFAARPSDIIVATLPKSGTTWIKALLYSTVHRGEHPADSSDHPFNTHGPHECIKFLEYQLYTQNRIPDLDELPDPRLFATHAPFVSLPRSVVASGCKIVCVCRDPKDTLISHWNFANKFRLRDGLEPLSVEXTADYFCHGVFAFGPYWDPCLGYWRAHSAAPTDXVLFFRYEEMNRDPAAHVRRLAEFVGCPFSVEEEEDGAVDAIVKLCSFEHMTGLEATKGGKTELTFGVVENSSFFRRGQVGDWENHLSPETARKIDAITEAKFRGSGLSV

SEQ ID NO: 18611 - protein, 296 aa, Thiobacillus denitrificans ATCC 25259
MAEISTARGSLVAIVTPMSDDGALDLGALRRLIDWHIEQGTDGIVIVGTTGESPTVNFDEHCLLIRTAVEQAGGRVPVIAGTGANSTSEAIALTECARAAGAQAGLSVVPYYNKPTQEGLYQHYRKIAEAVDLPLILYNVPGRTVADLANDTAVRLAEVPGIVGLKDATGNMERAADLVRRVPKGFALYSGDDASALPFMLLGGHGVISVTANVAPRLMHEMCVAAFEGNLARARECNDALLPLHSKLFVEANPIPVKWACAELGLIPPGLRLPLTPLSGGQHEVVRAAMRHAELI

SEQ ID NO: 18612 - protein, 370 aa, Cytophaga sp. KUC-1
MDATFATGKELQKMDPVFGQLSFDDHEQIVFCNDKDTGLKAIIGIHNSVMGPALGGTRMWNYNTEWEALNDVLRLSRGMTYKSAITGLNIGGGKAVIIGDAKTQKTPELMRKFGEFVHSLGGRYITAEDVGMETKDMDTVRDVTPYVTGISEGRGGSGNPSPITAYGVYLGMKAAAKSQFGTDVLEGKKVLVQGIGHVGEALVEYLTKEGAIVTITDINEEKLFQVAQKYNATVYTGTDLYTADVDIYAPCAMGAIINDDTVNKIKAKVIAGAANNQLADENVHGQRLQERGILYAPDFLINAGGIINVYAELEHYGKAEIMTKTENIYNTTLEIIDYAVKNGMTTHKAALTIAQNRIDLRKIENAAAKK

SEQ ID NO: 18613 - protein, 491 aa, Pseudomonas putida
MSQRLAAYENMSLQLIAGEWRVGKAGRDLDVLDPFTQEKLLQIPLANREDLDEAYRSARQAQVAWAACGPSERAQVMLNAVRIFDERRDEIIDWIIRESGSTRIKAQIEWGAARAITQESASLPSRVHGRILASDVPGKESRVYREPLGVIGIISPWNFPLHLTARSLAPALALGNACVIKPASDTPVTGGLLLAHIFEEAGLPKGVLSVVVGSGSEIGDAFVEHEVPGFISFTGSTQVGRNIGRIAAGGEHLKHVALELGGNSPFVVLADADLDQAVNAAVVGKFLHQGQICMAINRIIVEDSVYDEFVNRYAERVKSLPYGDPSKPETVVGPVINAKQLAGLQDKIATAKSEGARVMVEGEAQGNVLPPHVFADVTADMEIAREEIFGPLVGIQRARDEAHALELANSSEYGLSSAVFTSSLERGVKFARGIRAGMTHINDIPVNDEPNAPFGGEKNSGLGRFNGDWAIEEFTTDHWITVQHAPRRYPF

SEQ ID NO: 18614 - protein, 358 aa, Glycine max
  misc_feature (104)..(104): Xaa can be any naturally occurring amino acid
  unsure (1)..(358): unsure at all Xaa locations
MSSQRADLACRIFPEPEIDHFDRLPDSLLLLVFNKIGDVKALGRCCVVSRRFHSLVPQVENVVVRVDCVISDDDSSSSSAASDKSRGPFWNLLRLVFGGIVKPXQTLGQFLGPKRPSSSAAATATAATSPSSTSSLAVGSDEDSDGGVTHHSPTQVLKNFNEIRLLRIELPSGELGIEDGVLLKWRADFGSTLDNCVILGASSVFHPKDLTDPTTTNCNANDDNGSIPDSFYTNGGLKLRVVWTISSLIAASARHYLLQPIISEHATLDNLLLTDADGQGVLYMNREQLEELRVKPLSASSASKRTLVPALNMRLWYAPHLELPTGVVLKGATLVAIRPSEQSPNTAKKEASDLYFSA

SEQ ID NO: 18615 - protein, 393 aa, Triticum aestivum
  misc_feature (20)..(20): Xaa can be any naturally occurring amino acid
  misc_feature (38)..(38): Xaa can be any naturally occurring amino acid
  misc_feature (52)..(52): Xaa can be any naturally occurring amino acid
  unsure (1)..(393): unsure at all Xaa locations
MLSSAMDYLRSCWGPTSSPXGAPRKGVDAAGRQDGLLXWYKDAGQLVAGEFXMAVVQANNLLEDHSQVESGSLSTTDPNLQGSFVGVYDGHGGPETGRYINDHMFNHLKGYASEQKCMSVEVIRKAFRATEEGFLSLVSNQWSVRPQLAAVGSCCLVGVICAGTLYVPDVGDSRAILGRLVKGTGEVVAMQLSAEHNASFEEVRREMQAMHPDDPHIVILKHNVWRVKGIIQITRSIGDVYLKRPEFNREPLHSKFRLPETFRRPLLSSEPAITVHQIQLTDQFIIFASDGLWEHLSNQKAVELVHSSPRNGIARKLVKAAMQEAAKKREMRYSDLKKIDRGVRRHFHDDITVVVVFFDSNAIAMDAWSRPTVSLRGGGVALPANSLAPFSGS

SEQ ID NO: 18616 - protein, 621 aa, Coccidioides immitis RS
MKPATSTANWSKGETQRSLIGTLFGRPHRDATLDDVELLPSQPEEQELQSLPAFFFSFGEGSDPLQEGGLSWLRPCRESSTCDTDGQVHSMLRAYMIMEEEPGCLIRTFTAGKMLSALKDIPPGHLALGAAACFLLYQVYLYLTLGLARRKFIQQNGCRPPPAYPHKDPILGLDWALKGMKYSRSRTFLQGTQKRFREHGNTHSLNVIGKPAIATCDPENIKATLATKFQDFDLSTVRKRLFQPLFGKGIFTTDGAEWEHSRAMLRPNFVRSQVADLDMIERHLKNLFKEIPTDGSTVDLQDLFFDLTLDTATEFLFGESAYTLTKKDMGSGERFSDIFTYCTAVIGQWARLGIFLGIPDRRYHRYAAGVHEFADRYVQKALENYRAQQSGMITSDKTSNRYIFLDELVKSTQDPVELRSEALNILLAGRDTTASLLACLWNVLSKRPDVWSKLLNEVDALNKKRPSFEELKNMKFLRYCVNEALRLYPVVPGNTRVAVRDTFVPVGGGPDGKSPVFVPKGTLLNYSVYTMHRREDIYGPDAAEFKPERWEKLRPGWEYLPFNGGPRICLGQQLALTEASYTTVRLMQEFRHVESRDPNPWEELLTVTCASAHGAKVALRP

SEQ ID NO: 18617 - protein, 528 aa, Prochlorococcus marinus str. MIT 9313
MSNSQSEGKRQPAIVILDFGSQYSELIARRVRETEVYSLVMSYCTSADELRQLAPKGIILSGGPSSVYAERAPLCDPNIWDLGIPVLGVCYGMQLMVQQLGGRVEAAIGKAEYGKAPLQVEDPRDLLTNVESGSTMWMSHGDVVRDLPEGFVRLAHTANTPDAAVADHNRQFYGVQFHPEVVHSSHGIALIRNFVYHICGCEPNWTTTAFIEEAIAQVQAQVGQKRVLLALSGGVDSSTLAFLLKKAIGDQLTCMFIDQGFMRKGEPEFLMDFFDQKFHINVEYINARQRFISKLKGIIDPEEKRKIIGTEFIRVFEEESNRLGPFDYLAQGTLYPDVIESSGTNIDPKTGERVAVKIKSHHNVGGLPKDLQFKLVEPLRRLFKDEVRKVGRALGLPEEIVRRHPFPGPGLAIRILDEVNDEKLNCLRDADLIVREEIREAGLYHEIWQAFAVLLPVRSVGVMGDKRTYAWPIVLRCVSSEDGMTADWSRLPHELLERISNRIVNEVRGVNRVVLDITSKPPGTIEWE

SEQ ID NO: 18618 - protein, 210 aa, Thermosynechococcus elongatus BP-1
MNDSLLSNGHAPPLRQATVDRQTKETKVHVELTLDGNGLADNHTGIPFLNHMLDQLCAHGLVDLRVQASGDTHIDDHHTNEDVGITLGMALDQALGDRRGIQRFGHFVAPLDESLVEVALDFSGRPHLNYGLQIPTQRVGTYDTQLVREFFVALVNHSRMTLHIRQLDGMNSHHIIEATFKAFARALRMAIALDPRRAQQIPSSKGVIQA

SEQ ID NO: 18619 - protein, 1231 aa, Oryza sativa
MFPNFGLMWLRLLETSILLKGWRKRCCANLHHNIQAMRRHTGFCGLCLIRASCTKLFLILLRAMFVDKFLRWKTFPLCCLRWILHYAVFELPPNSGIETQKQRTSSFLAIGLCLEKMSKRELETTKDVLNNILEGVSCRLESPIDLIRKMASAIALTFSKVVDPNNPLYLDDNCCENVEWDFGVLSPKEITAPSKDVELISKLKPSLPENKKHAGERRAKAIKHDTSENRAKIIEIKSLDSCETSGSAVNGHFGEEECDEEIMNIDASSDSSLEPYDLSDDDSDLQKKFTQLKDLAAALRKPDDPDGVENALSSAEKLVRASPDELRHNSGDLVRALVHVRCSDVAMEGEEDSAEEKRQKALVALLVTCTFEPLDVLTKLLYSSSVDVSQRILIIDVMTEAAQELAETKIVRRELRHGNLISDTSPSWLVPSDQGPAGAGPWREVSESGTLLNWSHRYEREVPSRSGQVKSGKSRKWGLGKAKDLQTEWSKNRFPLYAAAFMLPVMQGYDKRSHGVDLLNRDFVVLGKLIYMLGVCMKCMAMHPEASAVAPALLDMIRSRYAKPKTSISVLKTFLVITKWAVSQHPEAYVRRSVLFAASCILIALHPSYVASSLIEGNQDVSTGLEWIRTWALHVAETDPDTECTSLMMMSKRELDESCRGEVSVGTTSHRMGPLLERWISREGRSDGGDSSGPAQPLFRISLSLASQEQRQSKASSAMGNSLPVESKFTFEEENDRIKYVVSSMQGWGEKMEDAHAAILNLDDATSTSFFGVYDGHGGAEVALYCAKQFHIELCNHEDYHNDLINALDNVFLSMDENLQQSDAWRELVIPHDNGCMYFLKAGVCAKPFPQATYTGPAYEGSTACVVVIRGNQMIVGHVGDSRCVLSRQGGLAIDLSFDHKPCTRTESERERVQNAGGRSLGLRCEQVMGNYVVKEQWVLGDFGGGDFAFKKNKDLDREKQMLVCDPDILADDITDDMEFLVIASQGLWSCVDSADVVSYIHDRLSVEGAELRVICEEVVEFGLASGENTTVILVQFKPGAFQYQLVDPAGFGTAVSNIASTSAAPAGASDTSDEGVMADSCATADTSGSARAESGELVPTPSANNTVTDEVDPTGTVAADDKVDPNSSANADADDGAPKPSLGAVIESDEVALDATATGHQVAVRQQEEFDPKKCWICGKGYKKILLEPSSARARNPLLAHAKTCESEDKKAKKKITKYMMKANVTNQYH

SEQ ID NO: 18620 - protein, 206 aa, Thermosynechococcus elongatus BP-1
MPLNTFAHWSRSSLLLGVLLLGVLPRSVFAQNQSGSPNVQIVNPTPPPSSSIYTLEGGKRLMDEAAAAVNSQNYVLAARKLLEARTVMNQLSNFYQSLNSSFLGIDNTAADSNRRRALEAAQLRDQATFQLALVYRANNQPELAVPLFVEIIRSQNPTRELGQKAYQQLLELGFVDVPFPRTGATPSATPEPTSAPASSTNSQPRQ

SEQ ID NO: 18621 - protein, 320 aa, Salmonella enterica subsp. enterica serovar Paratyphi A str.
MTDNRIGVSSLGFAGLREGSEDTAIWLSRYEHNIWTTPQRVAAREGEAHWNPVLFYPSDKLWLFYKVGSDVHVWKTWFIISSDRGFTWSTPAPLVNDDILPRGPVKNKLLLASNGAWIAPGSIESPERWRAFVDRSSDEGKHWNISFVPLEPDNAISGTNVALWDGVKKGMLWECCLENLLRWDGVIQPTLWESSSGHIHMLLRSTRGAIFRSDSIDYGATWSVARATSLPNNNSGIDLVSMQDGTLILALNPVNGNWGKRYPLSLIASHDNGESWLPLLDLESDHGEYSYPAIISEGGVVHITYTWNRKNIVYCRLQTV

SEQ ID NO: 18622 - protein, 702 aa, Cryptococcus neoformans var. neoformans JEC21
MLSLLITGGQPITTRAFQRSVHGALGRSVAAIHRPLLARPLTNRATSNGVLAALKTSNSAHQRGLQTEKRSRNAIHLGLRLPIVKRSLHSSRISRNTLKPNIPPIPPTRLFNLHRRLRRLRNFLILLSLLSILYYTYPPFRHTAIAVIRCARVMKAVSIDVWDYKQVFAAEERLRATGRELTDEEIEMKRKTRRACHKRSAERLLEALKKNSGIYVKLGQHVAAVQVLPKEWTETMRPLQDQCFPTPVQRTDEMLRDDLGMGIDDIFTDFEPNPIGVASLAQVHRAVDKRTGRAVAVKVQHADLQEFAAVDMATVNFAIHFVKYIFPDFEFSWLGEEMNEMLPLEMDFRHEAANSARCMGDFLHLKGKTSLYLPEVFWAERRCMVMEFIDGGRVDDLMYLKKHKIDRNQVSQELARIFSQMVYINGYFHADPHHGNLLIRPKASGSTSPFNFDVCLLDHGQYFDVPDDLRVNYAHFWLSLIKSTSKKTIAERRHYARLVGNIDDDMYPILESAITGQINMADESNTHDSANDPRPTSLLDSKTFDKDQIRKLRTAMLEREGLIASIFELLRIVPRRMLMILKLSDLQRSLDQSLVTTHGQSRVFVIVARYCAKAVWQADYANFRKSLSTQGFSLNLFKSFISSFFDYAYWNTTLGLVELGLDARARSIKIALWFDGLVKGGLKAAEAEMAGLSLNGAIPATV

SEQ ID NO: 18623 - protein, 394 aa, Triticum aestivum
MATLTASASSAMQEAAKTPTASPPRATAASTASPARYRPSPLVIFSACLVLIGAGGPLLLRVYFVHGGQRLWLSALLQISGWPLLLPPLCVSLFRGRRHGIANLLLPPRLVVAAAVLGGFYAVSCYVYAMGSQALPLSTSSLLLATQLAFTAVFAFLFVGLRFTPFSANAVLLLIIGPAVLGVGPGAGKPAGVTSKAYWTGFCEGIAAAALAGLVLPLVEVAMERYGRRTGPAARTPPPYSTVMQMQAVMGAAGTIVCLLGMAIKSDFGALRSEAAAFGLGKTNYYLVLVWDAVSWQLLNLGIMGLITCASSLLAGIMIAVLLPLSQILAVMFLHEKFDGPKGIALVLSLWGFASYMYGEKVQQKKLEAQKSELQQQQQQQVGSETGDLELAAP

SEQ ID NO: 18624 - protein, 214 aa, Zea mays
  misc_feature (117)..(117): Xaa can be any naturally occurring amino acid
  unsure (1)..(214): unsure at all Xaa locations
MDDTEREKEKEKEKHDCGTDVEDEEEDEEGNKRVVVLGPQVPLKEQLELDKDDESLRRWKEQLLGQVDTEQLGETAEPEVTVLDLTILSPGRPDLVLPIPFQADDKGYAFALKDGTXYSFRFSFVVSNNIVSGLKYTNTVWKTGVKVETQKMMLGTFSPQLEPYIYEGEEETTPAGIFARGSYSAKLKFVDDDGKCFLEMSYYFEIRKEWPGGQ

SEQ ID NO: 18625 - protein, 387 aa, Oryza sativa
MVTPRAPELLQQDQDEEMLVPDQDVVVEGPQPMEDSGSTVENEQVPETSTSRFTWTIEDFSNHRKLYSDVFVVGGHKWRVLVFPTGNSVQSLSMYLDIADANEQPHGWSKYAQFSLAVINQLDSKYSLRKGDLYDPTKGYIVNDKCIIEAEVAVRKIVDFWNYDSKKETGYVGLKNQGATCYMNSLLQTLYHIPYFRKHSDNSVSTKELTKSFGWDTVDSFLQHDVQELNRVLCEKLENKMKGTTVEGTIQQLFEGHHMNYIECINVDYKSTRKESFYDLALDVKGCSDVYASFDKYVEVERLEGDNKYQSEKHGLQDAKKGMLFIDFPPVLQVQLKRFEYDFVRDTMVKINDRYEFPLQLDLDKDDGKYLSPEADRRVRNLYTLHR

SEQ ID NO: 18626 - protein, 478 aa, Oceanobacter sp. RED65
MSDKFDVIVIGGGPGGYVAAIRCAQLGLKTACIDKWLDEEGKGVFGGTCLNVGCIPSKALLDSSHKYEEAKEHYDVHGIDVKDISMDVSKMLERKKGIVKQLTQGVRGLFQSNGVTPYEGLGKLLAGKKVEFTNHAGKTETLEAENIIIATGSVPVEIPPAPLQDDIIVDSTGALEFTEVPERLGVIGAGVIGLELGSVWNRLGSKVTVLEAQDKFLHLVDQQVAKEAAKQFKKQGMDVLLGARVTGTEVKGKEVTVNYTDSEGEQSITFDKLIVAVGRRPYTENLFSADTGVSLDERGFVFVDDQCGTEAPGVWAIGDVVRGPMLAHKASEEGVMVAERIAGEKAQVNYECIPSVIYTHPEIAWVGKSEDELKAAGEKYNVGSFPFAANGRAMAANDTGGFVKIIADAETDRILGASVIGPSAGDLCQQVVIAMEFGSSAEDLGMMVFSHPTLSESVHEAALGVNNHAIHKANRKRR

SEQ ID NO: 18627 - protein, 243 aa, Escherichia coli CFT073
MPTGSESLFLYIMRVKFHTTGETIMTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 18628 - protein, 412 aa, Oceanobacter sp. RED65
MSTEIKAPVFPESVADGTIATWHKQPGEQVSRDELLVDIETDKVVLEVVAQNDGVLKEIIKAEGDTVLSSEVVGIFEEGATGSAGGSKDEAPAAKEETAQEADEDDLKVNPAARKLAEEKGVQLSAVKATGKDGRITKEDVLNHIKAEKEAPAAAPAPKAESAPAPASAPSMPSFNAGERAEKRVPMTRLRATIAKRLVSAQQNAAMLTTYNEVDMKAVMELRSQYKDMFEKKHDGVRLGFMGFFVKAATEALKRFPSVNASIDGNDIVYHGYQDIGVAVSTDKGLVVPVLRDVDAMGLADIEGGIVDYAKKAKQGKLGIEEMQGGTFTITNGGVFGSLMSTPILNPPQTAILGMHKIQERPMAINGQVEIRPMMYLALSYDHRMIDGKEAVQFLVTIKELLEDPARILLDV

SEQ ID NO: 18629 - protein, 573 aa, Oryza sativa
  misc_feature (63)..(63): Xaa can be any naturally occurring amino acid
  unsure (1)..(573): unsure at all Xaa locations
IRPFPHQTNQKPKTHSHPLHQPTPTHPSPPPAPARHQARPSLTNPPPLPACRSLARSPAKDEXEMTLLCVPLVSRTVEAMQADAAAAAAAGADLVEIRLDFIEGFRPREHLPSLLRGCPLPALVTYRPNWEGGQYDGDDATRFEALRLAMELGVDYVDIELKVADKFISFISGSKPEKCKLIVSSHNYESTPSCEELADLVARIQAVGSDIVKIATTASDIADVSRMFQVMVHCQVPMIGLVMSEKGLMSRVLSPKFGGYLTFGTLDATKISAPGQPTVKELLDIYNIRRIGPDTKVLGLIANPVKQSKSPILHNKCLQSIGYNAVYLPLLADDLARFLSTYSSPDFSGFSCSLPFKVDAVQCCHEHDPVAKSIGAINTIIRRPDGKLVGYNTDYIGAISAIEDGIGGPGSKDAAISPLAGRLVVVVGAGGAGKAIAYGAKEKGARVVVANRTYEKAVSLAAAVGGHALRLAELETFRPEEGMILANATSLGMYPNVDGTPIPKKALSFYDVVFDAVYAPKVTRLLREAEECGIKVVSGVEMFVRQAMGQFEHFTGGIEAPESLMREIAAKYT

SEQ ID NO: 18630 - protein, 149 aa, Zea mays
  misc_feature (61)..(61): Xaa can be any naturally occurring amino acid
  unsure (1)..(149): unsure at all Xaa locations
MGASIYPVTVLILLDVPVPDQHIVVSQGCLLRDVHYVCPSQNQRQIDMAYYLNQYSWFLIXKLQYYERRGHLDWHIHGHENIDEPFEIEKGYFYDRMDCFCEKTWIHTPEQRIVYCQQSTDKEAWPTIEMYPAAPLYFNDGMYAHETSM

SEQ ID NO: 18631 - protein, 426 aa, Oceanobacter sp. RED65
MADKKAKLTVDGLDEALELPVYEGTVGPDVIDVRSLVAKGKFTYDPGFVSTASCESKITYIDGGAGILLHRGYPIEQLAENSDFLETSYLLLHGELPTQEEKDKFVNTITHHTMVHEQLAQFFKGFRRDAHPMAVMIGVVGALSAFYHDSLDINDARHREIAAHRLIAKMPTLAAMVYKYNIGQPFMYPRNDLGYSENFLHMMFNTPCEEKEVNPVLARAMDKIFLLHADHEQNASTSTVRMAGSTGANPYACIASGIAALWGPAHGGANEAVLRMLDEIGDETQIDKYLAKAKDKNDPFRLMGFGHRVYKSYDPRATVMKKTCDEVLAELGLEDDPQLKMAMKLEKIALEDEYFKSRGLYPNVDFYSGIILKAIGIPTELFTVIFATGRTPGWIAHWNEMLANDYRIARPRQLYTGYAKRDYPKK

SEQ ID NO: 18632 - protein, 363 aa, Chorispora bungeana
GTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDVKEKLAYIALDYEQEMESAYTSSSVDKSYELPDGQVITIGGERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 18633 - protein, 408 aa, Escherichia coli CFT073
MLSGKTQAASAKLLESTRGFTMSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 18634 - protein, 800 aa, Zea mays
  misc_feature (432)..(432): Xaa can be any naturally occurring amino acid
  unsure (1)..(800): unsure at all Xaa locations
MMEEDMENGRSYQERPRTFSTVRSKSSIPLALRLLMRINPRALIILSLLVFSGVLYVGASTSPIVVFVFCICTLSLFFSLYLTKWVLAKDEGPPEMSEISDAIRDGAEGFFKTQYGTISKMAFILAFVILGIYLFRTTTPQQEASGLGRATLAYITVASFLLGALCSGIAGFVGMWVSVRANVRVSSAARRSAREALQIAVRAGGFSAIVVVCMAVFGVAILYSTFYVWLGVDSPGSMKVTDLPLLLVGYGFGASFVALFAQLGGGIYTKAADVGADLVGKVEQGIPEDDPRNPAVIADLVGDNVGDCAARGADLFESIAAEIISAMILGGTMAQRCKIEDPSGFILFPLVVHSFDLVVSSVGILSIRGTRDSGLISPIEDPMAIMQKGYSVTIMLAVLTFGASTRWLLYTEQAPSAWLNFALCGLVGIVTXAYAFVWISKYYTDYKHEPVRLLALSSSTGHGTNIIAGVSLGMESTALPVLVISVAIISAYWLGQTSGLVDESGNPTGGLFGTAVATMGMLSTAGYVLTMDMFGPIADNAGGIVEMSQQPESVREITDVLDAVGNTTKATTKGFAIGSAALASFLLFSAYMDEVASFAQLPFKEVDIAVPEIFVGGLLGSMLIFLFSAWACSAVGKTAQEVVKEVRRQFIERPGIMDYKEKPDYGRCVAIVASASLREMIKPGALAIISPMAVGVVFRILGHYTGQPLLGAKVVASMLMFATVAGILMALFLNTAGGAWDNAKKYIETGALGGKGSESHKAAVTGDTVGDPFKDTAGPSLHVLIKMLATITLVMAPIFL

SEQ ID NO: 18635 - protein, 807 aa, Actinobacillus pleuropneumoniae serovar 1 str. 4074
MTNHWVDIKNADVVVVMGGNAAEAHPVGFRWAIEAKKQNGAKLMVVDPRFNRTASVADFYSPIRSGTDITFLSGVIKYLLDNDKIQHEYVKHYTNASFLINEGFGFEDGLFTGYDEVKRSYDKSTWTYQLDENGQPKRDMTLQDPRCVINLLKKHVERYTPEMVERICGTKQDKFLEFAQTIASTATPERTTTFLYALGWTQHTIGSQNIRTMAIIQLLLGNIGMAGGGVNALRGHSNVQGTTDMGLFPHMLPGYIPLPTESDKTLESFLNRITPKTAVEGQVNYWQNTPKFMVSMLKSFYGDKATKDNEFGYHYLPKQLKYRLDHLRFIDMMDEGKVTGYLCQGYNPLASYPDSNKISSALRKLKFLVIMDPLATDTSEFWKNHGELNDVNPAEIQTEVFRLPSICFAEEDGSIANSGRWLQWHWKATEPPKEAKPDVDILAEIREVMMEMYHKEGGKGLESFEAMSWNYANPLEPKADEIAKENNGYALEDLYDANGNLVAKKGDLLSSFALLRNDGSTSSACWIYTGQWTQKGNQMANRDNSDPSGLGNTLGWSFAWPANRRVLYNRASADLTGKPWNPKRQLIKWNSKNWNYIDVADFGTAAPNTSVSPFIMTNDGVSHLFAPQLAEGPFPEHYEPIETPIGTNPLHPNVVSNPVARILPRDKDRFGTADEFPFVGTTYRLTEHFHWWTKHSQLNMITQPEPFVEISEQLAALKGISHGDTVKITSKRGYIKTKVVVTKRIKPLMADGKEIHTVGIPIHGGFKSAGNKGHLANRLTGRVGDGNTLTPEYKTFLVNIEKVSEVA

SEQ ID NO: 18636 - protein, 408 aa, Thermococcus kodakarensis KOD1
MNFEELVEKVASGEIKLHQVEKYTNGDKKLATEIRRKALEKKLGIKLENIGHYSIDPNQVIGKNIENMIGVVQIPMGVAGPLKINGEYAKGEFYIPLATTEGALVASVNRGCSALTAAGGVKTTLIDDKMTRAPLLKCPDARRAREVAEWVKNNLDYLQEKAVSKVTRHGKLRGVRPFIVGNNLYLRFEFETGDAMGMNMVTIASEEIMKVIEEEFPDVKYLALSGNLCVDKKPNAMNFINGRGKTVIAEAVIPRKIVEEKLKTTPELIAEVNYRKNLVGSAQAGSYGFNAHFGNIVGAIFLATGQDEAQITEGSHGITLAEVTPEGDLYISITMPSLEIGTVGGGTRVPTQREALSIMGVAGGGDPPGTNAKKFAEIVAGAVLAGELSLLAAIAAKHLAKAHKELGR

SEQ ID NO: 18637 - protein, 493 aa, Mycobacterium sp. KMS
MRGDELFIGGTWCAPSTDRRIEVISPHTETTVGHVAAAAPADVDRAVGAAREAFDTGGWPRTSPAGRIDAVRRLAANYERRRSEMAELITSEIGAPISFSQRAQVALPWSMINAFCDLAQTYPWREARPGRYGSDIQVLREPVGVVGAVVPWNMPQFLIVTKLIPALLAGCTVVVKPAPESPLNALLLAEVIAESGLPPGVVSVLPGDGSVGEYLVGHRGVDKVSFTGSTAAGRAVATACAADLRRVSLELGGKSAAIVLDDADPVVVAAGVRSASLSNSGQICNALTRVLVPRSRAGEFTDALAAEVSALVVGDPTDGATQVGPLVARRQQQRVTGYLEQGVRDGARVVTGGTGMPDGLDRGWYVKPTVFDRADNSMTIAREEIFGPVLTVVAYDNEDEAVAIANDSDYGLAGSVFTADTDRGLAVGAAIRTGTFGVNQGYTMDPFAPFGGVKSSGYGRELGREGIDGYVDTKSISVAPKQDLATAAAGKGA

SEQ ID NO: 18638 - protein, 399 aa, Ralstonia solanacearum GMI1000
MTTASAARPAPSADTLAPIAPPPSRLPKVGTTIFTVMSALAAEKQAVNLGQGFPDFDCDPRIVDAVSDAMRAGFNQYPPMTGVPALRQAIAAKIATLYGHAYDAEREITVTAGATQALLTAVLCCVHPGDEVIVFEPTYDSYLPSIELAGGKAVPITLEAPDYRIPFDKLAAAITPRTRLIMLNTPHNPTGTVWHADDMRRLAEIVAPTDVLLLSDEVYEHMVYDGVPHASVSRIPELARRAFVVSSFGKTYHVTGWKVGYVAAPAALSAEFRKVHQFNVFTVNTPVQHGLAAYMADPRPYLELPAFYQHKRDLFRAGLEHTRFKLLPCQGTYFQCVDYSALSDLPEAAFAKWLTSEIGVAAIPVSAFYSQPHESGVVRFCFAKKDETLRLALERLSRL

SEQ ID NO: 18639 - protein, 771 aa, Oryza sativa (indica cultivar-group)
MASSHHQEVQEQGHGDGEEEEQDNSQITSPLLRSSMRLGSPEENSPVEQVALTVPVGDDPATPVLTFRIWVLGTASCVVLSFLNTFFWYRKEPLTVTAISAQIAVVPLGRLMAAALPERVFFRGRPWEFTLNPGPFNVKEHVLITIFANAGAGSVFAINVITAVRVFYGKRISFFVSLLVVLTSQVLGFGWAGIFRRYLVEPAAMWWPSNLVQVSLFRALHEKERRSKGGMTRTQFFLVAFVCSFAYYIFPGYLFQMLTSLSWICWIFPKSVLAQQLGSGLHGLGIGAIGLDWSSISSYLGSPLASPWFATANIAAGFFIYIYVITPIAYWINLYKAQNFPIFSDGLFTVTGQKYNISTIIDSQFHFDTKAYEKNGPLYISTFFSISYGLGFACLTATVVHVLLFHGRYTDKFVTPVSSEIWQLSRSAFQDKKMDIHTKLMKRYKQVPEWWFISILIASVAITMFTCEYYIEQLQLPWWGVLLACALAIFFTLPIGIVTATTNQTPGLNIITEYIMGYLYPGRPVANMCFKVYGYIGPQQALAFLQDFKLGHYMKIPPRTMFMAQVVGTLIAAFVYLGTAWWLMDTIPNICNTELLPPGSPWTCPYDHLFYDASVIWGLIGPRRIFGDLGTYSAVNWFFLGGAIAPLLVWFAHKAFPGQKWILLVNMPVLIAGISQMPPATSVNYTAWIFVAFLSGYVVYKYRRDWWERHNYLLSGALDAGLAFMAVLLYLCLGLEKISLNWWGNDLDGCPLASCPIAEGITVQGCPVASA

SEQ ID NO: 18640 - protein, 512 aa, Chlamydia muridarum Nigg
MSNILILDFGSQYTNVLAKKIRLLSVFCEVLPWNTPLEKILQKSPSGLIFSGGPHSVYQNNSPEVDKEIYNSNIPILGVCYGMQLIARDFGSEVQGGKSEFGYTPIVFYPSELFKGLADQDAFHTEIRMSHCDCVVVPPKDFFVIASSQHCPIAAIECPKKKLFGLQFHPEVSDSQDIGDKILSNFVKHICQTSETWKIETIEKQLIQGIREKVGETERVLLGLSGGVDSSVLAVLLHNALGDRLSCVFVDTGLLRKNEVEEVKQQFSSLGLEILVVDASEKFFHDLSGIEDPEQKRKVIGAAFIEVFDEASKNLDVQWLAQGTIYSDVIESAKSCDATQVIKSHHNVGGLPEKLNLKLLEPLRFLFKDEVRALGKVLGLPDVLISRHPFPGPGLGVRVLGEVRREYVEIVKNADSIFIEELKKANLYHKVSQAFAVFLPCKSVAVKGDCRHYGYTIALRAVESTDFMTACWPSLSREFLNRCSSRIINEIPEVCRVVYDISDKPPATIEWE

SEQ ID NO: 18641 - protein, 296 aa, Burkholderia xenovorans LB400
MNAQANAQPNAQATPHSYLVGLIGSGIGGSLTPAMHEEEGSQLGLHYVYRRIDLEALKLDIAALPDLLIAAERMGFNGLNITYPCKQAVIPLLDELSGDARALGAVNTVLFKDGKRIGHNTDWSGFARAFQRGLPDVSLERVVQLGAGGAGAAVAHAALTLGAKSLTLFDVDASRAASLARELQKRFPAAAISAGSSLAGSLTAANGLIHATPTGMAKLPGLPLPVELLHRDLWVADIVYFPIRTALLQAAESLGCRTLSGGGMAVYQAVDAMRIFTGLEPDAERVYRHFQSLLQR

SEQ ID NO: 18642 - protein, 370 aa, Azoarcus sp. BH72
MIKSRAAVAWGPNQPLEITEVDVAPPKAGEVRVRIVATGVCHTDAFTLSGADPEGIFPSILGHEGGGIVEAIGEGVTSVAVGDHVIPLYTPECGKCKFCLSGKTNLCQAIRATQGKGLMPDGTSRFSKDGKPIFHYMGTSTFSEYTVLPEISVAKIQKDAPLDKVCLLGCGVTTGIGAVLNTAKVEPGATVAVFGLGGIGLSAIIGAVMAKASRIVAVDINPDKFEIARQLGATDFINPKDYDRPIQEVIVELTDGGVDYSFECIGNTNVMRSALECCHKGWGESIIIGVAGAGQEISTRPFQLVTGRVWRGSAFGGVRGRTELPSYVAKAQTGEIPLDTFITHRMGLEDINKAFDLMHEGKSIRSVIIY

SEQ ID NO: 18643 - protein, 367 aa, Escherichia coli CFT073
MRQVRFPRTICWITLSGKFAQGKPCRRSMTVRVAINGFGRIGRNVVRALYESGRRAEITVVAINELADAAGMAHLLKYDTSHGRFAWEVRQERDQLFVGDDAIRVLHERSLQSLPWRELGVDVVLDCTGVYGSREHGEAHIAAGAKKVLFSHPGSNDLDATVVYGVNQDQLRAEHRIVSNASCTTNCIIPVIKLLDDAYGIESGTVTTIHSAMHDQQVIDAYHPDLRRTRAASQSIIPVDTKLAAGITRFFPQFNDRFEAIAVRVPTINVTAIDLSVTVKKPVKANEVNLLLQKAAQGAFHGIVDYTELPLVSVDFNHDPHSAIVDGTQTRVSGAHLIKTLVWCDNEWGFANRMLDTTLAMATVAFR

SEQ ID NO: 18644 - protein, 104 aa, Glycine max
  misc_feature (91)..(91): Xaa can be any naturally occurring amino acid
  unsure (1)..(104): unsure at all Xaa locations
MSGRGKGGKGLGKGGAKRHRKVLRDNIQGITKPAIRRLARRGGVKRISGLIYEETRGVLKIFLENVIRDAVTYTEHARRKTVTAMDVVYAXLRGRGRTLYGFGG

SEQ ID NO: 18645 - protein, 442 aa, Corynebacterium diphtheriae NCTC 13129
MDFNALPSHVWPRHAAREAGGDVSVAGVSLVSIAQEYGTPVFVVDEADFRSRCRDMAAAFGGADKVHYASKAFLTRRIARWVEEEGLSLDIASHGELQVALRAGFPSQRITAHGNNKDRAFLQALVDARVGHVVIDSMVELERLEEIAGAAGIQQPVMVRVKPGIEAHTHEFIATSHEDQKFGFSLASGSAYAAAARAISSESLYLIGLHCHVGSQVFDAQGFSLAAQRVLDLYSRIHRELGVDLEQLDLGGGYGIAYTEDETPLDVAAVAQDLLKAVQSAADEIGISAPEILVEPGRAIAGPSTVTVYEVGTVKDVHVTDRQTRRYLAVDGGMSDNIRPALYEAEYDARVINRNITGTPISSRVVGSHCESGDILINDAMLPDDIREGDLLALAATGAYCFAMSSRYNMMGRPAVVSVLDGQASVMVKRENIDDLLQLDVP

SEQ ID NO: 18646 - protein, 353 aa, Aspergillus oryzae
MSTMQAVVFQGPLKVTLEQRPVPQIEEPTDVIVKVRYTALCGSELHVFRGHQPSGTGFIMGHEFTGEIVEVGSAVRGFKVGDLVVSPFTVNCGECFYCARKCSSRCAKGKLYGSVMLDGGQADYARVPSADATLVAAPAAVDEKKLVLMADILPTGFFAARNAFKGMDRATIEESTVLLFGCGPVGLCALISALDYRPKHLIAVDSVPSRLELAKSLGAEPWNFQTDAEGLKQRVKDLTEGRGADVAIEVVGHSDALRMAFDNLRPWGRISSIGVHNGEIPWTGNEAYGKNLQIQMGRCPVRSIFEDALEFLIRKQDSLGFMVGDIRPLSQAIQAYDDFNQMKSQKIIFEAGK

SEQ ID NO: 18647 - protein, 491 aa, Methanopyrus kandleri AV19
MPRRLQNVYKVPGRGRHQLRIAGKSIPGVSPLADEVYTVDFKKRQKENEEKVEKVMEQVESKDVKFVRLQFVDIHGFVKNFAIPAERLEDALVEGVLFDGSSIDGFVDIEESDMIAMPDPDTFAVLPWRPREGKVARIICDVYWPEGKPFEGCPRLNLKRVMNELAEKGYMMYCGPECEFYLLKQDPETGEVEAHDEGGYFDFYPLDRAEDIRREIIFAMEEFGLEVEMSHHEVGPGQHEIDFKFADAVTTADNVISFKQIVKAIARKHGLIATFMPKPIYGENGNGMHVHQSLWDPEGKENLFYDPDAEDQYYLSDTALYYIGGIMEHAHALCAVCNPLVNSYKRLVPGYEAPVYIAWSPKNRSAFIRVPAARGKATRIEYRSPDPACNPYLAFAAMAVAGVDGIENKIDPGDPVNENLYEMSEEERKELGIEHLPENLRDALEAFKEDEVVQSAFTDHIVEQWLELKWEEWSEYRERVTKWEIKKFIVY

SEQ ID NO: 18648 - protein, 350 aa, Thermococcus kodakarensis KOD1
MAEKMQAIMKTKPAYGAELVEVDVPKPGPGEVLIKVLATSICGTDLHIYEWNEWAQSRIKPPQIMGHEVAGEVVEVGPGVEDLQVGDYISVETHIVCGKCYACKHNRYHVCQNTKIFGVDMDGVFAHYAIVPAKNAWKNPKDMPPEYAALQEPLGNAVDTVLAGPIAGRSTLITGAGPLGLLGIAVAKASGAYPVIVSEPSEFRRKLAKKVGADYVVNPFEEDPVKFVMDITDGAGVEVFLEFSGAPKALEQGLKAVTPGGRVSLLGLFPREVTIDFNNLIIFKALEVHGITGRHLWETWYTVSSLIQSGKLNLDPIITHKYKGFDKFEEAFELMRAGKTGKVVFFPHKG

SEQ ID NO: 18649 - protein, 377 aa, Leifsonia xyli subsp. xyli str. CTCB07
MNASTSISLTSGPTETSGLLWNVARNEAARTAAERAEILADPGFGNYFTDHMVDLCWSAKGGWHRPRVSPYGPIPLDPSAAVLHYAQEIFEGLKAYRHEDGSIWSFRPEANAARMQRSSYRLALPQLPVEHFLDSLKQLIAVDGDWVPDTEETSLYLRPFMFAKEAFLGVRPANKVAYYLIASPAAAYFPSGVAPVSIWLSDRWSRAGKGGTGAAKTGGNYASSLLPQAEAHEHGCAQVLFLDSVESTYIEELGGMNVVLVYKDGTLVTPDSDSILEGITLDSVLQLARDRGHRVERRRVTIGEWRDGVESGDIVEVFACGTAAVITPIGELKSDTFAVGDITAAPGALTLSLRKELTDIQYGRERDRHGWMYRLDA

SEQ ID NO: 18650 - protein, 357 aa, Leifsonia xyli subsp. xyli str. CTCB07
MSRTVQLVVIPGDGIGPEVIAEAVKALDAVTAGSGLAFQKTYFSLGADRYLATGDVLTDDDLAAIRGHDAILLGAVGGRPGDPRLAGANVERGLLLRLRFSLDHYVNLRPTTLFPGIASPLAAPGEVDFVVVREGTEGQYVGNGGAIRPGTPHEVANEVSVNTAYGVERVVRYAFEQAGQRRKKLTLVHKTNVLTFAGSLWKRIVDALAAEHPEVAVDYLHVDAATIFLVTDPARFDVIVTDNLFGDILTDLAAAISGGIGLAASGNINPVGEFPSMFEPVHGSAPDIAGEQRADPTAAILSVALLLRHLGERPLAERVERAVTTDLAARSGQMATASQTRTTSQIGDAIAALAAQN

SEQ ID NO: 18651 - protein, 500 aa, Pseudonocardia sp. K1
MTVIAKPDHLLRDDVQKFIDRPKKLFINGQWHDSIKGETLEVYDPAVGTKICTVAAGDAEDVDRAVAAARHAFDEGPWSKLNPSERGRLVWRLADLLEEHADEFAQIDALDNGKPVTDARAVDVAFSIELLRYMAGWSNKIYGETIPLTNPADFHAYTLREPVGVVGQIVPWNFPLMMAVWKVAPALAAGCTVILKPAEQTPLSALRLAELTEEAGFPPGVFNVITGFGETAGAAIAAHDNIDKVAFTGSTEVGRLIAQAASGNLKKVSLELGGKSPVIVFGDSDIEQAVAGASSAIFYNNGQTCTAGSRLYVHRKVYDKVVEGIASEASALPIGHGLDPATRIGPLISAEQRDRVTGYIAQGREAGAEVIVGGDTVGDGGYFIQPTILTKTDPSMSVVREEIFGPVLCAMAFDEDTIDSVVREANNSVYGLAASIYTRDISVAHRVAKRLKAGTIGINTHHVVDVALPFGGFKQSGYGRDMGRDAIDQYTEVKSIGIAL

SEQ ID NO: 18652 - protein, 325 aa, Idiomarina loihiensis L2TR
MKQVTQNFRLLGEQVLDIEKKAIEGLYQYLDDNFDAACQTLFNCKGRVIVTGMGKSGHIGGKIAATLASTGTPAFFVHPGEASHGDLGMVAAQDVVIAISNSGETAEVLNIIPVIKRLGVPLISMTGKPGSTLARLADTHVCIAVEQEACPLGLAPTASTTATLVMGDAMAVALLNARGFTADDFALSHPGGSLGKRLLLRLHDVMHTGERVPVIPADAIISDALLEMSRKGLGMTAIVDENQRLAGIFTDGDLRRILDNRIDVHKTPIAEVMTRSCITANEDMLAAEALKLMQDRKINGLIITNDDGQPCGAMNMHDLLQAGVL

SEQ ID NO: 18653 - protein, 302 aa, Prochlorococcus marinus str. MIT 9313
MSSAAELSPTPFGRLLTAMVTPFDADGCVDLALAGRLARYLVDEGSDGLVVCGTTGESPTLSWQEQHQLLGVVRQAVGPGVKVLAGTGSNSTAEAIEATTQAAAVGADGALVVVPYYNKPPQEGLEAHFRAIAQAAPELPLMLYNIPGRTGCSLAPATVARLMECPNVVSFKAASGTTDEVTQLRLQCGSKLAVYSGDDGLLLPMLSVGAVGVVSVASHLVGRRLKAMIEAYLNGQGALALSYHEQLQPLFKALFVTTNPIPVKAALELSGWPVGSPRLPLLPLDPVMRDALSNTLTALCQT

SEQ ID NO: 18654 - protein, 531 aa, Thermosynechococcus elongatus BP-1
MASSPVAPVVLVILDGWGYREETYGNAIASAYTPVIDSLWQAYPHTLIHTSGKAVGLPKGQMGNSEVGHLNIGAGRIVPQELVRISDAVEEGSLFSNPVLVRLCQTVKERNGKLHFIGLCSAGGVHSHIDHLYGLVELAKRHGLPACIHVITDGRDTPPRDAAGVLEELEQRLKTSGCGRIVTVSGRYYAMDRDRRWERTEAAYRVMTSNEHIQPLRAVDVARQSYAQDIGDEFIVPTRIAAGAVEPGDGVVFFNFRPDRARQLTQAFIDPNFSGFERALITPLDFVTFTQYDASFNCGVAFPPQNLSHILGEVIAEHGLKQLRAAETEKYAHVTYFFNGGLEEPFPGEDRILIPSPMVTTYDQAPAMSALAVTQAVKKAIEKQEYALVVVNFANSDMVGHTGKLAATIQAIETVDRCVGVLVEAATKVGGTLLITADHGNAEYMIDEDGNPWTAHTTNPVPFILVEGEKRKVPGHGGHVILRKDGCLADIAPTILEILELPQPLEMTGRSLIVSAPYEMRLNRTPVSLKI

SEQ ID NO: 18655 - protein, 570 aa, Bacillus anthracis str. Sterne
MSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLNNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMEDLLDFQIPYARKEAEVSEWKENGVIGLAEVVKHVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENFSDNDIKIAVKEAIWEPEYRQIKAVEKVTI

SEQ ID NO: 18656 - protein, 305 aa, Vigna radiata
MVSLPTLLLLFAASAAAIFLHRAFSRRKFRLPPGSYGLPFIGETLQLISAYKSSNPEPFMDERVRRYGSIFMTHVFGEPTVFSADPELNRFILQNEGKLLDCSYPGSISNLLGKHSLLLMKGALHKRMHSLTMSFANSSIIKDHLLHHIDRIIGLNLDTWSDRVTLMDQAKKITFELTVKQLMSFDPDEWTESLRKEYVLVIEGFFTLPLPLFSTTYRRAIKARTKVAEALTLVVRQRREEYNQGKEKKSDMLGALLASGDHFSDDQIVDFLLALLVAGYETTSTIMTLAVKFLTETPLALAQLK

SEQ ID NO: 18657 - protein, 295 aa, Bradyrhizobium japonicum USDA 110
MVPDTNSISHSRTWTFFRGQWHEGNVPIMGPRTHGLWLASTIFDGARAFEGVMPDLDRHCARVNQSAVNFGLKPVVDLDTWLGLVREGIARFPVNAELYIRPMYWPQNGIGGGVLFDPETTDWCLCIYESPIPEPVGSAITLSPFRRPTAECAPADVKASCLYPNSSRALREAASRGFQNCLMLDMLGNVTEFGNSNVFMAKDGVVFTPAPNGTFLNGITRQRVIELLRGDGITVLEATLRYSDFVSADEIFSTGNFAKVAPVIRIDDRQLRPGRFYARARKLYWDFAHGMKLAA

SEQ ID NO: 18658 - protein, 479 aa, Pseudonocardia sp. K1
MQAEPFWIAGRPATGSTVIDVQYPYDGRTVASVFVPSAEQVEEAVAAMHAARDVVGATSAHRRASALSHVADRLEQRSEEAAQVIVLESGKPIKWARVEVARAASTFRWAAEEARRWSGTLQRLDTDAGGAGRLALVRRFPRGSLLAITPFNFPLNLVAHKVAPAIAVGVPVIIKPAPSTPLSSLFLGQLLAETDLHQGSWSVLPVPNSQMEHLILDPRLPIISFTGSGPVGWDIKSLVPRKHVTLELGGNAAAVVCSDWSSEQDLEWAAQRIALFANYQAGQSCISVQRVYVPRELYEVFTVLLSRHIGALRQGNPNDDATDVGPVINEASAIRIEQWIDDAVHAGAKILVGGRRNGTSLEPTLLADVPLAARILRDEAFGPVVSITPFDSLDSAFAAVNDSDFGLQTGVFTRDIRTAFRAHRDLEVGGVIIGDVPSYRADQMPYGGMKDSGIGREGVRSAMDDFTVEKVLVLAGVAL

SEQ ID NO: 18659 - protein, 153 aa, Zea mays
MACSTNLCFSALIPPLPASSSSGSSPFLTMKRVSSVPSLSRWTIRYKQLGHALYQRSHVLAFASADASQGKRSSGENVVMVDPLEAKRLAAKQMQEIRAKEKLKVHCCCIGVYHSLDAINGPLAMIGLTAGLIVEAQTGKGILGQELMTPAME

SEQ ID NO: 18660 - protein, 604 aa, Cryptococcus neoformans var. neoformans B-3501A
MIALTDEIYFLWVKTLKQLVSITLDRQVTDITPSDPDMLWIRQLWPLGTKAINREKAEALCAQIGLQIKADGMLDITVFHDLIKASQTRPDINQVYRDLTLSGLLDKGRVVSFLTHIQRIPSSSVENVFNRYKSGDLWTIDSLTSFLSSSDNTPNQPQDMTHPLQHYFISSSHNTYLVGEQWKGESTVEGYIRVLLAGCRCVEMDVQSGDVEPVVYHRKTLTSSVPVRDICRAIKQYGFVTSPYPIIISTEIHCASEQQNRLAIILKEVFGDMLVSAPLVEEFSELPSPEDLKGKILFKAKPPKPELNSPKLEANLFYQESPSSTDSDTSFVRLARRLSIQSKTERPDIFSPQLSELLVYTHGVKYQGFSKLNEYLPSHQFSVSERTAAKILKVNKVDWIKHNFKHISRVYPRGTRLGSTNFNPVDSWSAGCQIVALNWQTLDESILLNHAMFHDSNGYILKPLSLREKVVEVPEKYLLTVRIISGQRTPLCADLYVEAILNGKISKRTRALSQVTLNPLWDETLTFEITSTPSLLMLNFLHLEVRNKALQAQWMRPVSLAPRGYHHLPLYDSLLSRFVFATLFVKITVEKLQDVVENEKSNSI

SEQ ID NO: 18661 - protein, 210 aa, Ralstonia solanacearum GMI1000
MRTKKLPALRVGVGGPVGSGKTTLLEMLCKAMRERYDLVAITNDIYTKEDQRLLTLSGALPAERIMGVETGGCPHTAIREDASINLEAVDRMLARFPDADVVFIESGGDNLAATFSPELSDLTIYVIDVAGGEKIPRKGGPGITKSDLLIINKTDLAPYVGASLDVMASDARKMRGDRPFVMCNLKEQAGLDAVVRFIEQQGMLAAPAAG

SEQ ID NO: 18662 - protein, 518 aa, Aspergillus nidulans FGSC A4
MEHIHNVFGLDTFFIINIGIALAGLATWLRSVWNLVNRYADTCIATVYINEHDPLYNDVIQWMNDHIFKDRNFCCVLAVTDNHHRPGKRQGLISAIAGPMNPADASPPQVLGKSTFELKPFNGSRIFTFRGRWVLFSHSAPSRTITTLQDGAEERIHLKLQTLSLSLDPLRALIEEANAYSKKLAKSQISVYRAMSNVRDLVRWNRITTRPSRAISTVILDSCKKKAVLDDMREYLREDTRQWYANHGIPYRRGYLFSGPPGTGKTSLSSALAGVFGLDIYVLSLLDPNISESHFLRLFSEVPTQCVVLLEDIDAAGMTLKRANEEPVTADTTASFDVMKKRARPGAPVPTSPPTPISLSALLNAIDGVSSQEGRILIMTTNAPQDLDPALIRPGRVDMHIRFELPSRVEFRELFRSMFSDAPSGPDSEVKGESDIGSDALKLEETKKKNIDMIDLDRLAQEFAEALPEGRFSLAEVQGFLLQYKRQPEAACARAAEWATDNKPRQYLPCPPAGPGDV

SEQ ID NO: 18663 - protein, 348 aa, Glycine max
MGSGNEVHSVVEFNLDAKWLIDPKQLFVGPKIGEGAHAKVYEGKYKNQNVAVKIVNKGETPEQISRREARFAREIAMLSRVQHKNLVKFIGACKEPVMVIVTELLLGGTLRKHLWSIRPKCLDMRIAVGFALDIARAMECLHSHGIIHRDLKPDNLILTEDHKTVKLADFGLAREESLTEMMTAETGTYRWMAPELYSTVTLRQGEKKHYNHKVDAYSFAIVLWELIHNKLPFEGMSNLQAAYAAAFKNTRPSADELPEDLALIVTSCWKEDPNDRPNFSQIIEMLLRYLTTISPSKPVVPMRITSKNAVLPPESPGTSALMAGRDDSGETPKGNIEGRSKGFFFCCY

SEQ ID NO: 18664 - protein, 142 aa, Triticum aestivum
  misc_feature (81)..(81): Xaa can be any naturally occurring amino acid
  misc_feature (87)..(87): Xaa can be any naturally occurring amino acid
  misc_feature (92)..(92): Xaa can be any naturally occurring amino acid
  misc_feature (97)..(97): Xaa can be any naturally occurring amino acid
  misc_feature (101)..(101): Xaa can be any naturally occurring amino acid
  misc_feature (109)..(109): Xaa can be any naturally occurring amino acid
  misc_feature (115)..(115): Xaa can be any naturally occurring amino acid
  misc_feature (120)..(120): Xaa can be any naturally occurring amino acid
  misc_feature (125)..(125): Xaa can be any naturally occurring amino acid
  misc_feature (130)..(130): Xaa can be any naturally occurring amino acid
  misc_feature (133)..(133): Xaa can be any naturally occurring amino acid
  misc_feature (136)..(136): Xaa can be any naturally occurring amino acid
  unsure (1)..(142): unsure at all Xaa locations
MAPTVMASSATSVAPFQGLKSTAGLPVSRRSNGASLGSVSNGGRIRCMQVWPIEGIKKFETLSYLPPLSTEALLKQVDYLXIRSKWXVPCLXSTSWXIFRXEHNASPGXYYDGRXYWDMXKLPIXDAPTXQCXQVXEVKKDT

SEQ ID NO: 18665 - protein, 247 aa, Triticum aestivum
MATSRRALRFVLLLPAILAALLPPAPAAAAGPPRVSLALYYESLCPYCSRFIVTRLAGSFDSGLIGAVDLLLVPYGNAHVRGANNTISCQHGPDECLLNNVEACAIEAWPDLNVHFGFINCVEDLVMNRKCEEWESCFQKQGLDPKPVMECYNSEHGHKLSLKYGKQTDALVPPHKYVPWVVVDGQPLYEDYENFEAYVCKAYKGHPPKICQGLGRDYPIVQQVVEAGNGVTYNSGDFELDEGVDDK

SEQ ID NO: 18666 - protein, 431 aa, Mycobacterium bovis AF2122/97
MADTDDTATLRYPGGEIDLQIVHATEGADGIALGPLLAKTGHTTFDVGFANTAAAKSSITYIDGDAGILRYRGYPIDQLAEKSTFIEVCYLLIYGELPDTDQLAQFTGRIQRHTMLHEDLKRFFDGFPRNAHPMPVLSSVVNALSAYYQDALDPMDNGQVELSTIRLLAKLPTIAAYAYKKSVGQPFLYPDNSLTLVENFLRLTFGFPAEPYQADPEVVRALDMLFILHADHEQNCSTSTVRLVGSSRANLFTSISGGINALWGPLHGGANQAVLEMLEGIRDSGDDVSEFVRKVKNREAGVKLMGFGHRVYKNYDPRARIVKEQADKILAKLGGDDSLLGIAKELEEAALTDDYFIERKLYPNVDFYTGLIYRALGFPTRMFTVLFALGRLPGWIAHWREMHDEGDSKIGRPRQIYTGYAERDYVTIDAR

SEQ ID NO: 18667 - protein, 182 aa, Campylobacter jejuni RM1221
MIKLTQEEQKYLLDSIRIIPDFPKKGIIFRDITTLLNNKEALNFLLKHLKERYKDYNLDFIAGTESRGFIFASMICAKLNLPFVPIRKPGKLPFETFSCEYDLEYGSDKVELHKDAFKNIQNARVLLVDDLIATGGTAIASYELIQKAGAKCVEACFLMNLKDLNGANKLEKLTSVYSVLEI

SEQ ID NO: 18668 - protein, 574 aa, Thermococcus kodakarensis KOD1
MPKFDVSKRDLERLVGKTFSVEEWEDLFLYAKCELDDVWEENGEIYFKADSKDTNRPDLWSAEGIARQIRFALGFQKGLPKYEIEKSDVVVYVDEKLKDIRPYGVYAIVEGLNIDEEALRQMINLQEKVALTFGRRRREVAIGIFDFDKVKPPIYYRAAEKTEKFVPLGYDEEMTLEEILEKHEKGREYGHLIKDKPYYPLLVDSEGKVLSMPPVINSETTGRVTTETKNVFVDITGWDLNKVMLALNVVVTALAERGGKIKSVKVVYPDFEIETPDLTPKEFEVELDYIRKLAGLELSDGEIKELLERMMYEVELENRRAKLRYPAFRDDIMHARDVLEDVLIAYGYNEIEPEEPKLAVQGRGDKFIEFEDAVRELMVGFGLQEVMTFNLTNREAQYDRMNLPCGEHQEECRDYFNHPPAELVEIENPISPKWSALRNWLIPSLLDFLSQNTHEEYPQKLFEVGKATLIDESRETKTVSESKLAVALAHPRVTFTEAKEILEGVMRHLGFEYELEEAEHPSFIPGRVGKIIVNGETIGVIGEIHPAVLENWGIEMPVAAFELFLAPLYTEPYL

SEQ ID NO: 18669 - protein, 267 aa, Leifsonia xyli subsp. xyli str. CTCB07
MTSTASPQPSTSADLAAAVSALAGTERLLVALDFDGTLAPFVDIPKAARALPEAKAALDRLEQMPGTRVAYVSGRPLSSLETVTEADGDALLIGSHGVEIRFGREGVSLDLATEERAALDRLGEVLGALVQSVPGTRLEVKPVGFGVHYRLLEGEGAEDVVARARAAAASVSSDLTIRDGKDIIEFSVWDADKGDGIDRLREYTKATAVLFAGDDVTDEDGFRVLVPGRGDVGVKVGPGETTAQYRVADERAIAALLTLLSEARAAR

SEQ ID NO: 18670 - protein, 673 aa, Escherichia coli CFT073
MPFIIRSGVKMSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKEFAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQIASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAEQLFEEFGFTVDNVVAKAKALL

SEQ ID NO: 18671 - protein, 1068 aa, Thiobacillus denitrificans ATCC 25259
MPSRTDLQSILIIGAGPIVIGQACEFDYSGAQACKALREEGYKVILVNSNPATIMTDPDMADVTYIEPISWQIVEKIIAKERPDALLPTMGGQTALNCALDLAKHGVLEKYGVEMIGASKDAIDKAEDREKFKAAMTKLGLGSARSAIAHSMEEALQVQAALGFPTIIRPSFTMGGSGGGIAYNKDEFVAICERGLEASPTHELLIEESLLGWKEYEMEVVRDSKDNCIIVCSIENFDPMGVHTGDSITVAPAQTLTDKEYQIMRNASLAVLREIGVDTGGSNVQFAINPDDGRMVVIEMNPRVSRSSALASKATGFPIAKVAAKLAVGYTLDELQNDITGGATPASFEPSIDYVVTKVPRFAFEKFPQADDRLTTQMKSVGEVMAMGRTFQESLQKALRGLEVGADGLDPKTTDREEIEAELMSPGPERIWYVGDAFRVGMTLDEVHAVSKIDPWFLDQIEVLIELEASLAGRALVDLGRDELRDLKRAGFSDRRLAKLLNTDQHAVRARRNELALHPVYKRVDTCAAEFATQTAYMYSTYEEECEAHPSDKKKIMVLGGGPNRIGQGIEFDYCCVHAALALRENGFETIMVNCNPETVSTDYDTSDRLYFEPLTLEDVLEIVRIEKPFGVIVQYGGQTPLKLARDLERNGVPIIGTSPDMIDAAEDRERFQQMLHDLGLKQPPNRTARDPESALRMAAEIGYPLVVRPSYVLGGRAMEIVREEADLVRYMTEAVKVSNKSPVLLDRFLNDAIEVDVDALSDGEQVVIGGIMQHIEQAGVHSGDSACSLPPYSLADALQDELRRQTVAMAKALKVVGLMNVQFAIQGDTVYVLEVNPRASRTVPYVSKAIGAPLAKIAARAMAGISLKSQAFEKEVIPPYFSVKEAVFPFRKFPGVDTILGPEMKSTGEVMGVGDNFGEAFVKSQLASSSELPKPGGRAFISVRSGDHSAVVDLAQGLRDLGFSLVATRGTAQVIEAAGIPVAIVNKVKEGRPHIVDMIKNGDIDFIVNVVEDKKAVKDSYAIRAEALSRRVVYFTTLAGARAACMGMQHGNELEVYSLQALHRRLN

SEQ ID NO: 18672 - protein, 254 aa, Zea mays
MAETLDMTLDDIIKNNKKSNPSSRGARRSRGGSAPGGGTGGVGPTRRPFKRAGNRQAPYQPPKAPDAAWQHDMYPAVAAGGGGGGGRVSALETGAKLYISNLDFGVSNEDIKELFSELGDLKRFSINYDRSGRSKGTAEVVFARRSDAVAAVKKYDNVQLDGKPMKIEIVGTNTPAAAAAHPVPNGGHARNAARSAPKDAAPAGMSQHRPHQRGGRRAAGSGGGRRGKERSKPKSTEELDADLEKYHADAMQTN

SEQ ID NO: 18673 - protein, 379 aa, Malus x domestica
KRGSFAGGPAVEGFDYRSILGQCCENPVGYVQIPVGVAGPLLLDGEEYMVPMATTEGCLVASTNRGFKAIYASGGAESVLFNDSMTRAPIVRFHSVVRAAQLKFFVENPLNFDALAVVFNMSSRFAKLEKIRCAIAGRNLYLRFSCSTGDAMGMNMISKGVQCVIEFLQNEFPDMEVVGISGNFCSDKKAAAVNWIEGRGKSVTCEAVIKEELVRKVLKTDVDSLVKLNVNKNLVGSAMAGALGGFNAHASNIVSAVFIATGQDPAQNIESSHCITLMEADGNDLHISVTMPSIEVGTVGGGTQLASQSACLNLLGVKGAGKDSPGLNSRQLARIVAGAVLAGELSLMSAIASGQLVKSHMKYNRSNPDVANLASVKHR

SEQ ID NO: 18674 - protein, 721 aa, Xanthobacter autotrophicus Py2
MEDATSRRPARSDLDPLTVCDREPIHRPGAIQPHGLLLVADSRTLKVVAAAGDVEGRLAADWAGRDLGALLGRDVAALLGAAAVGTVRVGRVAGRDETFEVQIHASGRGLLVELEPAGAPLAAADILAGLDASATRFEQAPDLRALCAEAAQAFRRITGFDRVMIYQFREDEAGVVLAEAKAPEMGSFLNHHFPGGDVPRQARALYVRNRVRVIPDVAYVPAPLRPAATDGAGPDWSDLDMSDLGLRSVSPIHVQYLKNMGVGASASVSIVKDGQLWGLVACHHRTARLLPYELRLACQSLAGNLARQIRAKVDAVLYRERIRLRAAEDALADALAGDFAVEDVLDRHGDDLCRALSADGFAAVAGSMLLTKGRCPDEETVRRIAQWVETQAQVRAFSTHALSEHLPADSGAVDARASGLLALTVPGEEPLVLLWFRAEQVEVVNWAGNPHKASSADPQAELTPRASFAAWSETVRGRSRRWTLVETETAQRLAHTLLQARQQRRIRELNRQLSATVVENERLLQYKDHLMNEVNHRVQNSLQLVASFLRLQARTLGDAPARDALAEAERRIAAVGLVHRQLYGGEQVETVDLSRYLTDLSHEVTNSLGAEWRAHLMLDLAPVLMAADRAVRLGLILTELVLNTAKYAYLGAPGPLILALDQNRDRFRLVVADRGAGKTGARQGFGTVILNAMVQSLNGTLEDLDNAPGLRTVVTAPIGIG

SEQ ID NO: 18675 - protein, 563 aa, Arabidopsis thaliana
MMISEKPLGVEESIRQDLEVLTVSRRLVKSVSQKLKKKIHKTEVVEDEEIARGAVNCLSISVGCRVADTGEDFEDSSNKRWSSASEEGKGLMTICGTEETRLDCFSYGVRERFWKKNNRKYLADSGQDYRKHVYLPDDILEMCLMRLPLTSLLNAHLVCKKWQSMANTQRFLQMRREGSFQTPWLFLFAALKDGCSSGDIHGYDVSQDKWHRIETDLLKGRFMYSVTSIHEEIYIVGGRSMDRNSFKSHRGILVFSPSIKAWRKIASMRHARSLPIVGATEVTSEFSTMQTKQNRQDRRFHLSRVGGESDVYEDPHRLSVRRQNRNSADQNGTKSHRLIRQKLDRLNRNSSKRFVLIAIGGTGLFDEPLDSGEIYDSATNTWSEMQRLPMGFGVVSCGIICNGIFYAYSENDKLSGYDIERGFWITIQTSPIPPRVHEFYPKLVSCNHRLFMLSVSWCDEGDGQIGRRNKAVRKLWELDLVYLTWTEVSVHPDAPMDWNATYVSDQNILMGIEMFKIFGQVLSFFTVCDVLTEEASWRHVSRNQRSQKLNLSCTNKTIALLHL

SEQ ID NO: 18676 - protein, 301 aa, Triticum aestivum
MLPYATAGEAEAALGRALTWAEAAWLRYSASVPDRYLHWPNIAITLVVYTLAPLPLALFDLAAPAAAAPYKLQPKVQHPPATFFRCYMDAVRVSLLIIGPYQLISYPAAKIMDIRTGLPLPSMGEIAAQLTVYFLVEDYLNYWLHRLLHTKWGYEKIHHVHHEFTAPMAYAAWYGHWAEMLILAVPSLAGPALVPCHVTTLWIWFAARLVESLNIHSGFKLPFNAEKYIPFYGGAEHHDYHHYIGGQSKSNFAPVFTYCDYIYGTDKGYRYHKATLAKLKELAGSDVQKGVDNGFNGGKQD

SEQ ID NO: 18677 - protein, 269 aa, Arabidopsis thaliana
MGNHQAVKKLWVINNFSFLDSDRVYSDIFVVGGCKWCLLALPEGNNNYIYDYFSLYLCVPDSEYLPSGWRRRAKVSFTMVNQVTGELSQQQEGVYWFDEKNTTQGFGSMFRLLVFQSSYKGFLVNGEVDIVAEVDVVEVIGKLDVSEESESIDSNGFDVLASQVESVNSLFGKYPCFASKLCPKTPRLKKNVVQSLNEILCKSTKELSNGDLAEAYSALRFVTKAGFKLDWLEKKLKETGKSRLQEIEEDLKDLKVKCADMDALLEFLR

SEQ ID NO: 18678 - protein, 379 aa, Gossypium hirsutum
MSTAGQVIRCKAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRTVQCTGSIQAMISAFECVHDGWGVAVLVGVPNKDDAFKTHPVNLLNERTLKGTFFGNYKPRSDIPAVVEKYMNKELELDKFITHTVPFSEINKAFELMLAGEGLRCCIRMDA

SEQ ID NO: 18679 - protein, 379 aa, Aspergillus nidulans FGSC A4
MNATDIERCRKRIIQYIWDPEPKNDEEPGNPDHGQQQNTNTSAPGWPEAFLLDFESKIWMTYRSNFPPIPKDAGQEGSLSLTLGVRLRSQLIDAQGFTSDTGWGCMIRSGQSLLANSMAILLLGRDWRRGERLEEEGKLLSLFADSPHAPFSIHSFVKHGADFCGKHPGEWFGPTATARCIQGLAARYDQSNLQVYIADDNSDVHQDKFMSVSRDEKGTVRPTLILLGLRLGIDRITAVYWNGLKAVLQLPQSVGIAGGRPSASHYFVAVQGSHFFYLDPHNTRPALRYSESGTYTEDEVNTYHTRRLRRLNIQDMDPSMLIGFLIRDEDDWEDWKARIMSLEGKPIITILSESDAASWKGRREALDEVEAFDDLDVAL

SEQ ID NO: 18680 - protein, 479 aa, Cryptococcus neoformans var. neoformans B-3501A
MPPRIAPLLSRTVRTSTRSFASTSVSMSAPVRTAAQWSDFGREHVSHGLGRVKDHVIVKGEGLNLYTADGKKLLDFTAGIGVTNLGHCHPAVSKAAAEQINNLVHLQCSIAFHQPYLELIEKLLPVMPDPSLDQFFFWNSGSEAVEAAVKLTRKATGRQNLIVFQGAYHGRTMGSGSMTRSKPIYTQSTGPLMPGVIATPYPYWHSLGVSPSTSEEELVNLAKYQLDLLFRQQTSPKDVAAIFIEPVQGEGGYVPCPPAFMKHLREVCDKHGILLVVDEVQTGFFRTGKYFAVNSIPDFRPDVLVFAKGIANGFPLSGIVSTKELMSTLDVGSLGGTYAGNPVACAAGIAAQEVYASGEIEKNVAARSEQLFTALNKLASSEKTKHLIADVRGVGLMTAIEFRSASDPLTHEGLPEGTKIPKDIGKRVQAYCLEKDLMVLTTSCFDTIRFIPALVINEEEMKRAMDIFTEAVEKVALEA

SEQ ID NO: 18681 - protein, 148 aa, Arabidopsis thaliana
MEQTFIMIKPDGVQRGLVSVKSSAGLRRRVSLCLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 18682 - protein, 410 aa, Methanopyrus kandleri AV19
MDEKKIEELVSKVVKGEIKFHEVEKYTDGDSEVATEVRRRALERLTGAKLEHLGKYTIDANRAMDKNIENMIGAVQVPVGIAGPLLVHGEYAEGEYYVPLATTEGALVASVNRGCSTITDSGGAHVRIVRDGMTRAPVFKLPSARKALEFCEWVRKHFDDIKEVAESTTRHGELLDIQEFVVGRHVFLRFEFDTKDAMGMNMVTIATEEAVNWIEEKYPDAKCVSASGNVCVDKKPSWLNNVLGRGRTVVAEVEVPRDIVEEKLKTTPEAMAEVNYRKNLVGSAAAGNIGFNAHHANIVAAIFIATGQDEAHAVDGSTGYTTMEVTEDGDLYASVTIPSLNVGTVGGGTGVETQRECLEILGVAGGGNPPGVNAKEFAEVVAAAVLAGELSLVAALAAGHLGKAHRLLGR

SEQ ID NO: 18683 - protein, 147 aa, Arabidopsis thaliana
QTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 18684 - protein, 231 aa, Brassica napus
MQVVSPSSPAARFVGKERFAELYGKLNEDFSSKLKVGVTEKEEEESNDEGEEGDEFSFASVNGENSPITADEAFEGGQIRPVYPFFNRNLLFEPEAEESLRSPLKKVFVEREEATTTTTTATEESEPIGPYCSWSGRTVEEASPKTCRKSNSTGFSKLWRFRDLVLRSKSDGKDAFVFLSNGSSSQSSPSTAAAAAKPSGVKRAEKAKMKTKSAHERLYMRNRAIREEGKR

SEQ ID NO: 18685 - protein, 378 aa, Brassica napus
MDIISGQALFLFFCFILSCFLIFTTVRSRRSSRGAATLPPGPPRLPIIGNMHLVGKNPHRSFAHLSKTYGPVMSIKLGCLNTVVIASPNAAREVLRTHDQILSGRYWNEAVRSIDHHSFSVAWLHPSSPLWRLLRKISVTHLFSPQRIEATQALRMKKVQELINFVSECSDREEAVDISRASFVTALNIISNVLFSIDLGNYDSRKSSDFQDMVIGVMESAGNTELANFFPFMRFFDVQGTRKKFKDCSERLFRAFRRLYDDRIKGNSLQTEDKDVSSKDFLDALIDLNQGDEAELNMYQIEHLLLDLFSAGTDTNSSTVEWAMTELLQNPKAMTKVQDEIDSVIGQNGVVQESDISQLPYLQAVVKETFRLHPAAPL

SEQ ID NO: 18686 - protein, 340 aa, Chlamydia muridarum Nigg
MLTLGLESSCDETSCALVENGKILANRIASQDIHAAYGGVIPELASRAHLQIFPKLLAAVAQDAEVSLEDVELISVANTPGLIGALSVGVNFAKGLASGLKKTLIGVNHVEAHLYAACLEEPSIRFPALGLAISGAHTSLFLMPNATTFLLIGKTRDDAIGETFDKVARFLGLPYPGGQKLEELAQDGDEEAYPFSRAKVSGNDFSFSGLKTAVLYALKGNNSSAKAPFPEVSETQKRNIAASFQKAAFMTIAQKLPDIVKAFSCESLIVGGGVANNRYFRRLLNQTCSLPTYFPSSQLCSDNAAMIAGLGERLFCNQTYVSKEVIPCARYQWESACLSH

SEQ ID NO: 18687 - protein, 458 aa, Thiobacillus denitrificans ATCC 25259
MGRKYFGTDGVRGKVGETPITPEFVMRLGYAAGKVLVSDRGSLPANEHPTVLIGKDTRISGYMLEAALEAGFTAAGVNVLMTGPMPTPAVAYLTRALRLQAGVVISASHNPFEDNGIKFFSASGQKLPDSVEEAIEAALDQPLATVAARQLGRARRIEDAAARYIEFCKSTFPNRLDLRGMRIVVDCAHGATYHVAPHVLHELGAEVVAIGNEPNGFNINEACGATHTPALADAVRAHHADIGISLDGDGDRLMMADAHGRIYDGDQLVYVIARHRLETGYMKGGVVGTLMTNLGTEHALARIHVPFERAKVGDRYVLKRLHANGWFLGGETSGHILCLDKHTTGDGIVSSLQVLRALRETGKTLDAFTADLETYPQVMINVPVVKGFRLSDAAAVTVAVADAESALNGSGRIVLRASGTEPLIRVMVEGRDGDLVRRTAEMIADAVRAAAAASDIAV

SEQ ID NO: 18688 - protein, 468 aa, Escherichia coli CFT073
MEGIMPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 18689 - protein, 422 aa, Gladiolus hybrid cultivar 'Traveler'
MEGCDCIEPQWPADELLVKYQYISDFFIALAYFSIPLELIYFVKKSSFFPYRWVLIQFGAFIVLCGATHLINLRTFTMHSKTLALVMTVAKVSTAVVSCATALMLVHIIPDLLSVKTRELFLKNKAEELDREMGLIRTQEETGRHVRMLTHEIRSTLDRHTILKTTFVELGRTLDLAECALWMPSRTGLNLQLSHTLHNQIPVGSTVSINLPTVNQVFNSNRAVRISHTSPLARIRPLAGRYVPPEVVAVRVPLLHLSNFQINDWPELSARSYAVMVLILPSDSARKWHVHELELVEVVADQIKDTGCGISPQDIPFLFTKFAHTQNGGNKGYSGSGLGLAICKRFISLMEGHIWLESEGLGKGCTATFIVKLGICGSQNGHQQQMIPTNRVLLGGADFPGPRALLKEDNKAIPSKLRYLSV

SEQ ID NO: 18690 - protein, 537 aa, Zea mays
MEPFFLFVGLALVLCFLTPYYRHLQSKKTSPLEPTEWPIVGHLPGLVANIHHFHDWATGVLAGVGYNFEARAGRTGVRYFITCDPSNVRHIFTSNFANYPKGEEYAAIFDVLGGGIFNADGESWRRQRVKAQMLMTGPRFRAFTARCSRDKVERSLLPFLAHHAADDGRTPPCDLHDVFLRLTFDMTCTLVFGVDPGCLAFGLPVVPFARAMDDALETLFLRHIIPMACWKLMHVLEVGQERKMAAARRTIDSFVAATVAKRRADKLKGCECCVSNSYDLLSSFICHEEDGSSENDDDVFLRDTTVNLLLAGRDTTGAALSWFFYLVSKNPRVEQKILDELTPIAASRRTKGAEDAAHAASGMVTFDADELGSLVYLHAALSECLRLYPSVPFEHKVAAAADVLPSGKELKAGDKVLVFNYSMGRMEGVWGKDCMEFRPERWLNVEGTKLRYEPSYKFISFNAGPRTCLGKEMAFVQMKTVAAAVLWNFAVEVVPGHVVEPKLSIILHMKNGLAVKVTRRDDGTAPSSSCVRHTACF

SEQ ID NO: 18691 - protein, 248 aa, Thiobacillus denitrificans ATCC 25259
MRKKLVAGNWKMHGSLAENAALLAALKPALQGIEAAVCVPFPYLAQVQTALAGSSLAWGAQNVSEHGKGAFTGEVSASMLLDFGCKYVIVGHSERRSLYGESDALVAAKYMAAQAAGLTPILCVGESLAERESGVTEQVVARQLDAVVAAAGIASLARAVVAYEPVWAIGTGKTASPEQAQAVHAFIRGKLADLDAAVAAGLIIQYGGSVKAANAAELMAQPDIDGGLIGGASLLADEFVAICRAAAK

SEQ ID NO: 18692 - protein, 216 aa, Roseovarius nubinhibens ISM
MENARPLPSYLVQRYRGWKATSYANNESWYRRLSDEGQHPRAMIISCCDSRVQVTSIFGADQGEFFIHRNIANLVPPYQPDGNQHGTSAAVEYAVTALKVAHVIVMGHSSCGGVKGCHDMCSGAAPELEKKSSFVGRWMDILRPGYERVKDIKDPIERTAALEKEAVVVSLENLMKFPFVASEVKEGRLSLHGLWHDIGEGTLEHYLPEKGTFEKV

SEQ ID NO: 18693 - protein, 363 aa, Buchnera aphidicola str. APS (Acyrthosiphon pisum)
MKKNYRIAVLSGDGIGPEVMQEACKILNVLKKYFFLSLEIQKFNIGGIAIEREGVALPKTTLLGCENSDSILLGSVGGKKWDNLPVEQRPERAALLPLRKHFNLFSNLRPAKLYPELKCLSPLRSDIVKNGFDILCVRELTGGIYFGEPKGFVNKNNTKYAFDTEIYHEYEIIRIAHLAFKLARSRKKKVCSIDKSNVLQSSILWREVVESVSKKYPDVHLSHLYIDNAAMQIIKDPNQFDVLLCSNLFGDIISDECATITGSIGMLPSASFNEKNFGLYEPAGGSAPDIEGKNIANPIAQILSLSMLVRYGMNLNQIADKIDKAVNNVLKKGYRTSDISHDNNFLKTDEMGDLIVDSLINGE

SEQ ID NO: 18694 - protein, 544 aa, Actinobacillus pleuropneumoniae serovar 1 str. 4074
MTCKNTRRLYQIITTFLRYGIDEIIPDIPLTRHARLGRKALFWVRNQHKDQPFGVRLRLALQELGPVWIKLGQMLSTRRDLFEPELAEQLALLQDSVEPFDGKSARQIIEQALGGSLETWFDEFDEQALASASIAQVHTAKFNQNQPLAGKDVVLKVIRPDIEPIIKADIALMYRLASWIPRLSNDAKRLRATEVVREYEKTLLDELDLTREMANAIRLRNNFENSEMLYVPEMYQDFCHKNVIVMERIYGIPVSDVETLKANGTDMKLLAERGVQVFFTQVFRDSFFHADMHAGNIFVNPNHPENPQYIGIDCGIVGTLNQNDKRYLAESFVAFFNRDYRRVALMHVESGWTPPDTDIDAFEQAFREVCEPIFAKPLSEISFGHVLLNLFNVAREFNMEVQPQLVLLQKTLLYIEGLGRQVYPQLDLWQTAKPFLQNWLNEQVGVKAILRDLKQRAPQFREHFAEFPEAVFNALQQQKQINFRLDELNKTLQAQGRQKSHNVRSIVSGVIILGVLWRFDDLPLWLSCGTLVTVLLVLLLQRKS

SEQ ID NO: 18695 - protein, 512 aa, Chlamydophila caviae GPIC
MSNILILDFGSQYTNVLAKKIRLLSVFCEVLTWNTPLEKILQISPSGLIFSGGPHSVYQENSPKVDKEIYNSNIPILGVCYGMQLIARDFGSEVQGGKSEFGYTPIVFYPSELFKGLVDQDAFHTEIRMSHCDSVVIPPKDFFVIASSQHCPIAAIECPEKKLFGLQFHPEVSDSQAVGDKILSNFVKHICQASETWKIETIEKQLIQSIKEKVGETERVLLGLSGGVDSSVLAVLLHNALGDRLSCVFVDTGLLRKNEVEEVKQQFSSLGLEILVVDASEKFFHDLSGIEDPEQKRKVIGAAFIEVFDEVSRNLDVQWLAQGTIYSDVIESAKSCDATQVIKSHHNVGGLPEKLNLKLLEPLRFLFKDEVRALGKVLGLPDVLISRHPFPGPGLGVRVLGEVRREYVEIVKNADSIFIEELKKANLYHKVSQAFAVFLPCKSVAVKGDCRHYGYTIALRAIESTDFMTACWPSLSREFLNRCSSRIINEIPEVCRVVYDISDKPPATIEWE

SEQ ID NO: 18696 - protein, 542 aa, Xanthobacter autotrophicus Py2
MAGGIYDLHLDRNPANFQPLTPLGFLERAAGVFPDHTAIIHGALRRNYRDFYARSRRLASALAKLGVGKGDTVAVMLPNAPAMLEAHYGVPMTGAVLNSLNTRLDAAILAFTLDHGEAKVLITDREFSPVMKAALAMATRKPVVIDYDDPEFTGKGERIGTIEYEDFLATGDADFAWKTPDDEWDAIALNYTSGTTGDPKGVVYHHRGAHLLAVGNVVTCSLGKHPVYLWTLPMFHCNGWCFPWSITLAAGTHVCLRQVRAKPIFDAIADYKVTHMCGAPIVMSTLLNTPDADKRPLPHKVEFITAAAPPPEAVLAAMQEAGFNVVHVYGLTEVYGPSVVNEWHAEWDALPAQERAIKKARQGVRYGALEALDVLDPDTMVPVPADGETLGEVMFRGNVVMKGYLKNPTATDAAFAGGWFHSGDLGVKHPDGYIQLKDRSKDIIISGGENISSIEVEDALYKHPAVSAAAVVAKPDEKWGETPVAFVELREGASATAEDLIAHCRTHLAAYKCPRHIVFEEIPKTSTGKIQKFRLREMAKEV

SEQ ID NO: 18697 - protein, 505 aa, Roseovarius nubinhibens ISM
MSIPKPVVLCILDGWGLSDSDVGNAPRLAQTPIMDRLLADCPNATLLTHGHDVGLPAGQMGNSEVGHMNIGAGRVVEMDLRRIDRAIETGAFATLPGILRFAEALKASGGTAHLLGVLSDGGVHSHITHMIAAAEALTAQGLRVAIHAFTDGRDVAQVSAKTYLEELRDALPQGAFIATVSGRYYAMDRDNRWDRVSLAFDALVNARGYTADTASDAIDNAYDKGRTDEFIKPRVLGDYDGMKDGDGILCLNFRADRAREILASFADPEFADFDTGPRPQFAIVSGFTEYSRRHTAYMDCIFPDEAPENTLSQWIAAKSRTQFHIAETEKYPHVTFFLNGGRERPEPGEERYMAASPKVATYDLAPEMSSGEVTDHLVRAIEQGFDFIVVNYANPDMVGHSGDLDAAIAACEAVDRGLGRVRAAIEAKGGALIVTADHGNCEQMIDPVTGEPHTAHTTNPVPVLLLGGPEGAALRHGRLADLAPTVLALMGLDQPAEMTGQSLLA

SEQ ID NO: 18698 - protein, 212 aa, Oryza sativa (japonica cultivar-group)
MAEGAELVGESAHQDMPRVVAALAGILERVAGRNDAAATPAELAAAPASPFRATAKPGISVRAYAARIARFAGCSPACYVVAYIYLDRLLRRGRRCLALALAVDSYSVHRLLITAVLSAVKFMDDICYNNAYFAKVGGISLAEMNYLEVDFLFGVGFDLNVTPETFADYCAVLQSEMLCAAPPTRLHYCCLSEDDAGSSSSSSLREAAMEAS

SEQ ID NO: 18699 - protein, 454 aa, Burkholderia xenovorans LB400
MRRVYPLQETPGLQFKLPTTATAPFCPSEVQGSVAVTQGAPFWKRILQFAGPGLLVSIGYMDPGNWATDIEAGSRYGYSLLFVVMLSSLAAMALQCLSMRLGIATGRDLAELSRTRYSPAVARFQWLLAELSIVACDLAEVLGGALAFHLLFKCSLTTGVLLTAFDTLIVLGLKGKNFRDLEAIMLGLIATIGVGYIIELALVQPHWPSVAQGLIPSWQALSSREPMYLAIGILGATVMPHNLYLHSSIVQTRAVKRDPASIRSAIGMSRIDTIVSLVLALLINMAILILAAAAFHATGHNQVTEIEDAYKLLAPIVGTGFAAVLFAVTLLASGQSSTFTGTVAGQVIMEGFLKLKIPCWQRRFITRALALIPALIGVQMMGNGAVGKLLVASQVVLSLQLPFALYPLIRMTNDRSLMGEFANTLLTRCVAWTLFVVISAANLWLVVQTAGLAG

SEQ ID NO: 18700 - protein, 575 aa, Cryptococcus neoformans var. neoformans B-3501A
MKGGRFLLPALFKTLLLPPLIAALFIHHFPSLFPTFTALIYLISFPALYVFRSYASLVASSWKASALGAIDIPRVNGTWPLNIDILLNWAKSGTEEEVGRMMVLMGRQYGGTYNTRVLGEDQIISSDPKVIKHVLIDDFDNFVKGQKFKERAQDFLGDGIFNSDGDNWKFHRSFMRPFFQPKYISPLHFSTNVQNFFAKLPSYGKVFDMQAHIGQLALELAIMWLCGEDMSRDTNNVAWTEEWKKAKGEISWAMTEAQKIVGKRVKIGTIWPLFEVRHDPLERPMKVIRAFFRPIISRALNRKRQRCKLDNTEDVYMIDRLVEATDDIKLVEDQLINVLLASRDTLASLLTFSVYAIVLHPDIAVRLKDEVFTIANQECEVTKDTIRQLRYCRAFINEVLRLFPPVPLNIRRTLRPSLLPTPNHLAYMPANTSIILATILMQRDPAVWGEDAQVFNPDRWLEGGGLGKEKEGFMSWNLGPRMCLGQSFALAITHTFLVYFFRHIAHVGTLVGHNTTVQLALDAQPPETVLPKEWMTPEGGDGRARGGRDKVWIVADVVLAIKGGLWIRFGAEETE

SEQ ID NO: 18701 - protein, 304 aa, Roseovarius nubinhibens ISM
MTETWLVADVGGTNSRLGLATHDGLLAGSSASFANDAYPEFDRLVAEYLAGQGAEITALCAGVAGPVRAGRAQLTNRDWQIDADRLAQTTGATRVTLINDLQAQGYALDDLDAARLTPIWQATPPPPRATRMVLGLGTGCNIAVTHDLGSRLFVPPAEAGHSRLPHLEDLAPAMARLEMDHLPVEAFLSGPGLSRLHKALHDQDASPAEILTGHSPAQRDTRAAATTLLGQVLGNFATIHLPMGGIFLIGGLARALLPRLDTTALRANFTQKGPYRAILEDIPLWLITDDDAALRGCARLLRQG

SEQ ID NO: 18702 - protein, 553 aa, Chlamydia muridarum Nigg
MSSSKHSSLCQKTPPLCRELQKAPALLLTEDTRFSALLNDRVETVAQLFPCTYESPYRKFIPKSDLPLDIAPLKVGVMLSGGPAPGGHNVILGLLHSIKKLHPHSKLLGFIRNGHGLLNNNTVEITEEFMKEFRNSGGFNCIGTGRTNIITEENKARCLQTANQLDLDGLVIIGGDGSNTATAILAEYFAKHRAKTVLIGVPKTIDGDLQHLFLDLTFGFDTATKFYSSIISNISRDALSCKGHYHFIKLMGRSSSHITLECALQTHPNMALIGEEIAEKGTSLSALIQGICEMISDRAAMGKYHGVILIPEGVIEFIPEIQTLVKEIESFPEQTDLSQALSPSSQQLLHQFPEDIRHQLLYNRDAHGNVYVSQISVDKLLIHLVQNHLETHFKHVPFNAISHFLGYEGRSGTPTHFDNVYSYNLGYGAGILVFNRCNGYLTTIEGLTNPIEKWRLRALPIVRMLTTKTNKDGTLYPLIKKGLVDISSPVFNKFSLYRKIWALEDSYRFVGPLQIHSPEDSHSDDFPPLILFLNHNEWQKRCSICLEIPDQDY

SEQ ID NO: 18703 - protein, 424 aa, Azoarcus sp. BH72
MSSTASAAYPLPSLSDGPAGLMLEEVPLATLAERFGTPTYVYSRAALTAAFRDWQAALAGRRSLVCYAVKANANLGVLSVFAQLGAGFDIVSGGELARVIAAGGRADRVVFSGVGKSRAEMRQALAAGIRCFNVESAPELERLNEVAGELGQRAPIALRVNPDVDPKTHPYISTGLKSNKFGVAFGEALELYRRAATLPHLRISGIACHIGSQLLDPAPVAEAAAKVLGLVDQLSAEGIVLDHIDLGGGLGIRYRDETPPSVAAYLAPLLAAFGDRREEICFEPGRSLVGNAGLLLTRVEYLKHGEEKNFAIVDAAMNDLARPALYDAYHEAVAVCRSDAPRQRYEIVGPICESGDFLAHDRELALRDGDLVALLSAGAYGMTMSSNYNTRPRAAEVMVDGGQVHLVRERETVEALYAGEHLLP

SEQ ID NO: 18704 - protein, 291 aa, Burkholderia xenovorans LB400
MRIARLDMEAFKPPYSFVPAGSEPAEADSTALEVTDVQIEGHAQDITLRLYRQAKKTALPVLLYFHGGGFTKGSIDQADYASRYFAEHLPALVVSVGYSLAPQFPFPAAPEDAHRAALWVQTRARAFGGNSKKVGVAGHDAGGQLANCLAFIARDRGDVRIAAQALFGPMLDPSLTRLGDEKRLGSDITAKECAACYRAYLPQASQRMHPYAAPLESSRLAGLPATLIVTAQNDVLHVEAEKYASSLIDAGVLTQVVRYPSVSHAALADHVPALQEAVRFFQWRFDARAYR

SEQ ID NO: 18705 - protein, 548 aa, Chlamydia muridarum Nigg
MELLSVNKSYFELQRLHYRPVTLALLDNLCSLHIKESASSEPNPGLLAKHIPHLCALPNLTIQKGDRSSSEPLRIGVLLSGGQAPGGHNVVIGLFEGLRAFNKETKLFGFIKGPLGLIRGLYKDLDISVIYDYYNAGGFDMLSSSKEKIKTKEQKSAILSTVKKMKLHGLLIVGGDNSNTDTAMLAEYFIEHNCPTAVIGVPKTIDGDLKNSWIETPLGFHTSCRTYSEMIGNLEKDILSTRKYHHFVKLMGEQASHSTLECGLQALPNITLIGEEVAIHHTSLRSLSHHIARGLIKRFRKDKNYSTILIPEGLIKQIPDTKLLIHELNALIAEGQFSVNHFDQQLSPMALQTFSSLPENIREQLLLDRDSYGNVRVSKIAIEELLASLVSDEIAKLEPTMPFAPVTHFLGYESRASFPSNFDSNYGLALGIAASLFLVRGKTGYMVTIGNLAEEYAHWTIAATPLYKMMHLEKRFNEETPVIKTDSVSPHSPMVQYLHKIKEACLLEDLYRFPGPLQYFEEQALIDQRPLTLLWEKGALSENNANRL

SEQ ID NO: 18706 - protein, 149 aa, Desulfitobacterium hafniense DCB-2
MEKTFIMLKPDAVQRGLVGQIIARFEAKGCKLVGMKLMSVDQALAEQHYAEHKGKSFFEPTVQYIMSSPVVAMVWEGKNVVALARELMGATNPANANPGSIRGSFGMDISRNVIHGSDSVASAEREIALYFRPEELCDYRKAGEEWLSE

SEQ ID NO: 18707 - protein, 246 aa, Triticum aestivum
  misc_feature (181)..(181): Xaa can be any naturally occurring amino acid
  misc_feature (204)..(204): Xaa can be any naturally occurring amino acid
  unsure (1)..(246): unsure at all Xaa locations
MQLNTMSHLPHEPEFEQAYGELASALENSSLFNEHPEYRTALAVAAIPERVIQFRIVWEDDKGNLQVNRGYRVQFNSALGPYKGGLRFHPSVNLSILKFLGFEQIFKNALTGLSMGGGKGGADFDPKGKSDAEIRRFCQSFMTELSKHIGAETDVPAGDIGVGGREIGYLFGAYRKLRNRXWEGVLTGKGLFWGGSLIRPEATXGYGLVYYVDYMLKHANRGSFEGKRVALSGSGHVAQYAALRSS

SEQ ID NO: 18708 - protein, 583 aa, Aspergillus oryzae
MVDKCGQSMLMSIMPMGSSPPNRCTATRHGVRRDFVVLKQNPIPSTASDVILSRRQIEALIAEGQSIIIVNQKVLRVDAWIPYHPGGQKVIQHVVGKDATDEFTIFHCEETRQMSERYQIGRIEGRWANFVPPIQGGVFRSEDEEDDESTILVKEQQDSSSTGLEVAAVDSGIHKRGSQPEPREDMATQDEMAFLDTETKEEIKLTLSKYPALDDATQDEIIAKYRLLHKQIHAEGLYTCNYTAYAWEFARCSLLFSIMLFFLHIGWYNTSALFLAWFWSQMVFAAHDAGHIGITQNFTIDSLIGMTIAAPIGGLSLGWWKRSHNVHHIVTNAPEHDPDNQHLPFLAVNHRFLGNIFSTYHERLLAYDKFAKALVPYQAYLYYIILLFGRFNLYVQSWLFLAKGQGPRKGPAKWHRWYEICGNVIFWLWFGYGILYKSIPTPLSRISFVLISHMATMPLHVQFTVSHFAMSTTDLGPNESFAQKMLRTTMDVDCPPWLDWVHGGLQFQAIHHLYPRVPRHNLRRAQALVMEFCRDVGIPYALYGFVGGNRKVLGGLAEVARQAAILEKCRRTVVERGEFVWGL

SEQ ID NO: 18709 - protein, 417 aa, Thiobacillus denitrificans ATCC 25259
MAEIRNYTMNFGPQHPAAHGVLRLVLELDGEVIQRADPHIGLLHRATEKLAEHKTFLQALPYMDRLDYVSMMVNEHAYVMAIEKLLGIEVPERAQYIRVMFDEITRVLNHLLWLGAHALDVGAMTVFLYAFREREDLMDCYEAVSGARMHAAYYRPGGVYRDLPDRMPQYQAQHTRNESTMKSMNANRQGSLLDFIEDFTTRFPAYVDEYETLLTDNRIWKQRTVGIGVVAPERALALGFTGPMLRGSGVEWDLRKKQPYEVYERMDFDIPVGTNGDCYDRYLVRIEEMRQSNRIIRQCVDWLRKNPGPIMVDNHKVSPPPRVDMKQNMEELIHHFKLFTEGMHVPAGEAYAAVEHPKGEFGIYLVSDGANKPYRMKIRAPGFAHLEALDEMSRGHMIADVVAIIGTQDIVFGEIDR

SEQ ID NO: 18710 - protein, 305 aa, Aspergillus oryzae
MDVLLDILDTYVFDRFYAAILPATNPVTASAGTYNKHIGLYYPLPPSPYADSSTWKRDDIVRQTMSLFLIGWIFATALYLIGSTIIYHTLFDKRVMRHPHFLPNQIRQEIRQGITSIPVIAVLTAPFFLAEVRGWTKLYDFADEAPFRAYNWLQYPLFVCFTDCGIYWIHRGLHYPPVYRWLHKPHHKWIMPSPFASYAFHPVDGWSQSIPYHVYPLLFPLQKSAYLGLFVFVTMWTVFIHDAEYLSQSVVVNGAACHTMHHLYFNYNYGQFLTFWDRLNGTYRTPKEDGFIQNENRKAQALKQA

SEQ ID NO: 18711 - protein, 403 aa, Bacillus licheniformis ATCC 14580
MNKPKVVVLGAGYGGLMTVTRLVKKIGINEADITLVNKHNYHYETTWMHEASAGTLHHDRCRYQIKDVINTSRVNFVQDTVKKIDKEGKKVVLETGELSYDYLVVALGSVPETFGISGLKEHAFSISNINSSRQLREHIEYQFATYNTEAEKRPERLTIVVGGAGFTGIEFLGEMANRIPELCREYDIDRQQVRLICVEAAPSVLPGFEPELVDYAVNYLEGKGVEFKIGTAVKECTPDGIIVGKDDQTEEIKAGTVVWAAGVRGNPIIEESGFENMRGRVKVKPDLRVEGHDDIFVIGDCSLIINEETERPYPPTAQISMQQGETCANNLAALIHGKETETFSFDNKGSVASLGEHDAIGVAFGRKMTGTTASMMKKIIDNRSLFMIGGPGLVLKKGKFKFF

SEQ ID NO: 18712 - protein, 483 aa, Thermococcus kodakarensis KOD1
MCLIAGGMGGNLREKLIKMAIAGKHRGPESFGVWTDGGVLKSDDFSKLTEIPDGRIGLLQCRLAITGSKSFTQPFINDLALVHNGEIYNHAALREYLERRGVSFESDVDSEVVLRLIEFLREEHLSYPEIVKKLFWMLEGDYAVAFSDGERIYLFRDPLGIRPLYFSRNGLFASEKKVLWAVGEREVEPVQPGELVVLEKNGVRRARLFSLENLKSKAKCERKDPVGGVGKLLRYAVKNRVSKKTGVLFSGGLDSTLVAYLASQYSDVILYTAGTEDSPDIEWARKVADHFGWALRERTFEVEDVRDAVKRVMYAIEEPNPMNLAIGLPLYFASGLASSDGTRVLLSGQGADELFGGYAKYLERPELMEEDIALISERNLARDDKITMLNGVEGRYPFLALPVVSFALKLPLEAKIVDGTRKVILRKLALRLGIPEWIAEREKRAAQYGSRAQKLLEKIAREEGLTLREFAEKLFRETFPNAF

SEQ ID NO: 18713 - protein, 162 aa, Thiobacillus denitrificans ATCC 25259
MRRITHFFGSLFLVELLRGMMLTGRHLFARKVTVQFPEEKTPQSPRFRGLHALRRYPNGEERCIACKLCEAVCPALAITIDSEQRADGTRRTTRYDIDLTKCIFCGFCEESCPVDSIVETRILEYHGEQRGDLIYTKPMLLAIGDKYEAQIAQDRAQDAKYR

SEQ ID NO: 18714 - protein, 163 aa, Rhodospirillum rubrum ATCC 11170
MNIIEQFEKEQIEKLLEQRGVPQFSPGDTLRVHVKVIEGNRQRVQVYEGVCIARRNAALNSSFTVRKISFGEGVERIFPLYAPTIDRIEVVRRGKVRRAKLYYLRGRQGRSARIIEDTTATQQALAVEREISQERKASGKDQASKPEVRPQGKKPAPKPKAKK

SEQ ID NO: 18715 - protein, 486 aa, Prochlorococcus marinus str. NATL1A
MKKKKLNLTKERISFGTDGWRGILGVEFTLERLLKVAAAAAQELDYVEEKNNNKIIIGYDRRFLAEEMAEAVASAVRGVDLVPLLASSALPTPSCSWGIVEENALGALVITASHNPCEWLGLKIKGPFGGSVDSSFTDSVQKRLDAGGISIPIEGVTEKVDFRKQHLLGISQEFDMHLIADGLRKLGVKIFVDPMHGSAAGCMSELFGVDSEELIYEIRTERDPSFGGNPPEPLKAYLSQLIQEVQDESQAGKLSMGLVFDGDGDRIAAIDEKGRYCNTQLLMPVLIDHLARVRNMPGCVVKTVSGSDLMRLVAEDLGREVLEKPVGFKYIAEEMLSREVLIGGEESGGVGFGHHLPERDALFTALLLMESIVADGKCLGEKIDSLHARFGKSHFERIDLTLKDMEMRRSLEDFLKQKTPSSIGHKSVLEVISTDGIKLILDKSHWLMFRFSGTEPLLRIYCEAPSSAEVTSTLYYAKQLIDNSFG

SEQ ID NO: 18716 - protein, 225 aa, Arabidopsis thaliana
MVMETESKFHVLAVDDSLFDRKMIERLLQKSSCQVTTVDSGSKALEFLGLRVDDNDPNALSTSPQIHQEVEINLIITDYCMPGMTGYDLLKKVKESAAFRSIPVVIMSSENVPARISRCLEEGAEEFFLKPVKLADLTKLKPHMMKTKLKKESEKPVAIEEIVVSKPEIEEEEEESSVIEILPLHQEIESEQLEPMLSSNKRKAMEEVVSTDRSRPKYNDITTSV

SEQ ID NO: 18717 - protein, 1467 aa, Yarrowia lipolytica CLIB122
MAHYYPSGVSSVGNFDSLDVEIRSLAEGMVHKPHHRESRYIFDHTFDDEFREEHEDEYDYDMLRKTSFENPDVNPYVEASAEPELDPWSGEFNSRKWIKTVLGLKERFGNSKGITAGVSFKNLGAYGYGSRSDYQKTFLNVIVATGDLLRSAIGAKRTSKIQILRKCDGLVLPGETCVPRDVMTKHCRGEIVYNAEHDIHFPHLTVGQTLMFAALARTPRNRVLGVTREQYARHTRDVTMATLGLSHTINTKVGSDLVRGVSGGERKRVSIAESVVCGAPLQCWDNSTRGLDAANATEFIRSLRLSAQMTGASMFVSLYQASQEAYDMFDKVCLLYEGRQIFFGKAGEATSYFEGLGFERAHRQTTGDFLTSLTNPVERRIKAGWEKLVPRTPEEFESRWRSSRTHALLVYNIDRFNTTHPLGGQGYVEFMKLRKESQARNTRLSSPYLLSWPMQVRLCLWRGFLLVRGDLSMTLMTIIGNFIMALILASMYYNLRESTDAFFSRSALLFLAMLLNAMASVLEIFVLYGQRPLIEKHKRYALYHPFAESIASMLVDLPTKLATLISVNLALYFMTNLRRTPGAFFIFLLFSFTCTMAMSMIFRFTASVTKTMEQALAPASVLVLALVIYTGFTLPVDYMHGWARWMNYLNPVAYAFEAVMVNEFRNRRFPCGLYVPSRSFYNSVPAESKSCVAIGAKLGQDYVDGSVFISTAYKYETGHLWRNLGILWAFAGFFCGVYLLAAEYVTMAQSKGEVLLFKRSQHRKNLKAKPDKRFQDVELGDNLGDHNLDQNLGDNHSTYSYQQPIQAQHSGVFQWTDVCYDIKVAGENKRLLDHIDGYVKPGTLTALMGASGAGKTTLLDVLADRKSTGIVHGDMLVNGQQRNASFQRKTGYVQQQDLHTATATVRESLEFSALLRQPSSVSRADKLAYVDEVISILEMDSYADAVVGVPGEGLNVEQRKRLTIGVELAAKPELLLFLDEPTSGLDSQTAWSIVSLLKKLAANGQAILCTIHQPSAILFQEFDRLLFLAAGGKTVYYGDLGDKASLLIEYFESNGADPCPDNGNPAEWMLEVIGAAPGSRAKKDWPSVWRYSQLRRQQREELDDMRLAFNADSQAALAVGGEDTDFAVSQWTQLYYVTKRLLQFHWRTPSYLWSKMTLCIGCALFIGFSFYKSARDIQGLQNQMFSIFLMFLIFTTVAEQIMPLFMIQRDLYEARERASKTYSWQVFLGGNMLAELPWQIIVAVVVFFCMYYPIGFYRIAAENHQTQERGALYFLFLLVFFIYDSTYAHMIGVMFNNHETAANFAYLLFSFCLMFCGVLATKESMPGFWIFMYRASPLTYFIGGFMATGLAGGKVTCSQHEILQFKPLKGNSCAQYMKPFLDNAGIFKGYLLNETATDMCHYCPIENADAYLDNASIFYGDRWRNFGIVFAYPIFNVCATFMLYYVLRVPGVRYKIASKVRWRRKKQ

SEQ ID NO: 18718 - protein, 252 aa, Lactobacillus plantarum WCFS1
MQPAIKLRNIELGSCRPKLAVPITGTTINDILAATTPILAAQPDVVEWRIDFFKDVTNPEQLKSAGQQLRQALGDIALLTTFRTKGEGGELALSDTEYFKLCETVLDGGFTDALDVERYHDEQAVKQIVAAAHEHQVVVIMSNHDFDKTPAVAEIVKRLTSMVDYGADVAKMAVMPQSVEDVLTLLTATNIARQTLPQPVITMSMGDLGKVSRLAGEVFGSCLSFATVGAASAPGQIALENLRPELEDLKLN

SEQ ID NO: 18719 - protein, 434 aa, Corynebacterium glutamicum ATCC 13032
MGVTEQPYTLIIGGGQGGIALGARLKRLGVPALIIDKASRPGDQWRSRYHSLCLHDPVWYDHLPYIPFPDHWPVFTPKDKMGDWLEHYVGIMDLDYWTNTECLRASYNEDTKQWDVTVNRDGAESTLHPTQLVMATGMSGSPNKPTLPGQDKFQGEIRHSSEHPGGDVDRDKNVVVLGANNSAHDICADLYSNGAKPVMIQRSSTHIVRSDSLMREVFGPLYSEDAVEAGIDTDTADLLFASWPYKVLPGVQKQAFDKIREDDKEFYDKLENAGFLLDFGDDDSGLFLKYLRRGSGYYIDVGASELVADGKIPVRSNVSIEDVKENSVVLTDGTELPADVIVLATGYGNMNNWVAQLVDQETADKVGPCWGLGSETTKDPGPWEGELRNMWKPTNVDSLWFHGGNLHQSRHYSRYLSMQLKARYEGMNTPVYSK

SEQ ID NO: 18720 - protein, 277 aa, Bacillus anthracis str. A2012
MKKSEMEESRMWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEIAHKKIDDFPDVPLLLMQACEDKLVDKTRVRTWFNNVKISDKAFKEWPNCYHELLNEYERDEILNYIQSFTEIRINNIIETNK

SEQ ID NO: 18721 - protein, 163 aa, Ralstonia solanacearum GMI1000
MLLAIKEFFNSLLLKELFKGLALTGRYLFARKITVLFPEEKTPLSPRFRGLHALRRYPNGEERCIACKLCEAVCPALAITIESDQRDDGTRRTTRYDIDLTKCIFCGFCEEACPVDAIVETHILEYHGEKRGDLYFTKDMLLAVGDRFEPEIAANKAADAKYR

SEQ ID NO: 18722 - protein, 417 aa, Ralstonia solanacearum GMI1000
MADIKNYTLNFGPQHPAAHGVLRLVLELDGEVIQRADPHIGLLHRATEKLAEQKTWIQNVPYMDRLDYVSMMVNEHAYVMAIERLLGIDVPLRAQYIRVMFDEITRIMNHLMWIGAHALDVGAMAVFLYAFREREDLFDMYEAVSGARMHAAYYRPGGVYRDLPDSMPQYKASKVRNEKALAAMNETRSGSLLDFIEAFTDRFPTYVDEYETLLTDNRIWKQRLVGIGVVTPERALQKGMTGPMLRGSGIAWDVRKKQPYEVYDRVDFDIPVGVNGDCYDRYLVRVEEMRQSNRIVRQCVEWLRKNPGPVITDNHKVAPPSRVEMKTNMEELIHHFKLFTEGMHVPEGEAYAAVEHPKGEFGIYVISDGANKPYRLKIRAPGFAHLAALDEMAKGHMIADAVTIIGTQDIVFGEIDR

SEQ ID NO: 18723 - protein, 82 aa, Cryptococcus neoformans var. neoformans B-3501A
MTASTTASQTEMEAARVPLGWRDQCSALLIPLNVCRHKELYMPWKCEDERHGYEKCQYDDYIRRMKQLTRQKKEAAEAAAEE

SEQ ID NO: 18724 - protein, 666 aa, Arabidopsis thaliana
MCLNTLCAILCFVLTVSFGFVSAQKCGESVFFRPNGNYDTNRRLVLSTLASNVSSQNNRFYNVSVGEGAGRIYALGLCIPGSDPRVCSDCIQLASQGLLQTCPNQTDSFYWTGDNADKTLCFVRYSNNSFFNKMALEPTHAVYNTMRFQGNLTAYTRTWDAFMNFMFTRVGQTRYLADISPRINQEPLSPDLIYALMQCIPGISSEDCETCLGKCVDDYQSCCNGFIGGVVNKPVCYFRWDGYKYYGAFGDEAPSQPPTPLPLPPPPPRDPDGKKISTGVIVAIVVSAVIFVVLVALGLVIWKRRQSYKTLKYHTDDDMTSPQSLQFDFTTIEVATDNFSRNNKLGQGGFGEVYKGMLPNETEIAVKRLSSNSGQGTQEFKNEVVIVAKLQHKNLVRLLGFCIERDEQILVYEFVSNKSLDYFLFDPKMKSQLDWKRRYNIIGGVTRGLLYLHQDSRLTIIHRDIKASNILLDADMNPKIADFGMARNFRVDQTEDQTGRVVGTFGYMPPEYVTHGQFSTKSDVYSFGVLILEIVCGKKNSSFFQMDDSGGNLVTHVWRLWNNDSPLDLIDPAIKESYDNDEVIRCIHIGILCVQETPADRPEMSTIFQMLTNSSITLPVPRPPGFFFRNRPNLDPLTYGSEQGQSSSMSVPFSIDSASITRATPR

SEQ ID NO: 18725 - protein, 348 aa, Arabidopsis thaliana
MAASKLLVSDIASVVDHVPSNYVRPVSDRPKMSEVQTSGDSIPLIDLHDLHGPNRADIINQFAHACSSCGFFQIKNHGVPEETIKKMMNAAREFFRQSESERVKHYSADTKKTTRLSTSFNVSKEKVSNWRDFLRLHCYPIEDFINEWPSTPISFREVTAEYATSVRALVLTLLEAISESLGLAKDRVSNTIGKHGQHMAINYYPRCPQPELTYGLPGHKDANLITVLLQDEVSGLQVFKDGKWIAVNPVPNTFIVNLGDQMQVISNEKYKSVLHRAVVNSDMERISIPTFYCPSEDAVISPAQELINEEEDSPAIYRNFTYAEYFEKFWDTAFDTESCIDSFKASTA

SEQ ID NO: 18726 - protein, 413 aa, Thermococcus kodakarensis KOD1
MKAVILAGGFGTRLRPISSTRPKPMVPVLGKPNLQYLLENIEKIPEIDEVILSVHYMRGEIREFIDEKMADYPKDIRFVNDPMPLETGGALKNVEEYVSDDFLVIYGDVFTNFNFRELIEAHRNNDGLITVAVTKVYDPERFGVVETDENGKVTHFEEKPHRPKTNLVDAGIYVVNKKVLEEIPKGKEVYFEREVLPKFVARGEVYAYRMPRDAYWVDLGTPDDLFYAHQIAMDEIAKDNGYITIKEGAEVPDDVEIQGPVYIDEGAKIGHGVKIKAYTYIGPNTIVEDKAYLKRSILIGSDIIKERAELKDTILGEGVVVGKNVIIKENAVVGDYARIADDLVIYGAKVLPWKKVEEYEAYIKVKLDPTKVRPGQYPDHCPLGLPECIYKKFKAIAGEKPPCDECIENQWLF

SEQ ID NO: 18727 - protein, 294 aa, Lactobacillus plantarum WCFS1
MAERIDGHTLLIGLMAYPIRHSMSPTMHNNAFAKLGLNYAYLAFEVTNETLPSAIESIRTLDMRGSNISMPNKQKVIPLLDKLDPAAKMVGAVNTIVNDDGVLTGYTTDGIGFMKALADEGLDIREHKMTLAGAGGAGTAIAVQAALDGVKEISIFNMHDATWANAERNVKLINEQTDCHATLHSLEDRDDFKREIQSSYIYTDSTGVGMKPLEDKTLVDDPSWFSSDQIVFDTVYAPRTTKLMKVARQAGLKHVYNGLGMMLEQGAAAFKLWTGEDMPVDYIHQILFSDDQDK

SEQ ID NO: 18728 - protein, 137 aa, Campylobacter jejuni subsp. jejuni NCTC 11168
MEKTLSIIKPDAVKKGVIGKILDRFESNGLRIAAMKKVQLSKEQAENFYAVHKERPFFKDLVEFMISGPVVVSILEGEGAVLKNRDLMGATNPKEAKAGTIRADFAESIDANAVHGSDSLENAKIEIEFFFKPNEIC

SEQ ID NO: 18729 - protein, 369 aa, Brassica napus
MSAIHLLRKLSRRPPSRLHRNLLSSTFSMDLPPDLARTTLIRPFSNRPTIFNNTHRLIPSCFRQLNLLPNWVSEKKKSISVSLREFSISVVETNTSDKTFERVVGLNPNPLVIERIHNGEKTIGESVSGGEIIGNEIEKSEETLVREESEAEKEAWRILEDAVVRYCGSPVGTVAANDPGDKLPLNYDQVFIRDFVPSALAFLLKGEGEIVRNFLLHTLQLQSWEKTVDCYSPGQGLMPASFKVRTVALDENTTEEVLDPDFGESAIGRVAPVDSGLWWIILLRAYGKLTGDFSLQERIDVQTGIKLIMNLCLADGFDMFPTLLVTDGSCMIDRRMGIHGHPLEIQSLFYSALRCSREMLSVNDSSSNL

SEQ ID NO: 18730 - protein, 341 aa, Oryza sativa (japonica cultivar-group)
MGGRASAAAAVAAFGRRAARLRSWQIRPVPAWILRAVRFPPRFFLWRESDVGFKEFLASDLIPPRRDLPFVVAPLHFDCVEQVGCSIQRLLRYLAELLAERHKLSPFIPVLPNSVRLLNQEILRVSTLLENASLLNQSGLEHGSPLTTGGLYSNGAAADMNGWTSAFQSEGSPAYSWRGGSQGSSSGLIVKKTMKVDIPVDKYPTFNFVGRILGPRGNSLKRVEATTDCRVLIRGRGSIKDPAREDMMRGKPGYEHLNEPLHILVEAELPVEIIDTRLIQARDILEDLLKPVDESQDFFKKQQLRELAMLNGTLREEGMQRSGSASPFHNSLGMKRAKTRG

SEQ ID NO: 18731 - protein, 248 aa, Bacillus licheniformis ATCC 14580
MEFNQQTAIITGASRGIGRAIAELLADKGANVVINGTNEELLKSLCTQLNTERKCASYVAGDASLPETASLLIAEAKQRFGRIDILVNNAGVNLRKTTVDTSLEEWKRVIDLNLTGTFLMCQAVIPEMITQGGGKIVNMSSTTSKTPHHNASPAYGASKAGINYLTMHLAKELAEHRIHVNGVCPGPIETDMSKQWSEEYRAAVVERIPLKMLGSPEHVANVVAFLASDKSDFMTGETININGGTYMN

SEQ ID NO: 18732 - protein, 388 aa, Yarrowia lipolytica CLIB122
MQGWRVTMEDAHATVLELKDAKGQPEKKKVAFFGVYDGHGGDKVAIYTGDNLHHIVARQEAFAKGDYGQALKDGFLSTDRAILEDAALKHDSSGCTATTAIVSDGKVICANAGDSRTVLGVKGIAKPMSFDHKPQHEGERTRICAAGGFVEAGRVNGNLALSRAIGDFDFKRSPYFPPEEQIVTAYPDVIEHQLTADDEFLILACDGIWDCFLSQEVVEFVRRGIAEKQTLVDICENLIDNCLAPTSDLSGVGCDNMTVMVVALLQGKTEEEWYNMVAERVKNGEGPAASREAVERVAGEEREVTAQQLQQNAQAQQANSASLALQQLLSSGATITDENGMVVLKAENAAELLAKVGFAPEDVGQLVESGDLVEEDVEVGGDRITEEQ

SEQ ID NO: 18733 - protein, 294 aa, Lactobacillus plantarum WCFS1
MEARIDGHTTMLGLFGSPVGHSGSPAMYNYSFEKAGINDAYLAFDIQADEMASALTKMRVLNMRGANVTMPCKKVAAELVDELSPAAELIGAVNTIVNNDGVLVGHNTDGAGYVENLRQHGVDPQGKRLTVLGAGGAATAIAVQMALDGAQAIHIFNPKDSFYQNAELTAQKIMDKVPACQVTVGDINDQEVLTQAIAQSDILANATKAGMAPNVEQTNIKDMTVFRSDLVVTDTVYNPATTKMLADAAEHGSKTIGGKGMLVWQGAAAFKLYTGQEMPVEEVTQRFFSDDGGR

SEQ ID NO: 18734 - protein, 444 aa, Prochlorococcus marinus str. MIT 9313
MSNLLLFEVAPVTSSPLREFPCSEALLEEALNLIPLASQTFSKSVSQLPRGVSPLFVDRADGARFWDVDGHSFIDLTNGLACVTLGYRHPAVDEAVRSQLQSGVSFSLPHKLELQVAKLIIEMVPCAEMVRFAKNGTDATSGAIRLARHCTKRDRIALCGYHGWQDWSIGTTSRNGGVPKGVSDLSHTFIYNDIDSLKNLLNRYPDEFAAVILEPMNITWPEPGFLETIKSIAHQHGALLIFDETITGFRFSNGGAQELFGVIPDLSTFGKGLANGFPLSALVGRSSFMKEISNIFFSGTFGGETLSLAAANAVLLQLLNNNVTDKLSSIGSQIADGVNHLINHYSLSHVFSLSGHPSWKIWSINDHYDATAWEIRTFLFQELYARGMFTIGSHNISLAHLDFVDEILDTYSQVLSLLSSSLTTKGGVRHSLRCKPIEPLFRVR

SEQ ID NO: 18735 - protein, 542 aa, Arabidopsis thaliana
MMISEKPLGVEESIRQDLEVLTVSRRLVKSVSQKLKKKIHKTEVVEDEEIARGAVNCLSISVGCRVADTGEDFEDSSNKRWSSASEEGKGLMTICGTEETRLDCFSYGVRERFWKKNNRKYLADSGQDYRKHVYLPDDILEMCLMRLPLTSLLNAHLVCKKWQSMANTQRFLQMRREGSFQTPWLFLFAALKDGCSSGDIHGYDVSQDKWHRIETDLLKGRFMYSVTSIHEEIYIVGGRSMDRNSFKSHRGILVFSPSIKAWRKIASMRHARSLPIVGATEVTSEFSTMQTKQNRQDRRFHLSRVGGESDVYEDPHRLSVRRQNRNSADQNGTKSHRLIRQKLDRLNRNSSKRFVLIAIGGTGLFDEPLDSGEIYDSATNTWSEMQRLPMGFGVVSCGIICNGIFYAYSENDKLSGYDIERGFWITIQTSPIPPRVHEFYPKLVSCNHRLFMLSVSWCDEGDGQIGRRNKAVRKLWELDLVYLTWTEVSVHPDAPMDWNATYVSDQNILMGIEMFKIFGQDSSKLIDSCIEKKCNVLVPRLI

SEQ ID NO: 18736 - protein, 226 aa, Zea mays
MATSSDGGGDQRRLLSIPKEGERIIAPTRRPDGTLRKAIRIRAGYVPQEEVAIYQSKGALMRKSGPDVPPGYDPALVADAKPKTKAAKRNERRKEKRQQQASLANDKGKSMNIEGTDAGETDKVLSSKTDKQKDSVESVTKQMSGIAISESHAMPSTNTINNSQPESSAPDIDKKIRALKKKIRLAEAQVQGDPEKLKSETLEKIKKIDGWCMELKLLEDSRAPAA

SEQ ID NO: 18737 - protein, 294 aa, Lactobacillus plantarum WCFS1
MEKRISGTTGLFTLLGSPVGHSGSPAMYNFSFQEQGLDYAYLAFDVKKAQMPEAIDAIRLFKVRGSNVTMPCKGVAATLVDELSPAAKIVGAINVIVNDNGKLTGHITDGIGFVRNLKENGVDIAGKKLVVIGAGGAATALQVQCALDGAKSLAIFNREDDFYANAENTQKKIKEAKPEVDVNVYHLEDQDKLKAEIEKADILVNATIVGMKPLDGQSLVDPSYLRSDLVVADTVYNPLKTKLIEDAEALGCTVAPGKGMLLWQGDAAYTLFTGKAMPTAEYQAYEARQAAKRH

SEQ ID NO: 18738 - protein, 300 aa, Bacillus licheniformis ATCC 14580
MKVEGIIPAILTPLTKEQAFHPGAAEKLVNRLIDSGVHGIFALGTNGEFHLFSQEEKLQIAETVVKAVNKRVPVFIGAGENSTEATISLFNQMADLGADVLSIITPYFVAPSQEELYQHFRTISENVALPVLLYNIPSRTGVSLEPETVERLAALPNIIGIKDSSGSFANIKAYLERTKEQSFSVLAGTDSLILDTLKAGGTGAVAATANVFPHTVVSIYESFKQGNIEESEHYQQQLQPLRDTFSLGSLPAPLKKAAELAGIDVGPPKRPIAELSGEPLLKVKKMLEGYGIEAKLAKEQ

SEQ ID NO: 18739 - protein, 520 aa, Tuber borchii
MGFIIKRPEGESGKALPAILIGLFVAFGGILFGYDTGTINGILAMDFFQSEFATDGRKELTSSQTSLIVPILSAGTFFGALCASPFGDILGRRMGLIASCLVFSIGVALQVAATAIPLMAAGRVIAGLGVGLVSALVPLYQSESAPKWIRGSIVGCYQLAITIGLLLAACANQGTHARNNHGSYRIPLAIQFVWAAILAGGMFILPETPRYYIKKDNMEAAAKSMSRLRSLPADHPAIIEELNEIKAIHDLEMQATGEATYLDCVKPDMIKRLLTGCGIQALQQLTGINFIFYYGTQFFKNAGIKNAFLIGLITNLVNVISTFPGLWMVEKMGRRNLLLFGAIGMCACQFIVAIVGITTVSAIANNVLIAFVCFYIFFFACSWGPCSWVVTGEIYPLKVRAKCLSISTATNWLLNWAIGFSTPYLVAEGPGKPNLGTKIFFVWGSCCFLCIAFVYLFIYETKGLSLENVDQLYMTVGHAWESKKFTPSVSYNSDKMLSNGHGADGKSSELAHIEGGHGEV

SEQ ID NO: 18740 - protein, 470 aa, Triticum aestivum
MEFTEAYKQTGPCCFSPDARFLAVACDYRLVVRDVVTLKVVQLFSCVDKINFLEWAPDSEYILCGLYKRPMVQAWSLSQPDWTCKIDEGSAGIAYARWSPDSRHILTTSEFQLRLTVWSLVNTACVHVQWPKHAARGVSFTKDGKFAAICTRRDCKDYINLLSCHSWEIMGVFAVDTLDLAGVEWSPDDSAIVAWDSLLEYKVLIYSPDGRCLFKYSAYESGLGVKTVGWSPCGQFLAVGSYDQSVRILNHLTWKTFAEFTHAASIRSPYNAAVFKEVDDPFQLDMSELCLSEGLSRNMRDNGTENGSEGGSRVKYAVMDVPITVPAQKPASDKPNPKQGIGMLSWSSDSHYFFTRNDNMPTVLWIWDICRLELAAVLVQKDPIRAAAWDPTCPRLVLCTESPHLYMWTPSGACCVNIPLPDFRIVDLKWNSAGSCLLLKDRDSFCCAAIVSALPEEEPDEQTDETSEDE

SEQ ID NO: 18741 - protein, 184 aa, Triticum aestivum
  misc_feature (112)..(112): Xaa can be any naturally occurring amino acid
  misc_feature (132)..(132): Xaa can be any naturally occurring amino acid
  misc_feature (148)..(148): Xaa can be any naturally occurring amino acid
  misc_feature (164)..(164): Xaa can be any naturally occurring amino acid
  misc_feature (170)..(170): Xaa can be any naturally occurring amino acid
  misc_feature (172)..(172): Xaa can be any naturally occurring amino acid
  misc_feature (175)..(175): Xaa can be any naturally occurring amino acid
  unsure (1)..(184): unsure at all Xaa locations
MAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQXATLFDLILAANYLNIKGLLXDLTCQTVADMIQGQTXRRISQDFNIKNDFTLXEEEEIXRXENXWPSNKEVWY

SEQ ID NO: 18742 - protein, 173 aa, Prochlorococcus marinus str. NATL1A
MTNDSEIVVEEKISGPISDWLSNKGFENIPLKEDHLGIEVIKISPNNLLSIVEALKNDGFNYLQCQGGYDEGPGLNIVCFYNLIEMNELKEDISPREVRLKVFLDRNGDLTVPSLYSLFRGADWQERETFDMYGVNFKGHPHPKRLLMPEDWKGWPLRKDYVQPDFYEMQDAY

SEQ ID NO: 18743 - protein, 248 aa, Ralstonia solanacearum GMI1000
MSARPKLVVGNWKLHGSLNGNAELLEKIKAAGQTRAALAVCAPFPYLAQCQSVLAGSSVAWGAQDVSAETRGAFTGEVAASMLSEFGCGYAIVGHSERRTYHGETDAQVAIKALRALEHGITPIVCVGETLAQREAGETELVVARQLEAVLESLSVEQLGHIVVAYEPVWAIGTGKTATSEQAQAVHAFLRGRVAACDAGVAQRMPILYGGSVKPDNAAELFTMADIDGGLIGGASLKAEDFLAIGRA

SEQ ID NO: 18744 - protein, 384 aa, Roseovarius nubinhibens ISM
MAKRDYYEVLGVARGASADEIKKAYRRKAKELHPDRNKDNPEAETQFKEAGEAYDVLKDADKKAAYDRFGHAAFEGGMGGGPRPGGGGHGQGDFASAFSDVFDDLFGDFMGGRGAPGGGRQRASRGSDLRYNLRVTLEEAFSGLQKNITVPTSVQCGSCNGSGAEGGGEPTTCPTCSGMGKVRAQQGFFTVERTCPTCSGMGQTIKNPCKNCGGAGRVEKDRALNVNIPAGVETGTRIRLSGEGEAGLRGGPSGDLYIFIEVSKHKLFERDDMHLFCHVPVSMSVAALGGDIEVPTIDGGRSRVKIPAGSQSGRQMRLRGKGMPALRSNTRGDMFIELAVETPVNLTARQKELLKEFDSLSEDNNPESKSFFSSVKTFWDSMKS

SEQ ID NO: 18745 - protein, 514 aa, Candida albicans SC5314
MSMYPQRTQHQQRLTELLDAIKTEFDYASNEASSFKKVQEDYDSKYQQQAAEMQQIRQTVYDLELAHRKIKEAYEEEILRLKNELDTRDRQMKNGFQQQQQQQQQQQQQQQQQQQQIVAPPAAPPAPPTPVTSLSVIDKSQYIVNPTQRANHVKEIPPFLQDLDIAKANPEFKKQHLEYYVLYNPAFSKDLDIDMVHSLDHSSVVCCVRFSRDGKFIATGCNKTTQVFNVTTGELVAKLIDESSNENKDDNTTASGDLYIRSVCFSPDGKLLATGAEDKLIRIWDLSTKRIIKILRGHEQDIYSLDFFPDGDRLVSGSGDRSVRIWDLRTSQCSLTLSIEDGVTTVAVSPDGKLIAAGSLDRTVRVWDSTTGFLVERLDSGNENGNGHEDSVYSVAFSNNGEQIASGSLDRTVKLWHLEGKSDKKSTCEVTYIGHKDFVLSVCCTPDNEYILSGSKDRGVIFWDQASGNPLLMLQGHRNSVISVAVSLNSKGTEGIFATGSGDCKARIWKWTKK

SEQ ID NO: 18746 - protein, 667 aa, Arabidopsis thaliana
MKQRSLFSVLCFFFISFGVASVSAQTCTTDKGTFRPNGTYDVNRRLILSSLPSNVTDQDGLYYNGSIGQQPNRVYAIGMCIPGSTSEDCSDCIKKESEFFLKNCPNQTEAYSWPGEPTLCYVRYSNTSFSGSADLNPRNWLTNTGDLDSNLTEFTKIWEGLMGRMISAASTAKSTPSSSDNHYSADSAVLTPLLNIYALMQCTPDLSSGDCENCLRQSAIDYQSCCSQKRGGVVMRPSCFLRWDLYTYSNAFDNLTVASPPPESPVTVPQPAGDQDNPTNNDSKGISAGVVVAITVPTVIAILILLVLGFVLFRRRKSNQRTKTESESDISTTDSLVYDFKTIEAATNKFSTSNKLGEGGFGAVYKGKLSNGTDVAVKRLSKKSGQGTREFRNDSVLVTKLQHRNLVRLLGFCLEREEQILIYEFVHNKSLDYFLFDPEKQSQLDWTRRYKIIGGIARGILYLHQDSRLKIIHRDLKASNILLDADMNPKIADFGLATIFGVEQTQGNTNRIAGTYAYMSPEYAMHGQYSMKSDIYSFGVLVLEIISGKKNSGVYQMDETSTAGNLVTYASRLWRNKSPLELVDPTFGRNYQSNEVTRCIHIALLCVQENPEDRPMLSTIILMLTSNTITLPVPRLPGFFPRSRQLKLVSEGSESDQYTSKSSSFSS

SEQ ID NO: 18747 - protein, 120 aa, Cucurbita maxima
MAVEGQVIPLRDAEEFDAIIDKEKESGRLIVIDFTASWCPPCRFIAPVFAELAKAHVHVTFLKVDVDNVKEIAKRFEVTAMPTFVFLKGGNEVHRIVGADKVELGVKVLELSAAPATCAS

SEQ ID NO: 18748 - protein, 429 aa, Burkholderia xenovorans LB400
MTMKNAELKSRKDAATPRGVGVMCDFYAERAENAELWDIEGRRFIDFAAGIAVCNTGHRHPKIVAAIRDQLDHFTHTAYQIVPYASYVELAEKLNERAPGDYPKKTAFFTTGAEAVENAIKIARAATGRPGVIAFTGAFHGRTLMGMALTGKVAPYKIGFGPFPSDVFHAPFPNPLHGVTTADSLKAIEFLFKADIDPKRVAAIIFEPVQGEGGFYPAPAEFVRALRKLCNEHGILLIADEVQTGFARTGKLFAMNHYDVVPDLMTVAKSLAGGMPLSGVIGRADVMDAAAPGGLGGTYAGNPLAVAAAHAVLDIIDEEKLCERATLLGDRIKAKLIALQSDVPQIADVRGPGGMVAVEFCKAGTTEPDAEFTKRVQSRALERGLLLLVCGVYSNVVRFLFPLTIQEAVFDEALAILEDVIKDSVAITV

SEQ ID NO: 18749 - protein, 486 aa, Burkholderia xenovorans LB400
MTTLTLKDPSLLKTHAYIAGEWQGADDGSTFEVKNPATGEIIATVPRMGTAETRRAIDTANAAWPAWRATTAKQRAVILRKWHDLMMENADDLAKILTTEQGKPLAEAKGEIQYAASFLEWFAEEGKRVNGDTIPTPANDKRIVVTKEPIGVCAAITPWNFPAAMITRKVGPALAAGCPIIVKPAEATPLSALALAVLAERAGVPRGVFNVVTGEPKAIGAEMTGNPVVRKLSFTGSTPVGRLLMAQCAPTVKKVSLELGGNAPFIVFDDADLDAAVAGAIASKYRNSGQTCVCTNRFYVHDKVYDAFAEKLRVAVEQLKVGRGTEDGVTQGPLINEAAVLKVESHIEDALAKGARIVTGGKRHVLGHGFFEPTVLADVTPAMKVARDETFGPLAPLFRFSSDEEVIRLANDTEFGLASYFYSRDIGRVWRVAEALEYGMVGINTGLISNEVAPFGGVKQSGLGREGSHYGIDDYVVIKYLCVGGI

SEQ ID NO: 18750 - protein, 284 aa, Pseudomonas syringae pv. phaseolicola 1448A
MTHAEKKSVLAGLIGSGIQASRTPAMHEHEGDAQGLRYLYRLIDIDALQLDISALPQLIESAQNCGFTGLNITFPCKQAVIPLLDELSAEARGIGAVNTVVFKGGKRIGHNTDCLGFAEGFQRGLDKAPRQQVVQMGAGGAGAAVAHALLSAGVECLTVFEVEPQRAQGLVDNLNEHFGAGRAKVGIDLPAAMAEADGLVNTTPVGMAKLPGTPLPVELLRPELWVAEIIYFPLETELLKHARALGCRTLDGSTMAVFQAVKAFELFSGQSADAERMMAHFHTL

SEQ ID NO: 18751 - protein, 342 aa, Corynebacterium diphtheriae NCTC 13129
MRIATLTSGGDCPGLNAVIRGIVRTCSEYGSTVVGYQDGWVGLMEDKRIQLYDDENIDRILLRGGTILGTGRLHPDKFKSGLDQIKANLEDAGIDALIPIGGEGTLKGAKWLSDNGIPVVGVPKTIDNDVNGTDYTFGFDTAVSVATDAIDRLHTTAESHNRVMIVEVMGRHVGWIALHAGMAGGAHYTVIPEQPFDIAEICKAMERRFQMGEKYGIIVVAEGALPKEGTMDFVEGGVDQFGHQTFNGIGQVIGEEIKKRLGHDVRTTVLGHIQRGGTPTSYDRVLATRYGVHAARACHNGDYGKMVALHGEHIDLIPLEDAVDTLKTVPEGRYRTARALFG

SEQ ID NO: 18752 - protein, 517 aa, Zea mays
MDKAYIAALSAAALFLLHYLLGRRAGGEGKTKGSQRRLPPSPPAIPFLGHLHLVKAPFHAALARLAARHGPVFSMRLGTRRAVVVSSPDCARECFTEHDVNFANRPLFPSMRLASFDGAMLSVSSYGPYWRNLRRVAAVQLLSAHRVACMAPAIEAQVRAMVRRMDRAAAAGGGGAARVQLKRRLFELSLSVLMETIAHTKTSRAEADADSDMSPEAHEFKQIVDELVPYIGTANRWDYLPVLRWFDVFGVRNKILDAVGRRDAFLRRLIDGERRRLDAGDDSESKSMIAVLLTLQKSEPEVYTDTVITALCANLFGAGTETTSTTTEWAMSLLLNHREALKKAQAEIDAAVGTSRLVTADDVPHLTYLQCIVDETLRLHPAAPLLLPHESAADCTVGGYDVPRGTMLLVNVHAVHRDPAVWDDPDRFVPERFEGGKAEGRLLMPFGMGRRKCPGETLALRTVGLVLGTLLQCFDWDTVDGAQVDMKASGGLTMPRAVPLEAMCRPRTAMRDVLKRL

SEQ ID NO: 18753 - protein, 71 aa, Glycine max
QLVYDLDMTKCICCGFCQEACSADALALGPDFEFATDTHEELLYDKEMLFEYDDRWETETAENLRSDSLYH

SEQ ID NO: 18754 - protein, 223 aa, Oryza sativa (japonica cultivar-group)
MGPRVVFMFIIAVMLLGDTSLAFDNAVGEKISNMETSLTMKVDPQLCQICEEFATEALFYLNENETQVEIIATLHQACSKFPSFKLECTKLVDYYVSLFFTKVTSLSPEEFCESVSLCHKVTFIRLPRHEDSCDLCHEVVDEILTDLENPDVELKIIEVLLKGCNNAENFVQKCKKLIIQNAPIILEHIKKFLKKRDFCNSIHVCGGKIIPARAGDLGALSAA

SEQ ID NO: 18755 - protein, 342 aa, Oryza sativa
  misc_feature (192)..(192): Xaa can be any naturally occurring amino acid
  misc_feature (248)..(248): Xaa can be any naturally occurring amino acid
  unsure (1)..(342): unsure at all Xaa locations
MEKLLSSSGAAAAVASQGQLPDCFVFPADRRPPASTAAVSLPVIDLSGPRDAVRRAVLDAGKELGFFQVVNHGVPPETMREMAAVCEEFFRLPAEDKAAFYSDAEENPNRLFSSTIYEVGDQRYWRDCLRLACGFPVADDTNTHWPDKPHHLRDVTEKFFVATRGLGIELLRLLCEGMGLRPDYFERDLTAXGDVIINVNHYPPCPDPSLTLGLPPHCDRNLITLLLQGDVFGLQVSYNGDWINVDPXVPDAFVVNFGHLLEIATNGVLKSIEHRAMTNSAVARTSVATFMMPPMDCLVGPAKELVGDGGQPQYRTVTFREFMRIYKTVGARRDSVEKAFKI

SEQ ID NO: 18756 - protein, 475 aa, Bacillus cereus G9241
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVVTILAFVVLGGSALLGFISYDGKEAAPLFSNFVSDGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 18757 - protein, 138 aa, Actinobacillus pleuropneumoniae serovar 1 str. 4074
MIQQTLCLIKPDATQRNLIGKILSHLEEAGLTIKALKKVQLNQEQAEGFYAEHQGKEFFAPLVEFMISAPIVAVVLEGENAIAHYRELMGATNPEQRKAGTIRALYAISGRENSVHGSDSEQSAKREIAYFFTPNEIL

SEQ ID NO: 18758 - protein, 126 aa, Synechococcus sp. RS9917
MITTTSSLLSQRALQRARQAMACLPFTWRFYQVLEEEALSSTALLERSDRTQFCQQPLTASRIEDDFIWLIQLGVLRREVDGQGLTERVRLTPMGRECLRCWTGAIPRASLPQRLHHWLRRYRPRL

SEQ ID NO: 18759 - protein, 890 aa, Idiomarina loihiensis L2TR
MSEELNKDVDQQETQEWLDALEGVLEAEGPERAHYLLEQLVDKARRNGAYLPYKPTTAYLNTIPASQEPTMPGNQTLESRIRSAIRWNAAMMVLRASQKGEELGGHLASFASSAMLYDVGFNHFFRAPNEDDGGDFLFIQGHVSPGIYGRAFIEGRLTEEQLNNFRQEVDGKGLPSYPHPNLMPDFWQFPTVSMGLGPIQAIYLARFLKYLTDRGIKDCSKQRVYCFLGDGETDEPESLGAIGLAAREELDNLTFVINCNLQRLDGPVRGNGKIIQELEGNFHGAGWEVIKVIWGRYWDPLLYRDTEGKLQQLMEETVDGDYQNFKAKGGKFTRENFFGKYPETEEMVANLSDEDIWRLNRGGHDPVKVYSAYHKAANTKGRPQVILAKTVKGYGMGAAGEGKNIAHQVKKMDLDAVKHMRDRFNIPFEDKELEDLPYYKFDDDSDEMKYLNERREKLGGYMPVRRPESDVELELPALKAFDAVLKGSGDREISSTMAFVRVLTALLKDKKIGKRIVPIIPDEARTFGMEGLFRQVGIYSHHGQKYTPQDKDQVAYYREDKKGQVIQEGINELGAMASWIAAGTSYSLNNEPMIPFYIYYSMFGFQRVGDLVWAAGDSQTRGFLVGGTAGRTTLNGEGLQHQDGHSMVHFGTVPNCISYDPTYGYEIAVIVHDGLKRMFGDQENVFYYLTVMNENYHQPEMPEGVEEGIIKGIYELDKVKAKNKAKGDVQLLGSGTILQQVREAATILSEEYDVNSTVYSVTSFNELARDGLDTDRWNMLNPEKKEKEAYITQVMKKAKGPAVAATDYIKLYADQVRAWVPTSYRVLGTDGFGRSDSRANLRKHFEVNPHYIVVAALKELADQGDIDKKVVAKAIKDYDIDTDKLNPRLA

SEQ ID NO: 18760 - protein, 338 aa, Glycine max
MGKVKIGINGFGRIGRLVARVALQRDDVELVAVNDPFITTDYMTYMFKYDSVHGHWKHHDVTVKDEKTLLFGDKPVTVFGHRNPEEIPWKSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 18761 - protein, 551 aa, Chlamydophila caviae GPIC
MHPNSSDLNGVIIPGTPPLPRELQKFPSLVATSDQRFSPKFDADVAKLFPNTYDSPYLKFTSGTLPTLQPLKVGVMLSGGPAPGGHNVIWGLLHSLKKIHPDSSLIGFLDNGQGILNNNTVEITEEFMECFRNSGGFNCIGTGRTNIITEENKAACLKTVKALNLDGLVIIGGDGSNTATAILAEYFSQHHPKTCVVGVPKTIDGDLQHLFLDLTFGFDSATKFYSSIISNISRDTLSCKAHYHFIKLMGRSASHIALECTLQTHPNITLIGEEIAEKNVPLKTIIHKVCSIIADRAAMGKYYGIILIPEGIIEFIPEINNLVKEIERLPENADKFSSLSRESQKLLNSFPEAIANQLLNDRDAHGNVYVSKISVDKLLIHLVDNHLKKHFKNVPFNAISHFLGYEGRSCLPTKFDNTYSYALGYGAGVLTLNRCNGYLTVIESLINIVDKWRLRAMPIVKMFTTKKNSDGTIRPLIKKSLIDISSPAFVKFKLYRKIWALEDSYRFLGPLQIDTPPNAHSDHFPPLTLLLNHNEWQKRCSICMEIPDCDY

SEQ ID NO: 18762 - protein, 539 aa, Chlamydophila caviae GPIC
MELLSVNKSYFELQRLHYRPETLSFLNGITSLHIVDSTEPPAIPKNLQEHIPNLCSIPEVTIEKGEATPSQPLKIGVLLSGGQAPGGHNVVIGLFEGLRAFNPKTKLYGFIQGPLGLTRGLYKDLDISVIYDYYNVGGFDMLSSSKEKIKTKEQKSTILTTVKKLKLDGLLIIGGNNSNTDTAMLAEYFLKHNCTIPIVGVPKTIDGDLKNFWIETPLGFHTSCRIYSEMIGNLEKDTLSIKKYHHFVRLMGQKASYTTLECGLQTLPNVTLISEHIAMRKISLQKLSEHIAMGLVNRYRSGKNYSTILIPEGLIEHVFDTRKLVNELNVLLLDNNLNLDNVQSKLSPESLKTLSSLPIEIAHQLLIARDSYGNVRVSKIATEELLAALIKKEIQKIEPKMEFQPVNHFFGYESRAGFPSNFDANYGLALGIVSALFLVRQRTGYMVTINNLARSYSEWIGGATPLYKMMQLEHRLGEDTPVIKTDSVNPHAPEVQYLLNQSDACLMKDLYCFPGPLQYFGEERLLDQRPLTLLWGNRE

SEQ ID NO: 18763 - protein, 442 aa, Oryza sativa (japonica cultivar-group)
MVASAAAGASGEPQKKLPSWPSMVRDFATDESHGERGMSVLKLRLDGVRSAYDAAAAELETAKRAREDAEQELGGNQVQVAIAVVSIHGLEATISHLQEEISQVRSDLDALKGKGDIERDEFISQMDQLNTKIRKFQQMVSVELNGKKCSELSSGEGQQVTDWSEVIELEGSFEELNGNVSNADSERSLFEEQYEKDDHDKVTGKECHRKGFTFLRSTGKFESSDEGSTFSDDETILELLPLGPSTSRILVASTSVNNGQNIYASDQPLSTLPPLPDLEIPQRKGPLCIDGDANESDNDDTATTSSQGSYIELHTIQDEYVIGGPSWEAMIAPITGLALEEEEELMIEGQILLANDQKANRLITLFDEEERAMVRMLAALGQPLLTMGTFPTSRSFLLNLPLIFVCKEKDTECSICKSTLATKYRCHVHASLVNTYSICNAY

SEQ ID NO: 18764 - protein, 292 aa, Oryza sativa (indica cultivar-group)
MTTARFVSPSLSRVSPSPAGRVSGSSWLSRAGVALPARPHGLSLHLRPPAMASAAAAGNGSPSAPEDSTALSRIGEVKRVTKETNVHVKINLDGTGVADCSTGIPFLDHMLDQLASHGLFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRQLAGKNSHHIIEATFKAFARALRQATEYDLRRRGTVPRLQYSKETNGMASTAPRFLLTLGISVGCDNRT

SEQ ID NO: 18765 - protein, 441 aa, Triticum aestivum
MPATDSSASPAHHHHHTSFGRHILSLRHREHGQIHSAPPTPDHANTANPSSSPADREVDAFQRHAAELLLDLLPCSPDAAPADAKNAPPEILSIAWTQHLLDSFLICLEEFRSALLGGGPGALARPPLDRLVADFFDRAVKALDLCNALRDGLDLLRQWRKHLAIAAAALAPQGAASDPAAPLGEGQIRRARKALTDLTILMLDDKDAGGGGQRNRSFGRTGNGGKDAAGGQSRGHHRRSSSGSGSGSGGSHFRSLSWSVSRTWSASRQLQAIGGNLPVPRANDIAATGGLASAVYTMGAVLFVTAWALVAAIPCQDRGLQAHFAVPRSFPWAGPVTTLYERVLEESKKKDRKHSCGLLKEIHLIERWSRQLMEITDAAQFPLDKEKDAEVREAAQELVQVCEALKEGLDPLERQVREMFHRIVRTRTEILDCLSRPNTAE

SEQ ID NO: 18766 - protein, 408 aa, Thiobacillus denitrificans ATCC 25259
MAGGEGSRLQPLTADRCKPAVPFGSRYRIVDFVLSNLTNSDIRSIYVLVQYRPQSLIEHVRKAWTVTSLFADQFLTVVPPQMTKTSTVFGGTADAVYQSLDLMNMHRPDLVAIFGADHIYRMDVRQMVRFHCEHDAEATVAALPVSLNQASSFGIIETDAQNRIIGFDEKPKAAKPMPDDPDHAYASMGNYLFNADVLREALEEAHRRGETDFGRHVLPRLAQSHGVYAYNFATNEVPGTKRYEEQAYWRDVGTLDTYFDAHLDVLGLEPRFDAFNPQWPIYSSHYQGPTARVLRAELDNVLLGAATIVTGAKIRNSILRREVVVEPGAEIEDSVIMDYVCIGAGAKLRRVIIDRHNVVPPGARIGYDHDADRAAGYHVTEGGVVVAPLGDVRFYAREASRHSGGYSE

SEQ ID NO: 18767 - protein, 662 aa, Frankia sp. EAN1pec
MRVVRGLSRVLFVLVAALDGAGSTSVHRAGFIGWYIGRDAVAWVHRGLLVFFVAFSAILRPVPPHSAPRRDPTGASDARLHHAGRRRQVFGRVGARTARHTTALLRGRASNAMANTESTALAAGTVVDRTPEWAALAAHHAEISGVTLRKLFADDPGRADSFTVEADGLRLDYSKNIVTARTVELLLALARRAGLGARIEAMFGGERINVTENRPVLHVALRTPLGTSIHVDGVDVVPEVHAVLDRMSAFCDRVRSGVWTGATGEHITTVVNIGIGGSDLGPAMAYQALRDYSDRSIAVRFVSNVDPTDIWEATHDLDPARTLFIVASKTFTTLETLANARAARAWLTAALGQDAVAHHFVAVSTNAEKVAEFGIDTANMFEFWDWVGGRYSMDSAIGLALMVAIGPHHFREMLAGFHAMDVHFRNTPFERNLPVLLGVLGLWYRDFFGAQSHAVLPYSQYLDRFPAYLQQLDMESNGKSVDLAGRPVPVPTGPVVWGTPGTNGQHAYFQLLHQGTTVVPADFIGFLAPNHPGVGDVDQHVLLMANFFAQTEALAFGRTAEEVAAEGVDAALVPHRTFAGNRPTNTLLAPKLTPFALGQLVALYEHKVFTQGVVWGVNSYDQWGVELGKVLAGRIIPELADPSAPPRHDSSTNALINLFRSV

SEQ ID NO: 18768 - protein, 466 aa, Rhodospirillum rubrum ATCC 11170
MSDFDVVVIGGGPGGYVCAIRAAQLGLRVACVEKRPTLGGTCLNVGCIPSKALLQSSHLFDEANHGFAAHGITVGTLGLDMKTMMARKDEVVEANTKGIVFLFKKNKVTHVVGSARIAGAGQVVVSGEGGEQTLTTRAIVIATGSEVTPLPGVTIDEERIVSSTGALALAKVPKSLVVIGAGVIGLELGSVWRRLGAEVTVVEYLDHILPPMDGEVRKQSQRILEKQGLRFKLGRKVTAAERKGEGVSLTVEPAKGGEAETLEAETVLVAVGRRPFTDGLGLEEVGVEKTDRGFVKVDGDFQTAIEGIFAIGDVIGGMMLAHKAEDEGMALAEMLAGESAHVNYGAIPSVVYTWPEIAGVGKTEEMLKKDGVAYKVGKFPFTANARAKANGDTDGFVKILSNAETGRVLGCHIIGAQAGDLIMEVVLGMEFGASSEDIARTCHAHPQLGEAVKEAALAVNKRTIHM

SEQ ID NO: 18769 - protein, 812 aa, Triticum aestivum
  misc_feature (165)..(167): Xaa can be any naturally occurring amino acid
  misc_feature (208)..(208): Xaa can be any naturally occurring amino acid
  misc_feature (386)..(387): Xaa can be any naturally occurring amino acid
  misc_feature (398)..(398): Xaa can be any naturally occurring amino acid
  misc_feature (401)..(401): Xaa can be any naturally occurring amino acid
  misc_feature (409)..(409): Xaa can be any naturally occurring amino acid
  misc_feature (419)..(419): Xaa can be any naturally occurring amino acid
  misc_feature (426)..(426): Xaa can be any naturally occurring amino acid
  unsure (1)..(812): unsure at all Xaa locations
MQCLTSLFVYVARLDNGNRGKVGAEASLEQWITSLPFITVGENKFSVNFDWAVDKLGVPGAIIVKNNHASEFFLKTITLDNVPGHGKVVFVANSWVYPQAKYRYSRVFFANDTYLPSKMPAALKPYRDDELRNLRGDDQQGPYEAHERVYRYDVYHDLGDSRQIXXXGSKEFPYPRRCRTGRKLSQTSPDRESRLLPLVQSIYVAREXLVGHLKKSDFRGYSLKALVEGIIPAIRTYVDLSPGEFDSFADILKLYEGGIKLPDIPALQEMRKRFPLQLVKDLIPMGGDYLLKPPKPQVIKQDEKAWMTDAEFAREILAGVNPMMITRVTEFPPKSTLDPSQYGDHTSTITEAHIGLSLEGLTVQQAVASNRLYILDHHDHMMPYLXXLNNLDDTFLYXTRXLLFLKGDXTLAPVAIELXTPLLQGXLTTAKSTVYTPASTGVEAWIWQLAKAYVCVNDYGYHQLVSHWLNTHAVMEPFIIATNRQLSVTHPVHKLLHPHYRDTMNINSRARELLVSAGGIIELTVFQRKYAMEMSSVTYKDWNFNEQALPDDLIKRGMAVRDPSSPHKVRLLLEDYPYAVDGLAIWTAIEQWVTEYLAIYYTSDSVLQSDVELQAWWKEVREVGHGDLKDAAWWPKMMTVAELVKACATIIWTGSALHAAVNFGQYPYAGYHPNKPSASRRPMPEPDTEEYALLARDPEKVFIHTITNQVQSIIGISLLEILSKHSSDEIYLGQRDTPEWTSDAKALEAFKRFGTRLEGIESQVVALNGNPQLKNRNGPAQFPYMLLYPNTSDHTGKAEGLTARGIPNSISI

SEQ ID NO: 18770 - protein, 339 aa, Corynebacterium diphtheriae NCTC 13129
MKLAVIGGDGIGPEVTAEALKVLNAVRDDIEVTDYDLGARRYLRNGELLADADLVSLREHDAILLGAIGAPGEVPPGVLERGLLLKMRFALDHHVNLRPSKLYPTATSPLANPGDIDFVVVREGTEGLYCGNGGTLREGTPHEIASEVSQNTRYGVERVVRDAFERAQNRKKHLTLVHKTNVLVNAGGLWQRTVNEIATEYPEVTVDYNHIDAATIYMVTDPSRYDVIVTDNLFGDILTDLAGAVTGGIGLAASGNIDATGVNPSMFEPVHGSAPDIAGQGIADPTAAILSAAMLLRHVGDESNAQRIEAAVTYDVAERPAGPVKTVEVGDRIVAALQR

SEQ ID NO: 18771 - protein, 475 aa, Idiomarina loihiensis L2TR
MSDKITTQVVVLGSGPGGYSAAFRAADLGLDVVLIERYSTLGGVCLNVGCIPSKALLHMTKHIEEAQHLAEEGIEFGEPKIDLDKLRKHKEKVVGQLTGGLGQMSKMRKVKVVNGYGKFTGSNTIKVEGDDGETEVKFDNAIIAAGSQAIKLPFIPHDDDRVWDSTDALELKEIPKKMLLLGGGIIALEMGQVYASLGSKVDVVEMTDQLVPPADADIIKNFNKQIKGRFENIMLNTKATNVEAKKDGVYVTFEGDKAPKDPVKYDAVLVAVGRAPNGNKIDADKAGVNVDDRGFIKVDSQMRTNVDHIFAIGDVVGQPMLAHKAVHESHVAAEVISGKKHFFEPKVIPSIMYTNPEVAWAGVTEKEAKEQGIEYDAVTFPWSASGRAIASNAQQGMTKLIFDKNNRIIGGSMCGTNAGELLGEVCLAIEMGCDAEDIALTVHAHPTLHESVGLAAEIQEGAITDMPNPKAKKKK

SEQ ID NO: 18772 - protein, 892 aa, Xanthobacter autotrophicus Py2
MNAPLASPPSVKTTCPYCGVGCGVKATPDGLGGALVEGDAAHPANLGRLCSKGAALGETVGLDTRLLHPLVRGTDGALARASWDTALDRIADGLKTVRDAHGPGAIAFYLSGQLLTEDYYAANKLAKGFLGTAHVDTNSRLCMSSSVAGHKRGFGSDTVPGSYEDLEAADLIVLVGSNTAWCHPVLFRRMEAARKARGTKFVVIDPRRTETAAEADLHLPLAHGADALLFSGLLAHLAQSPAFDADYVRDHTTGFDAALAHARAMAPDAEATARACGLAVEDVARFFALFTDTARTVTCYSQGVNQSVAGTDKVNAILNCHFATGRMGREGMGPFSLTGQPNAMGGREVGGLANQLAAHMGFSPEEVDRVRRFWDAPHMATREGHKAVDLFAAIGRGEIKALWVMGTNPAVSLPEADGVRAALKGLDLFVLSENVVHNDTAACHPHVMLPAAAWGEKDGTVTNSERRISRQRPFLALPGAVKPNWWALAQVASRLGFGAAFAWRGPADIFREHAALSGFENAGSRDFDISAFADLSDTAYQDFTPVQWPAPRGRPQGTPRLFADGGYFTADRRARFVSPAPVAAARASEAYPFLLNTGRIRDQWHTMTRTGLSPRLGSHILAPFVAVHPDDAAPLGLADGGLARVSSAHGAAVLEVKIDAGQKRGTLFAPIHWSGATSSHGRVGPLVHAVTDPFSGQPDSKATPATLAPFTAPFEGFVLSRRPLAMPQGLWWARAALEGGFGWRTAGSLGPDEWAQWVKAEGPADVAELVDGPSGLYRAAAFDADGRLDFAVFEGTAGRRVAWDALKGLLKEDTVSTADRRTLLAGRRAGAAAACGPLVCACFGVPRDAIVGAIRAGAHDAAMVGEKLKAGTNCGSCLPEIRRLLAETTVPA

SEQ ID NO: 18773 - protein, 207 aa, Triticum aestivum
MDSAASVAGAPPAVPPAVLCAAEEALAATESVGDHLAEMLAAAAEDPDAIAELPPLQRARAFLAVAHAATSLFSVRLRCSGINPDEHPIKKEFERLSLWQEKLNRLNEWDKAPLRPSTTVNTQAAARFIGRSLSHLTDDQKRGMQAISKGEGAGWSGRKRKSQPLPERKSVRAAAEEFLAKASQELIGYNGSGVKGPVRTVFDEDED

SEQ ID NO: 18774 - protein, 445 aa, Campylobacter jejuni subsp. jejuni NCTC 11168
MKLFGTDGVRGKAGEFLDSFLAMRLAMAAGIYFKDKSITNNILVGKDTRRSGYMIENAIVSGLTSIGYNVIQIGPMPTPAIAFLTEDMRCDAGIMISASHNPYYDNGIKFFDAHGNKLSEDIEKKIEEIYFDDKLIQASKVDMEKIGQAKRIDDVIGRYIVSIKNSFPKDLTLKSLRVVLDVAHGAAYKVAPTVFKELGAEVIVMSDKPNGLNINENCGALHPANLAAEVKRLRADVGFAFDGDADRLVVVDEKGEVANGDSLLGVLALYLKEQGKLQSSVVATIMSNGALKEFLNKHGIELDTCNVGDKYVLEKLKANGGNFGGEQSGHIIFSDYAKTGDGLIAALQFSALMLSKKKSASSILGQVKPYPQLLTNLKIAEKKDLDKIKGLKELKKDLENKNINTLFRYSGTENLIRLLLEARDIKLLEKEMKNVVEFFKKALNG

SEQ ID NO: 18775 - protein, 586 aa, Xanthobacter autotrophicus Py2
MGSDFTIDQKRYLEGFVSGAKAVQITRGAAPAGAPAAAAEPTGPDAASLKAMARFEAEGKKLSPEEKGKREELGLDAYPRMRTAAHEGVFPKGPDVLRWKYHGLFHVAPAQDSFMCRLRIPNGILTHWQFRGVADIASAHGGNYTDVTTRANLQIREIPATDGIAVLEKLVDLGLTAKGSGADNIRNVTGTPTAGIDPQELLDTRPLAKEWHHYILNNRDMYGLPRKFNVAFDGAGTIGALEDTNDIGFQAVEVKDGFGVAPGIWLRLALGGITGHKDFARDTGIVVRPDEASDVAAAIVRAFIDTGDRTDRKKARLKYVLDAMGFDGFLTLVEKKLGRPFTRLPAEAVAPRAEADRLAHLGVHAQKQPGLNYIGVGLPVGRMSVEQMHGLADIAARLGDGDIRLTVWQNLLISGVADADVAQACTAITALGLSTQATPLQAGLVACTGSKGCRFAAADTKGTARAILAHCEERLDLDGPVNIHVTGCHNSCAQHYIGDIGLIGARVAINDDGDTVDGYHLFVGGGFGADAAIARELYRDVKAEDAPAVVERLLKSWLAHREEGEAFAHFTRRMDPDALKALAEVA

SEQ ID NO: 18776 - protein, 406 aa, Xanthobacter autotrophicus Py2
MSEPLLIIGNGMAAAKLCEELSQRALGRYAVAVIGAEPHLAYNRVLLSEVLAGHMTAADAQMKPASWWRDRGVTLQYGTPAVAIDRTERAVVLADGRRLSYARLVLATGSHPIRLPLPGMDLNGVHTFRDLKDVEALLAAAAVPGTRAVVIGGGLLGLEAAVGLAGAGVKTSLVHLMDRLMERQLDPAAAGFLRRAVEGKDVEVLLQAASDAIEGDEQGRVTGLRLKDGRVVEADLVVVACGVIPNADLARAAGLEVKRGIVVDDTLATSDPAICAIGECAEHRGIAYGLVAPAYEQARVLAHRLAGEEARYDGSVMATNLKVSGVPVFSAGDVTGGEGTEDIVLTDRGLGVYRRLIVKDGLLVGAVLFGDTADGLFYLDLITQRTPITAMRADLAFGRDAIAAAA

SEQ ID NO: 18777 - protein, 267 aa, Bacillus cereus ATCC 10987
MWNYEAEEAKAVIVIVHGAMEYHGRYEAVAEMWNHNGYHVVMGDLPSHGTTSRNRGHIDSFDEYIEEVKLWVKEARKYRLPIFIFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEIAHKKIDDFPDVPLLLMQACEDKLVDKTRVRTWFDNVKISDKAFKEWPNCYHELLNEYERDEILNYIQSFTEIRINNIIETNK

SEQ ID NO: 18778 - protein, 364 aa, Rickettsia bellii
DISKVYSEADCFTYDPGFMSTASCRSTITYIDGDQGILRHRGYDIKDLAEKSDFLEVAYLLIYGELPNNKQYNDFTKKVAHHALVNERLHYLFQTFCSSSHPMAIMLAAVGSLSAFYPDLLNFFKEADYELTAIRMIAKIPTIAAMSYKYSIGQPFVYPNNSLDFTENFLHMMFATPCEKYKVNPVIKNALNKIFILHADHEQNASTSTVRIAGSSGANPFACVSTGIASLWGPAHGGANEAVINMLKEIGSVENIPKYIAKAKDKNDNFRLMGFGHRVYKNYDPRAAVLKETCKEVLKELGQLDNNPLLQIAIELEAIALKDEYFIERKLYPNVDFYSGIIYKAMGIPPQMFTVLFATARTVG

SEQ ID NO: 18779 - protein, 517 aa, Triticum aestivum
  misc_feature (240)..(240): Xaa can be any naturally occurring amino acid
  unsure (1)..(517): unsure at all Xaa locations
MDKAYIAVLTIAFLFLLHYISGKISNGRRGKGAVQLPPSPPVIPFLGHLHLVEKPFHAALRRLAARLGPVFSLRLGSRRAVVVSSAECARECFTEHDVTFANRPRFPSQLLVSFDGAALATSSYGPHWRNLRRVAAVQLLSAHRVACMSGVIAGEVRAMARRLFRAAAAAPGDAARVQLKRRLFELSLSVLMETIAQTKGTRSEADADTDMSVEAQEFKKVVDEIIPYLGAANTWDYLPXVLRWFDVFGVRNKILAAVSRRDAFLHRLIDNERRRLDHAGTEGDKKSMIAVLLNLQKTEPEVYTDTMITALCANLFGAGTETTSTTTEWAMSLLLNHPAALRKAQAEIDAAVGTSRLVTADDVPRLAYLQCIVSETLRLYPAAPMLLPHQSSADCKVGGYNVPSGTMLMVNAYAIHRDPAVWERPLEFVPERFENGKAEGRFMIPFGMGRRRCPGETLALRTIGMVLATLVQCFDWERVDGAEVDMTEGGGLTIPKVVPLEAVCRPRPAMRDVLQSL

SEQ ID NO: 18780 - protein, 439 aa, Brassica rapa
MLLESDGEMSLETTNSPISSGTESCSSFSRLSFDAPPSTTAIIPEEESCLSLKPHRSSDFAYAEILRRRKHSLTFRDFRLMRRIGAGDIGTVYLCRLAGDQEESRSSYFAMKVVDNEALAMKKKMHRAEMEKKILKMLDHPFLPSLYAEFEASHFSCIVMEYCSGGDLHSLRHRQPQHRFSLSSARFYAAEVLVALEYLHMLGIIYRDLKPENILVRSDGHIMLSDFDLSLCSDSIAAVESSSSTPENYPHSSPRRLTRLAKLFNRVLRSKKVQTLEPNRLFVAEPVTARSGSFVGTHEYVAPEVASGGSHGNAVDWWAFGVFLYEIIYGRTPFAAPTNDVILRNIVKRPLSFPTDSPATMFELHARSLISGLLNKDPSTRLGSRRGAAEVKVHPFFKGLNFALIRTMTPPEVPSDVRRPKKSATFGGRSSKPAAFDFF

SEQ ID NO: 18781 - protein, 417 aa, Candida albicans SC5314
MSLSNKLSVKDLDVAGKRVFIRVDFNVPLDGKTITNNQRIVAALPTIKYVEEHKPKYIVLASHLGRPNGERNDKYSLAPVATELEKLLGQKVTFLNDCVGPEVTKAVENAKDGEIFLLENLRYHIEEEGSSKDKDGKKVKADPEAVKKFRQELTSLADVYINDAFGTAHRAHSSMVGLEVPQRAAGFLMSKELEYFAKALENPERPFLAILGGAKVSDKIQLIDNLLDKVDMLIVGGGMAFTFKKILNKMPIGDSLFDEAGAKNVEHLVEKAKKNNVELILPVDFVTADKFDKDAKTSSATDAEGIPDNWMGLDCGPKSVELFQQAVAKAKTIVWNGPPGVFEFEKFANGTKSLLDAAVKSAENGNIVIIGGGDTATVAKKYGVVEKLSHVSTGGGASLELLEGKDLPGVVALSNKN

SEQ ID NO: 18782 - protein, 498 aa, Acidobacteria bacterium Ellin345
MAILLFISVLLISACGLIYELIAGTLASYLIGDSVFQFSTIIGSYLFAMGIGSALSRYIRSGLVHRFIWIELMVGLIGGFSSALLFLAFAYTQAFGLLMYTLVIVIGVLLGLEIPLLMRIVREKYDFRDTVAHVLTFDYIGALGASLLFPVLLVPKLGLVRSAMLFGIVNALVALWSTFLFGSELAKRTMLRAMSAIVLIALCAGMVNARKITAAAEDNIYADEIVFARDTRYQHIVLTRFKDDLRLFLNSHLQFSSRDEYRYHEALIHPGLSAVPVPRHVLVLGGGDGLAVREILKYPQVESITLVDLDPEMTKLFSTNPMLTALNKKSFLDPKVKVINADAFPWIDQSTESFDFIVIDFPDPTSYSLGKLYTTTFYRAVARHLSEQGFMVVQSTSPMFARDSFWCIAETLKQTGLKTYPYHVYVPSFGEWGFVLAGTHEYEAPTSLPQGLRFVSTATLPTLFQFPPDMAPMNVPANHLNDQVLVRMYDNDWKDISH

SEQ ID NO: 18783 - protein, 536 aa, Glycine max
MIKQILNRLPRKPSKSGESREGGAILTPSSTPSTSARSSDAAGYSHGNATASPLSGTADSNLVPGLNHGDRIVQAMNSKLNLNSYVGLPPYEALPSFRDVPNPEKQNLFIRKLQMCCVLFDFTDPTKNIKEKEIKRQTLVELVDYVSSANGKFTDVMMQEIVKMVSINLFRTFISPPRENKVLEAFDVDEEEPSMDPAWPYLQIVYELLLRFVMSTETDAKLAKRYIDHSFVLRLLDLFDSEDPRERDYLKTVLHRVYGKFMVHRPFIRKAINNIFYRFIFETEKHNGIAELLEILGSIINGFALPLKEEHKLFLVRALIPLHKPKCIPMYHQQLSYCITQFVEKDCKLADTVIRGLLKYWPITNSSKEVMFIGELEEVLEATQPAEFQRCMVPLFRQISCCLSSSHFQVAERALFLWNNDHIETLIKQNYKIILPVVLPALEYNARNHWNQAVQSLTINVRKIFADTDPEFYEEYMIKVRENEAQEKDMKSKREARWKRLEDMGGMKATTNEAVLVSPRTASHTPSGKASRAQLE

SEQ ID NO: 18784 - protein, 164 aa, Triticum aestivum
  misc_feature (133)..(133): Xaa can be any naturally occurring amino acid
  misc_feature (135)..(135): Xaa can be any naturally occurring amino acid
  misc_feature (149)..(149): Xaa can be any naturally occurring amino acid
  misc_feature (157)..(158): Xaa can be any naturally occurring amino acid
  unsure (1)..(164): unsure at all Xaa locations
ISGRARHVTRRRPHPPPKGQGEGRGIPNPKPRPSARPRLTRSRRPCPVPTTRSLARFHEIPQPAADSLPSPPGSRSALPAGLAGRGQWGKGPRGDGPSAAAPAGVAVAEEGEEDQFDRLPDAVLLDVFNRIGXVXALGRCALVSRRFHXLVPLVDSXXVRVDCV

SEQ ID NO: 18785 - protein, 172 aa, Synechococcus sp. CC9311
MDLHHYVQDIPDFPKPGILFRDISPMLRDPVGWAEVMDRLGVLCDSLKPDLIVGIEARGFIVGMGLATHKKLGFVPVRKPGKLPGKVYGIDYALEYGTDRLEIHADAMRGQPRILVVDDLLATGGTASATADLVKQAGGQLVGCAFIVELTELKGRGRLPGDIQVESLIHYS

SEQ ID NO: 18786 - protein, 210 aa, Brassica napus
  misc_feature (60)..(60): Xaa can be any naturally occurring amino acid
  misc_feature (88)..(88): Xaa can be any naturally occurring amino acid
  misc_feature (150)..(150): Xaa can be any naturally occurring amino acid
  unsure (1)..(210): unsure at all Xaa locations
MWKLCFCLPFLLLDIGVAKASASIYLPSQTGADGSSSPVCSSPDPKLNYRPVIGILSHPXGDGASGRLTNDTTSTYIAASYVKFAEAXVGARVIPLIYNEPEDVLFKKLELVNGVIFTGGWAKKYEYFDMVTKIFKKALERNDAGERHFXPIYGICLGFELMSIIVSQDRGILQRFDAEDNASSLQFVENVNIEGTLFQRFPPELLRKLS

SEQ ID NO: 18787 - protein, 391 aa, Glycine max
MSCLLMQSLKSHPALLFSLSNHFSFSSHSVRSFLSSFSTCQHSKESTSIIDYLNAKFDFSRTQSFYISKRVSSSRFPQNPLSVLSFFKQFGFSEAQILFLIRHKPQILFTDVDKILRPKIELFQLLGLERSELCKFISKNSSILTFSLKKTLVPSVEAIGKILCSEKDFVHVLLRCGRILPNYKKFMDNVVFLESCGIVGSHLAMLLKLQPGIFITRQSIIGDYVSRAVDMGFNENSRMLVHAIHSISSLSYKTFRRKLKLIICFGFSNEEGLQMFRRSPTLLRTSEKKVKVGLEFFLHTVMLPKSVLVHQPRVLMYSMEDRVLPRYRVFQLLIEKKLCKKVPSYIHLLCLSEEVFLDKYIPHFRENAEELLVAYKCICFSNKKCLLYIGI

SEQ ID NO: 18788 - protein, 665 aa, Lactobacillus plantarum WCFS1
MFDKVDELGVNTIRTLSIEAIQKANSGHPGLPMGAAPMAYVLWTKHLNINPKTHMNWVNRDRFILSAGHGSAMLYSLLHLAGYDVSIDDLKHFRQWDSRTPGHPEYGHTDGVEVTTGPLGQGFGMAVGMAMAEAHLAAQYNRPNFPIVDHYTYTIVGDGDLMEGISHEAGSLAGHLKLGKLIALYDSNGISLDGKTSQAFTENVGDRFTAYGWQHLVVEDGNDLDAIDAAIELAKKTTDRPSLIEVKTVIGYGAPKQGTNAVHGNPIGADGIKAAEKVYGWNYSDFEVPSAVSDRFEVTIQENGARAEQQWKRLFEEYEAKYPDQAQSFKQAFNGQFSDDLKSTLPHYQLTDALASRAASAKAINAAAKVIPSLWGGAADLSSSNKTMIAETSDFQPESYDGRNIWFGVREFGMAAAMNGIVLHGGTRVFGGTFFVFTDYLRAAVRLSALQHAPVIYVLTHDSIAVGEDGPTHEPIEQLASLRCMPNVQVIRPADGNETSAAWEQALKTTDKPTVLVLSRQALKTLPVSVDTAFAGVEKGGYVVSAAQKEIPDGLLIATGSEVNLALEAKAQLAKHNQDVAVVSIPSFDRFAQQSPEYRASVLPSAVTRRVTIEAGSTFGWDQYAGDHGAKIGVDRFGTSAPGDLVLDKYGFNVTNVVNTYLKLK

SEQ ID NO: 18789 - protein, 140 aa, Xanthobacter autotrophicus Py2
MNIIQTLEAEQAAKLAEKRAIPDFQPGDTIIVNVKVVEGERSRVQAYEGVCIARSGGGLNESFTVRKISYGEGVERVFPVYAPLIDSIKVVRRGKVRRAKLYYLRDRRGKSARIAERQDRTADGKIKKGGKSAPAPTAAE

SEQ ID NO: 18790 - protein, 324 aa, Idiomarina loihiensis L2TR
MMDMQSINALAKDDMLGVNALIGEQLQSDVALINQLGLYIVNSGGKRLRPLLAILACRALGYEGNDHRKLATIIEFIHTATLLHDDVVDESELRRGRKTANAVFGNEASVLVGDFLYTRAFQLMVDLDSLRILRILADATNIISEGEVLQLMNCNDPDTSEASYFNVIYGKTAKLFEAATELAGVLTAQDEKVTQQLADYGRYLGTAFQLVDDLMDYTADSESMGKNAGDDLAEGKPTLPLLYAMWHGNEIEQKLIREAIEQGDGREHLQTVLTAMERTGALQYTRDKALEAAEQARESLSELPDSDYKQALLTLTHLAVDRVA

SEQ ID NO: 18791 - protein, 384 aa, Brachylophon curtisii
DLEPVNPADVPVTAAGALKSYKLAAKAISRLQSLPSGNISMLCDVLVKEVRDLTGYDRVMVYKFHEDEHGEVVSECRRPDLEAYLGLHYPATDIPQASRFLFMKNKVRMICDCLAPPVKVIQDERLPQPLSLCGSTLRSPHGCHAQYMANMGTIASLVMSVTINEDDDMMDGDQRQMARKLWGLVVCHHTSARFVPFPLRYACEFLIQVFGVQINKEVELAAQVREKHILRIQTLLCDMLLRDAPVAIITQSPNVMDLVKCDGAALYYKKKFWLLGITPTEAQIRDIAEWLLEYHNGNTGLSTDSLMEAGYPGASVLGDAVCGMAAVSITSRDFLFWFRSHTAKEIKWGGAKHDPDDKDDGRKMHPRSSFKAFLEVVKWRSLPW

SEQ ID NO: 18792 - protein, 823 aa, Pneumocystis carinii
MDYLKKVRLWSEEEVGEWLESNNFGDYMDIFKENNINGDILLECNAAVLKELGVKKLGDRIRLSVCIKGLREKCIESARKSKMSFLMIDNQIQGFSFTLQSPTDPLIPVKSSELASPTSNFQLDNSYSDACCFDSLNNFHSVLSNISCSTKSISRNSSISTQKVFEKSPIFLETNVMQSDSIKKNCLKFIGEKGQTRIVNISLCYTADAILSKALKKFNITENPSEWRVFITNEDGSFECISNDTLLTISRQLSRPERERLILKRKSDPLTQEEFKKSQTIAREQRDAIYHTAVMAKTSGNLRKLETFFGEKLAPTLTSSFTTPLPSPLPKDNKYGNITHIRNFFGQRPPSELINSNLAEYFPGHEKKVLEQTIKNSIKSNHLNSFKGSNFDTPSSTLTYDLSSIPAVGEERIQYEGRRLSGVSHTLSLSRFISTRFPTLLESSILRENSSHHTLSSSSKLNSEGNTQDSKPSFRKKLEEKASSDETFKSESPNMLMEPSILSDFYDASLETDRDLLDDNIFENNEAKDFNTEKEIENNNSGPTRWIKGALIGSGSFGSVFLGMNALSGELMAVKQVEIPSIDIQGCKRKRAMLDALQREISLLKELHHENIVQYLGSSMDETHLTFFLEYVPGGSVTALLNNYGAFEEPLIRNFVRQILKGLNYLHNKKIIHRDIKGANILVDNKGGIKISDFGISKKVEANLLSMTRNQRPSLQGSVYWMAPEVVKQTLYTRKADIWSLGCLIVEMFTGKHPFPKMNQLQAIFKIGQYVSPDIPEHCTSEARHFLEKIFEPDYHARPTAADLLKYSFLGPMVSSPLTDAKK

SEQ ID NO: 18793 - protein, 328 aa, Medicago truncatula
MFVSLTRQSKSPDPSETEPPYFAIPCGDCLTFRMENRCPIYGPLTEELTFLEGSAPFNNCHASTIVEFDKDHFLVAYFGGTSEGAPDVKIWLQTCKNGRWESPVIADEQPNVPMWNPVLFKLPSDELLLFYKIGQEVQKWSGFVKRSYDKGNTWTEREQLPPGILGPIKNKVTSDFGRSWSKHGPIYIENEPLSVIQPVPYQTADGKLRVLLRSFDGIGRVCISESSDGGQTWGHAKPTQLPNPNSGIDGVKLRDGRILLVYNTTSRGILKVALSNDDGDSWYEALTLEDSSGMEFSYPAVIQASDGLIHITYTYKRTQIKHVTLRPN

SEQ ID NO: 18794 - protein, 363 aa, Rickettsia amblyommii
EDVIDISRVSAEADCFTYDPGFMSTASCQSTITYIDGDQGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIA

SEQ ID NO: 18795 - protein, 211 aa, Saccharomyces cerevisiae
DLSTTFCVIQTLCPPETIFEWNKTSNPNPWEPELLNQLIQRYEEPNSNNRWDSPLFAILTPQDNITDYIDDICKVVFQTSKSAKNSGHNDPLSKGLQKPNSATVLKPASQSNFIQVLDIETSKIIKTIMNHIKSLTSIGGVSNGTRVIVSEGITDINDDGCFFVDLPIGNVVTLAQLQRLKRQFINFNKLRDIDQDRIGPLFADYLNKNLN

SEQ ID NO: 18796 - protein, 437 aa, Chlamydophila caviae GPIC
MPVIDETPMTYTEACRYFPGGVNSPIRACIPVGIVPPIVSSASRDVFIDSFGKNFIDFCGSWGSLIHGHSHPKILDALCSAASQGTSYGLTSENEISLATTLFSCLGLQDHKLRFVSSGTEAAMTSVRLACGVTQRSVMIKFLGCYHGHADVLLKGMTIDENNLMEVPHLVDRYFSSDPCLPLTLILPYNDLKTFEEVMEKIGERVACVIFEPIAINMGVVLPEAGWIESIITTCRRYGALSIMDEVVTGFRMGSRGMRSILDVTPDITVYGKILGGGMPVAAVLAHQSIMEHLMPVGTVFQAGTLSGNPIAMAAGQASIELCQERDFYPKLENLTEGFLSPIEDFIRCKGFPIALVRAGSMFSFFFRETPPRNLRDVQECDQKTFGIFYRHAFSRGVYLSPASMEASFISSVHSRENLAYTQNVLIDSLVKTFEGI

SEQ ID NO: 18797 - protein, 406 aa, Agrobacterium tumefaciens str. C58
MEEFHKVRRLPQYVFEQVNRLKASARAAGADIIDLGMGNPDLPTPKAIVDKLCEVVQDPRTHRYSSSKGIPGLRRAQAGYYARRFGVKLNPDTQVVATLGSKEGFANMAQAITAPGDVILCPNPTYPIHAFGFLMAGGVIRSMNVEPDESFFGPLERAVRHSIPKPLALIVNYPSNPTAHVASLDFYKDVIAFAKKHEIIVLSDLAYSEIYFDDNNPPPSVLEVPGAIDVAVEFTSMSKTFSMPGWRMGFAVGNERLIAALTRVKSYLDYGAFTPIQVAATHALNGDGSDIAEVRSVYRRRRDVMVDTFGKAGFEVPPPAATMFAWAKIPEKFRHLGSLEFSKLLVEKADIAVAPGIGFGEMGDDYVRLALVENEHRIRQAARNLKRFLSSADETMHNVVSLNAHR

SEQ ID NO: 18798 - protein, 516 aa, Cryptococcus neoformans var. neoformans B-3501A
MFRSPLPQRTSHNSASEAGPSIPTPIPTDGDAVTLENASNTTGEATLSSSGSSEGESLISKMMADNPYFSAGAGLMGIGVALTALRRSITLGATMAQRRMLVTLEIPSKDRSYPWFLEWMAHQSAAQTRGNVKPPGLFGWGQGMRSHELAVETSYKQHENGASEAIFNLVPGPGTHYFKYGGAWFQVKRERDSKLMDLHSGTPWETLTLTTLSTSRDLFSSLLEEARTLAEASTEGKTVVYTAWGVEWRPFGKPRRRREMGSVVLGKGIAEEIESDLKGFLGRGKWYAERGIPYRRGYLLHGPPGSGKTSFIQALAGSLNYNICLMNLSERGLTDDKLNHLLGLVPERSFVLLEDIDSAFNRRVQTSEDGYKSSVTFSGLLNALDGVASSEERIIFMTTNHYDRLDPALIRPGRVDIQQLLDDAAGEQAKRLFVKFYGNSVNEDGTKGRVLREGELPLNDEEVESLGNSVQRIVDDERAHGKVVSMASLQGHFIRTGAKESLDGIRELCRPREGQA

SEQ ID NO: 18799 - protein, 192 aa, Glycine max
  misc_feature (19)..(19): Xaa can be any naturally occurring amino acid
  misc_feature (30)..(30): Xaa can be any naturally occurring amino acid
  unsure (1)..(192): unsure at all Xaa locations
MVLVLALGDLHIPHRAPDXLPAKFKSMLVXPGKIQHIICTGNLCIKEIHDYLKTLCPDLHITRGEYDEETKYPETKTLTIGQFKLGLCHGHQVIPWGDLDSLAMLQRQLDVDILVTGHTHQFTAYKHEGGVVINPGSATGAYSSITYDVNPSFVLMDIDGLRVVVYVYELIDGEVKVDKIDFKKTSTSHSAH

SEQ ID NO: 18800 - protein, 330 aa, Arabidopsis thaliana
MGNLVDNKFTWVIQNFSSSQSRVVPSNQFVIGGCKWRLLVYPEGFNKSGDHLSLFLEVADPRSLPPGWSRHARYLLTIVNQHSDKISKRNEATKWFNQKIPGWGLSAMIPLTKLHAKDGGFLVNDELKIVAEVNVLEVIGKLDVPEESEEETQVTQPMKKVKVDYDHVESNDLMINETPPVSELMDVNGFQVLPSQVDFVKRIFEKHPDIAKDFRPKNPHLRKACMNFLLSLMETLCQPPQKLSNEDLVEADNALTYVKVSGFKVDWLEKKLEEVKKKKEEEQTGEARIQELEEELKEFKQKCLDREAMLEKEKAKVLTARAPLTLDDVI

SEQ ID NO: 18801 - protein, 421 aa, Roseovarius nubinhibens ISM
MDHFLYRDGELYAEDVPVAEIAAAVGTPFYVYSTATLERHFRLFDEALEGIDHLVCYAMKAASNQAILKTLARLGAGMDVVSGGEYARAIAAGVPGDRIVFSGVGKTRDEMRAALTGGIRQFNVESEPEMAALNEVALELGTRAPITVRVNPDVDAKTHAKIATGKSENKFGIPIARARDVYAQAAAMPGLEVIGIDVHIGSQLTDLEPFRLAYRKVAELTETLRAEGHDIRRLDLGGGLGIPYARGNEAPPLPVEYGKMIKEELGHLGCEIEIEPGRLVAGNAGLMVSRVIYVKSGEDREFLILDGAMNDLIRPAMYDAHHDIVPVVEPQAGAEQRPYDVVGPVCESGDTFAKGRNLPVLNAGDLVAFRSAGAYGAVMSSEYNTRPLIPEVLVHGHQFAVIRARPSFDEMINRDTIPEWL

SEQ ID NO: 18802 - protein, 538 aa, Coprinopsis cinerea okayama7#130
MSFSFLASWIQQSSNSQSYVFDTAKLFFLGTLVEAGRRFLQWLAERVRFQYSVTAHFTEGDPAYEWIVMFLTEENIWKRSRDFHINAKSSTRRWGITLGENAPGSDHVDFVPTYELPHLFRWKGLWIETKRNTGAMIQPPFGGFSPGAIVLTIYTLNVKDLQEFVEEARVRYIEHGRSSVILHSASQPNFGPGFVWSSVKRKLRRPMDSIILEEGMLDSIVQDAKDFIEMEDWYIEAGIPHRRGYLLHGPPGTGKTSTIHALAGELGLEIFSLSLSAGFVDDAFLQQASSTIPKKAIFLIEDIDCAFASREDDETNTSGGASSNGFLGLPFMPLRRSNVTLSGLLNVIDGIGSEEGVLFFATTNHINRLDPALLRPGRIDRKIEYKLTTAAQATALFSRFFPAARTTLGKESTESDKAARLQELAVRFASRIPEHKFSTAELQGYLLSCKGSPEDAVSGIDLWVQQELDDRRSRQAKESDAAQLSSTMHDHQEPQPVLAPVVSPSTSQSSVSRKTRAVLTPPSTPPLGAKEHVPFTAQ

SEQ ID NO: 18803 - protein, 259 aa, Bordetella parapertussis 12822
MISLPYLQRFALSGQVALVTGSARGLGLRIAQALAGSGAHVLLNGRDAHAVEAAVSDLCQQGLRASALPFDVSDEQATEQAFARIDAEHGRLDILVNNVGARNRKPLAETSPAEIRAMMDTNLVAGILLARLAAQHMVRQRYGRLIAITSVAGELARANDAVYPAAKQGLTGMMRALAVEFGRHGITSNAIAPGAFATETNAAMANDPQAGAAMAARNPTGRWGDPEEIAGAAVFLASPAASYVNGHVLVVDGGLSVQF

SEQ ID NO: 18804 - protein, 490 aa, Bordetella parapertussis 12822
MQDFPNILQRWYSMKQHFIDNASVPGSSGERIPVIDPSTGQEFDSIARGNAADIDLAVQAARRAYEGAWGRLSAAERGRLMLALSLKVLEHRDELTALESRDCGKPLKQARADVLAIARYFEYYGGAADKLHGETIPYQQGYTVLTLREPHGVTGHVVPWNYPLQIFGRSVGAALAAGNACVVKPAEDACLSLLRVAELAAETGFPAGALNIVTGYGHEAGDALTRHPGIDHISFTGSPRVGVLVTQTAAERHVPVTLELGGKSPQIVFADADLDALVPVAVNAIVQNAGQTCSAGSRLLVERGAYERVLERLGAAFAALRAGPAQSDLDCGPLIRKTQQERVRGFLDLARGDGIATVAQGRIVPEAPAEGYYQAPTLLRDVPVDHPLAQEEVFGPVLAAIPFDDEADAVRIANATEYGLAASVWTRDGGRQLRIARKVRSGQVFINNYGAGGGIELPFGGVKASGHGREKGFEALYGFTVLKTISIKHD

SEQ ID NO: 18805 - protein, 242 aa, Arabidopsis thaliana
MDHLQESFRGSELCILCDIEACVIYYGPDGELKTWPKEREKVEDIALRYSQLNEALRRKKSVTLYDFLNKKKDKTNLEKKAMITDNDDLKTCLKNVNVLKSPIADHYFNDQISQLIQSLEPHVSKVQERIRFVESQKHKETKLDHQSLASIYSLNQSLNPSQFTLFLYNHGDNTMSQIPNMFMNNNNFQHSFVSNTQDYSALQESVNNNYGLMPNVLCGYDQNLFTSDITNNNLLIDNSMYL

SEQ ID NO: 18806 - protein, 174 aa, Brassica napus
MFKQILGKLPKKPSSAKFWDNGESQAPDNNNNQEVSSQRASSNGDNLASLSVDVLPRLKDVSISEKQKLFLKKLRLCCVVFDFAAEPQRNLKEKEIKRQTLLEVVDYVISSGNGKFPEPVIQEATRMVSANLFSNPHQQQWKNKTPEAGEWEEKEEGSLNPSGPHLQIVYEFLL

SEQ ID NO: 18807 - protein, 169 aa, Bordetella parapertussis 12822
MHPMTEIIKPWHSVRRSRLHGNGVFATRKIPAGTRIIEYGGKRISAAEADRRHPTNPDDPFHTFFFSLSSGRVIDGGDEGNDARWINHSCDPNCEAQEDRHGKRVYIVALRDIARGEELFYDYGLVLDGRITRKLKEGYRCLCGTTPCRGTMLALPEKKKTKARSAEKA

SEQ ID NO: 18808 - protein, 523 aa, Rhodospirillum rubrum ATCC 11170
MTSQMPPFRRPRPVVLCILDGWGHRDDPTDNAIALANTPTWDRLMATCPHSLIATSGADVGLPAGQMGNSEVGHMNIGAGRVVMQDLPRIDAALADGSVAHFPALVRFIDALRASGGTAHLLGLLSPGGVHSHQDHIAKLARVIAAAGVPVKIHAFLDGRDTPPRSALGFLETFAAAAGPEAPIATVSGRYYAMDRDKRFDRVRLAYDVLVSGKGESAADAASAVSQFYDSKDKGDEFVLPTAIAGYDGMKDGDGVFMVNYRSDRAREITQALLDPTFDGFERQPPHFAGALAMTEYSTAHNAFMDVLFGPESLNNILGQVVSEAGMTQLRIAETEKYAHVTFFFNGGRETSFPGEERILIPSPKVATYDLQPEMSAPELTDRLVEVIDAGRFDVIIVNYANGDMVGHSGILEAAIKAVEAVDGCLGRVEEAVVRAGGTMLVTADHGNAELMRDPVTGEPHTAHTTGRVDLLLVNGPEGASLADGRLADLSPTLLALIGLPQPAEMTGKTLVAKAAVAVGASH

SEQ ID NO: 18809 - protein, 352 aa, Lactobacillus plantarum WCFS1
MEAVVKTESGYDNMELKQIPIPEVTGDKVLLKVAYTGICGTDIHTFKGQYANAVTPLVLGHEFSGEVVEVGPDVKTLKPGDRVTSETTFATDGTCVYCQDKEYNLCPNRVGIGTKANGSMANYVLTREESAHILPDNVSYKMAAMSEPLASCVHAMYQKTPFTLHDTLLIMGPGPMGLLSLQIAKEIGAFVIVSGITKDADRLQIAKELGADIIVDTQKEDLAKVVMDATDGVGVTKVYDCSGATPAVNSALPLIRKGGTFQQVGLFAKPMNELDERSIIQHEITYRGSRSQNPYDWAIALHLESKGAINQDAMITKVFDLEHWRDAFDAMMAGKELKVMIASNPDDPDLAD

SEQ ID NO: 18810 - protein, 233 aa, Chlamydophila caviae GPIC
MKEDPYLEVKRHLAREAAALVTSGMLLGLGSGSTSREFIKAVAERKKQENLDIRAVASSKESYSLASSLGIPLIDDEEFINTDLAVDGADEIDPQLRMIKGGGGAIFREKILLQSSQRRLILADESKSVKVLGKFGLPVEISPFGRSSIIATLENFGYLGNLRKNPRGGFFITNNGNYIYDIHTPNVYPHPEEDLLKLLQIHGIIEAGFVIENVEVWLGYTNGQIGKKNTGGL

SEQ ID NO: 18811 - protein, 336 aa, Idiomarina loihiensis L2TR
MKTIDVVGIGNALVDQEFEVSEDFLKKHDLKKGMMELIDEYAQNTLIAELSQLGELKKQSGGGSAANSLVAFAQFGGKAYYCCKVADDEAGMFYRQDLEKIGIETSLHQQKNPGTTGRCLVMVTPDAERTMRTHLGITADLSSAEIDDHAIAAADYLYIEGYLITSEIARGAIQHAKKVARENNTKLVMTCSDPAMVKFFRSGIDEILDGGVDLMFCNREEAELLTGKDDPQAALSVLLKQADTVAITLGKDGAVIANRERQVHIPGVPVKAIDTNGAGDMFAGAMLYGLTRNMSLEDAGRLASHAAAELVTEFGPRLNKDRQQQLIERVMSAQTA

SEQ ID NO: 18812 - protein, 457 aa, Arabidopsis thaliana
MNAKDVISRLPDEVLGRILSLISTKEAVSTSVLSKRWKNMFVLVSNLDIDDRQSVPKTKQNRIEIHRNYMAFVDKLLDTQRGSSIKKLTLKSHVGVRGGTDSSRIQSWICNVLDHGVMDLDVFITLKGKSPPVPAMIFKSKTLVKLRVGRGFTIKLSQDVSLPLLRTLCLDSVNFVGGHNVVGTLISRCPVLEELVVEERRCVDWTCSVSSPSLKRLHIRFDRKFTSISLDAPNLIYYKHSGYVLGKYPNVKLDSLIEARLNLRMDETRMVGVRNGSLGSIPADMRNLINGIRNVRILHLSSHTLELLYFSCKEMPLFDSLVSLSIGNDKARGWQMLPLLIKNSPNLETLIFMGLDHYITNRCGDVCVCYDTDESITSCLSSSQVKVLEILSYQGTTRELNQMKHFLEKLPCLELVKICVVNNSNNLQTTMEMRNLMMLPRASSKCKIQVKVLTKNN

SEQ ID NO: 18813 - protein, 501 aa, Oryza sativa
MGLPGRRNPLLSARRAAASLRRSRRLPVYVAAVFFVASVLLMFRDEILYLTTARSPSSSLPTTGGSAGGAGLARKEELVSVNKPVLLGHGGKPEKHHSVTERHRPKVSAKRRPNKKAAKAARKKFMASPSVAAGAEVNVPETCNLSKGKWVFDNATYPLYREQECEYLTAQVTCTRNGRRDDGYQKWRWQPRDCDLPLAFDARLFMERLRGKRLMFVGDSLNRNQWESMVCLVRPALSPGKSYVTWWDGQRVVLHAWEYNATVEFYWAPFLVESNSDDPKAHSIRDRVIKPEAIAAHAGDWVGVDYLVFNTYIWWMNTVNMKVIRRPTGKTWEEYDEVGRIEAYRRVLDTWATWVNDNVDPARTSVFFMSVSPLHISPEAWGNPGGVRCAKEDAPVQNWHGPLWLGTDWDMFRAARNASRAAGRVPVTFVDVTAMSELRKDGHTSVHTIRQGRVLTPEQQADPATYADCIHWCLPGVPDVWNLMLYARILSRPPAAAGHVA

SEQ ID NO: 18814 - protein, 369 aa, Arabidopsis thaliana
MRKFKLKYDEYTYDDDRLAGWVVTTVDRGIQHLDAKGFETNMCVREFMPQNIYKCNTLVSLMLVTVGIENPEFVVSLPSLKIMHLEDVWYYDDPLIMEKIISGCPVLEDFVLIRPIDFCNLDVLQFLRVRSLSLRSFRLTFEYSVSCTYFSVEIDAPRLEYLNFNDDQSDTIVVKNMTSLSMIDIDSEFNVKFGGSRLEPGDLRKRDIIRDFLTAISCVRHMIISRRTLEVLDRYSKLVPIPKFDNLYRLQAAVSRSMLQLLLVFLESCPNLENLILDFTVSTEPEQDGLTYVPQCLLSSLECVEIRELIMGEETGEKLVRYFLKNSVVLKKLILRLEDSSIANQDSDIFKELSTFTKRSRSCEVIIIH

SEQ ID NO: 18815 - protein, 433 aa, Arabidopsis thaliana
MRRRRCDLQPKRTRMCDLQPKRTSMCDLPPKLVGEKIITRIPITSLRAVRSTCKLWNALTKDRVLGKAAAQFLGFMTMDSKVCSVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 18816 - protein, 283 aa, Clostridium perfringens SM101
MELWYTEEHTDKVRFSIKVDEQLYSGKSDFQRIDVFKSQEFGTFFTLDGLMMVTEKDEFIYHDMIVHVPMATNPNIKNVLVIGAGDGGTVRELTRYETIEKIDMVEIDKLVVDVCREYLPQTANKLDDPRVSLFFEDGLKFVRSVENKYDLIIVDSTDPFGPGEGLFTREFYGNCFKALKEDGILVNQHESPYYEEYARGMKRAHKRIKECFPVCRVYQAHIPTYPSGHWLFGFASKKYDPLNANIEKWNDLGLKTKYYNTDLHKGCFALPNYVKEMLENVDE

SEQ ID NO: 18817 - protein, 392 aa, Bacillus anthracis str. Ames
MKLFQPSEIVTSLPTQFFASLVAKVNKVVAAGHDVINLGQGNPDQPTPQHIVKALQDAAEKTIHHKYPPFRGHESLKEAVATFYQREYDVVVNPKTEVAILFGGKAGLVELPVCFTNPGDTILVPDPGYPDYLSGVALAKAQFETMPLIAENNFLPDYTKIDDSIAERAKLMFLNYPNNPTGATASKDFFDETIHFANKHNILVVHDFAYGAIGFDGQKPVSFLQADGAKDTGIEIYTLSKTFNMAGWRIAFAVGNESVIETINLLQDHMYVSIFGAIQDAAREALLSSQSCVIDLVNSYESRRNALISACHSIGWNVDIPTGSFFAWLPVPEGYTSEQFSDILLEKAHVAVAPGVGFGEHGEGYVRVGLLHTEDRLREAINRIDKLNFFKK

SEQ ID NO: 18818 - protein, 388 aa, Zea mays
MLMAQIHHGSERNLIPLPQETTTSARAVRHGRRAQRARLTEALRLKMDQVPIPLIEYSKNLLHSKYSSRREIQGKARKLKDLMIKSDNRICADCGAPDPKWASANIGVFLCLKCGDVHRALGPDISKVLSVTLDDWSDSDIDSMVEVGGNSYANSIYEAFLPKDHPKPKPDSTMEYRTKFIRAKYETQDFLKPSLRISSRSSFKSTNSVKSVDSNFSSTSRKDISEDTREFVGELNITVVKGTNLAVRDMLTSDPYVALTLGGQKAQSTVKKSDLNPVWNEMLKISVPRNYGPLKLEVYDHDTFSADDIMGEAEIDLQPMITAAMAFGDTSRLGDMQIGRWFTTKDNALMKDSTVNVVAGKVKQEVHLKLQNVESGELELELEWVPIL

SEQ ID NO: 18819 - protein, 289 aa, Francisella tularensis subsp. holarctica
MIANINNKKIFHETLYHSYHQSIAISEILYEHKTDYQHLVIFNNPIFGNVMVLDGIVQTTEKDEFIYHEMLVHVPVIAHGNVKNILIIGGGDGGMLREALSHKAVEFVTLVEIDQAVIDMCQEYFPGHSKGAFDHPKAKIVIQDGCEFVKNPPRKYDLIICDSTDPIGPGEVLFTSKFYKDCKEALNPGGIMVTQNGVIYFQIDELKKTLERFEPLYKDVSFYTAAVPTYVGGSMAFGWGTDELSYRNHDIQVIAQRFLKSGIKTKYYNPAIHIAAFALPQYVIDTLKK

SEQ ID NO: 18820 - protein, 493 aa, Pseudomonas syringae pv. phaseolicola 1448A
MNKPLDPASMPAIPESAVSQWPDVDSLYRRFDELVKQPIRPIKREAMSKVMGYFDERCQGSKRLSEAAKKVIPGGVQHNLAFNYPFPLAFAQAKGAHLTDVDGNRYTDFLQAGGPTLLGSNHPAIRKQVNRILDECGPVTGLLHEYEVKLAELVCEVMPGVDMLRLLGSGTEAVMAAVRLARAYTRKKWVIKIGGAYHGWSDQLVYGMRLPGTGRMEAVGIPRGATANTQESPPNNLDALRRRLQINRLRGGTAAIMVEPFGPESGTRPVHADFNRQLRALCNEFGALLIFDEVVTGFRAGLGGAQAYFNVMPDITVLGKCLTGGYPMAGAIGGRRDVMQLLAGGIGTSSRRAFVGGTLSANPLSCVAGYYALLEARRLNAPALAGRAGDRMRAGLDEIINRRGLPYVAYNMGSIVHLQTSGVLLLDTSNPLKLLRARNEAKTRKHMMEEMGAAYTAHGLITLAGSRIYTSLADTDDVIDDALDRFDAVFQLV

SEQ ID NO: 18821 - protein, 423 aa, Candidatus Desulfococcus oleovorans Hxd3
MLNYKAIEIFTSESARHQGRPLTETVVEYVRGLKIAARCIVTRGIAGCYESGETATTRFELLSFNMPVRIYIVMPSTQTDRVLDGLNDMVTDGIVAIHDLNVVAHRTRNAFFPRQLSVRDVMTADPRSVTSETPLDEVTRLLLSSIFTGVPVVDKKGRPVGVITQGDLIRKGGLPLRLGLLAESDQDRMKSVLSQMAGRQAEQVMTGPAVTIAEDRPLAEAVDLMISRNFKRLPVTDKEGRLCGMVSRLDIFRTVMREAPDWNAFRSQKVDVTHLKQVADIARRDTHTVSPDTPVADVLRLIGDNDIQRVAVVDAENNLLGLISDKDLLRCFAQKQSGIWGLLSRVGSAFKHDEADTCLAGATAGTVMNTELITVKEEMLIEEAIGLMVERGLKRLPVVDAEGRFAGMISRDSLLRTGFGAGM

SEQ ID NO: 18822 - protein, 303 aa, Mycobacterium avium subsp. paratuberculosis K-10
MNTAHSPDGSGRTGTARVKRGMAEMLKGGVIMDVVTPEQAKIAEGAGAVAVMALERVPADIRAQGGVSRMSDPDMIEGIISAVTIPVMAKARIGHFVEAQILQSLGVDYIDESEVLTPADYTHHIDKWKFTVPFVCGATNLGEALRRINEGAAMIRSKGEAGTGDVSNATTHMRAIGGEIRRLMSLSEDELYVAAKELQAPYELVVEVARAGKLPVTLFTAGGIATPADAAMMMQLGAEGVFVGSGIFKSGDPAQRAAAIVKATTFYDDPDVLAKVSRGLGEAMVGINVEQIAQPERLAERGW

SEQ ID NO: 18823 - protein, 424 aa, Thermus thermophilus HB8
MERPISEAYFQEAKRHIPGGVSSPVRAFKAVGGTPPFLVRGEGAYVWDADGNRYLDYVMSWGPLILGHAHPKVLARVRETLERGLTFGAPSPLEVALAKKVKRAYPFVDLVRFVNSGTEATMSALRLARGYTGRPYIVKFRGNYHGHADGLLVEAGSGALTLGVPSSAGVPEEYAKLTLVLEYNDPEGLREVLKRRGEEIAAIIFEPVVGNAGVLVPTEDFLKALHEAKAYGVLLIADEVMTGFRLAFGGATELLGLKPDLVTLGKILGGGLPAAAYAGRREIMEKVAPLGPVYQAGTLSGNPLAMAAGLATLELLEENPGYYAYLEDLGARLEAGLKEVLKEKGLPHTVNRVGSMITVFFTEGPVVTFQDARRTDTELFKRFFHGLLDRGIYWPPSNFEAAFLSVAHREEDVEKTLEALRKAL

SEQ ID NO: 18824 - protein, 339 aa, Zea mays
  misc_feature (218)..(218): Xaa can be any naturally occurring amino acid
  unsure (1)..(339): unsure at all Xaa locations
INARPTRPAFLLPLWPLPRHRVLPLDLRAAMAKPVLFHSGWVAVGSRRGKAAAAASSSSARAQLSITVRAEPDPRFVFQFDGEPECSPQVLQVKGSMKQPMFTCRFSCRSSSDLRSRSVQSDPGARNWLAKLGSERERAGKERKGWSVTVHDLSGSPVALASMVTPFVASPGTDHVSRSSPGAWLILRPADGTWAPWGRLECWRGRGDTLGYRFELVXATPRGGAGVCVAEASVPASRGGRFAIDLTAAAQPFWCSSSGDMGHGIWPFGGFVMSAAVQGEGRCSRPPVEVGVAHVGCAEDAAAFVALAAAVDLSMDACRLFSCKLRRELSTASRAEFLR

SEQ ID NO: 18825 - protein, 62 aa, Oryza sativa
AGGVPALVQINMFFHIWRLAQQVKVRQRVIATAVTYFRRVYTRKSMTEYDPRLVAPTCLYLA

SEQ ID NO: 18826 - protein, 161 aa, Brassica napus
VDPRVRSPLAGKTVVVIGAGGAGKALAYGAKEKGAKVVIANRTYERALELAEAIGGKALSLTDLDNFHPEDGMVLANTTSMGMQPNVDETPISKHALKHYALVFDAVYTPRVTRLLREAEECGAITVSGSEMFVRQAYEQFEIFTGLPAPKELYWQIMSKY

SEQ ID NO: 18827 - protein, 326 aa, Thermus thermophilus HB8
MRVLNMVQAINEALDLALSRDERVLVFGEDVGRLGGVFRVTEGLQAKYGEKRVFDTPLAESGILGMAIGLAMGGMRPVAEIQFAGFLYPALDQILSHLGRWRHRSRGRVGLPVVVRAPYGGGVHTPEQHADSPEALLCHTPGVKVVIPSSPERAKGLLLSAIEDEDPVFFLEAIKLYRGARAEVPEGYYTLPLGKARVLREGKAATLIGYGGMVEVMLEAAEVAQREGVEVTVVDLETLVPLDEETLLEAVRATGRAIVVYEAMRTGGFGAEIAARIAEGAIDYLQAPVLRVAGYDAPYPPFSAIEHLYRPNARRVLAALRKALTY

SEQ ID NO: 18828 - protein, 466 aa, Lactobacillus plantarum WCFS1
MNKQKKVSSKFIFFFGSFGGILFGYDIGVMTGALPFLKTDWALTNATLVGWVTSAVMFGAIFGAAIAGQLADRLGRRRMILMSSLIFAIGSILCGFSPNNGTYYLIGMRIFLGLAVGAASALVPAYMSEMAPARLRGSLSGINQTMIVSGMLISYIVDYILKDLPENMSWRLMLGLAAVPAIILFLGVLKLPESPRFLIKANRLDEARQVLSFVRKPDEVDSEVKAIQSTAQTEANNLEKTSWATLFNGKYRYLVMAGVGVAAFQQFQGANAIFYYIPLIVEKATGSAASSALMWPIVQGILLVLGSLLYIWIAEKFNRRTLLMLGGSVMALSFLLPAVINSLVPNASPMMIVVFLSIYVAFYSFTWAPLTWVLVGEVFPLAVRGRASGLASSFNWIGSWAVGLLFPIMTASMSQEAVFAVFGVICVLGVLFVRFCVPETRGHSLEEIEAAGTNHHKQVPVQQASH

SEQ ID NO: 18829 - protein, 162 aa, Bupleurum falcatum
GDAMGMNMVSKGVQNVLDFLQSDFPDMDVIGISGNFCSDRKPAAVNWIEGRGKSVVCEAIITEDVVKKVLKTTVHALVELNMLKNLAGSAVAGALGGFNAHAANIVSAIFIATGQDPAQNIESSHCITMMEAVNNGRDLHISVTMPSIEVGTVGGGTGWYRW

SEQ ID NO: 18830 - protein, 381 aa, Thermus thermophilus HB8
MRLHPRTEAAKESIFPRMSGLAQRLGAVNLGQGFPSNPPPPFLLEAVRRALGRQDQYAPPAGLPALREALAEEFAVEPESVVVTSGATEALYVLLQSLVGPGDEVVVLEPFFDVYLPDAFLAGAKARLVRLDLTPEGFRLDLSALEKALTPRTRALLLNTPMNPTGLVFGERELEAIARLARAHDLFLISDEVYDELYYGERPRRLREFAPERTFTVGSAGKRLEATGYRVGWIVGPKEFMPRLAGMRQWTSFSAPTPLQAGVAEALKLARREGFYEALREGYRRRRDLLAGGLRAMGLRVYVPEGTYFLMAELPGWDAFRLVEEARVALIPASAFYLEDPPKDLFRFAFCKTEEELHLALERLGRVVNSPREAEGGAVSG

SEQ ID NO: 18831 - protein, 194 aa, Xanthomonas campestris pv. vesicatoria str. 85-10
MDTATHATPASASPLAIVVMGVSGSGKTTIAHALAAHYRFRFLDADDYHSVAARAQMAAGQPLTDAMRLPWVELLSAKLRDCVQAGESVVLAFSGLRSAHRQLLRNSGVPMRFVFLHAAPHVIAARLSNRAGHFMPPTLLDSQLQTLELPLDEADVVSVDVDASVPAVVQDAIAQLAAIDPAAVQHASRASERV

SEQ ID NO: 18832 - protein, 341 aa, Roseovarius nubinhibens ISM
MKALVKSRPEPGLWMEHVPVPEPGDDEVLIKVRKSAICGTDVHIWKWDEWSAKTVPVPMVVGHEFCGEIVDTGRAAIKYKIGQRVAGEGHVVCGTCRNCRAGRGHLCRNTLGVGVNRPGSFAEYLCIPESNVVPIPDDIPDEIAAIFDPFGNAVHTALSFDLVGEDVLVTGAGPIGIMGALVAQKAGARKVVITDISPYRIALAQKLGVQHVVNAAEENLKDVMARLGMTEGFDVGLEMSGAAPAMRDMIDKMNNGGKIALLGIAPTEFAVDWNKIIFKMLNVKGIYGREMYETWYKMIALVQSGLDLTPLITHRIGIDAFEDGFAAMLSGEAGKVVMDWG

SEQ ID NO: 18833 - protein, 450 aa, Rhodospirillum rubrum ATCC 11170
MINEFEAWINEHGIAEVECLLSDMNGIVRGKVLPARKFLRSLEDNSLRIPSSVFLVTVTGEYPFADDNNTVVIDPDADLRPDFRTLCVAPGYRTPTAFVVVDAYKSNGIPLDLSPRQVLKRVLALYSEQGWKPVVAPEIEFYLTQVNADPDLPLSPPAGRSGRPETSPQPYGLEAITEFEDLIENIYEHAEIAGLQIDTLIHEAGAAQLEINFLHGDPITLSDQVVVFKRLVRQVALKHGVYATFMAKPMADQPGSAMHIHQSLVEIGTGKNLFVRDDGSDSPMFRHYIGGLQALLAQVTPLFAPNINSFRRMRPHHSAPINLECGYDNRSCGLRVPLSDPANRRLENRLPGADANPYLAMAASLACGYIGIMERIEPSIMVEGGNAYRRSRTLPRTLDEALDRLEKCTVIKNVLGEHFFEAFTMIKRVELDAFQDVISSWERNHLLLKV

SEQ ID NO: 18834 - protein, 741 aa, Arabidopsis thaliana
MASTSSLALSQALLTRAISHNGSENCVSIPAFSALKSTSPRTSGTISSRRRNASTISHSLRPLVRAAAVEAIVTSSDSSLVDKSVNTIRFLAIDAVEKAKSGHPGLPMGCAPMSHILYDEVMKYNPKNPYWFNRDRFVLSAGHGCMLQYALLHLAGYDSVREEDLKSFRQWGSKTPGHPENFETPGVEATTGPLGQGIANAVGLALAEKHLAARFNKPDNEIVDHYTYSILGDGCQMEGISNEVCSLAGHWGLGKLIAFYDDNHISIDGDTDIAFTESVDKRFEALGWHVIWVKNGNNGYDEIRAAIREAKAVTDKPTLIKVTTTIGYGSPNKANSYSVHGAALGEKEVEATRNNLGWPYEPFHVPEDVKSHWSRHTPEGAALEADWNAKFAAYEKKYPEEAAELKSIISGELPVGWEKALPTYTPDSPGDATRNLSQQCLNALAKAVPGFLGGSADLASSNMTMLKAFGNFQKATPEERNLRFGVREHGMGAICNGIALHSPGFIPYCATFFVFTDYMRAAMRISALSEAGVIYVMTHDSIGLGEDGPTHQPIEHLSSFRAMPNIMMFRPADGNETAGAYKIAVTKRKTPSVLALSRQKLPQLPGTSIESVEKGGYTISDNSTGNKPDVILIGTGSELEIAAQAAEKLREQGKSVRVVSFVCWELFDEQSDAYKESVLPSDVSARVSIEAGSTFGWGKIVGGKGKSIGIDTFGASAPAGKLYKEFGITIEAMVEAAKSLI

SEQ ID NO: 18835 - protein, 191 aa, Glycine max
MDNKKSKWSWSSAIIGAASAVAASALISAKPKDPTFHLISINFTSLKLNFPLLDAEVLLTVHVTNPNIAPIHYSSTSMSIFYQGSLLGSAQVQAGSQPPRSCQLLRLPARLHALELAHHATRFLHDVARREMFLDAAVDIAGTARVMWWDHNFKVHVDSHVTVDPVFLDVIDQENTSELEVFTAAALGSEQ

SEQ ID NO: 18836 - protein, 219 aa, Oryza sativa (japonica cultivar-group)
MTSYVYKGKLTFGIWEDNVLFDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVSSETAKAFADEMGIPFMETSAKNATNVEQAFMAMAASIKDRMASQPAAANARPPTVQIRGQPVNQKTSCCSS

SEQ ID NO: 18837 - protein, 107 aa, Lolium perenne
MAEEYRCFVGGLAWATNDQSLEQAFSQFGEITDCKIINDRETGRSRGFGFVTFSSSESMKNAIEGMNGQDLDGRNITVNEAQSRSGGGGGGYSRGGGGGDSGGNWRN

SEQ ID NO: 18838 - protein, 570 aa, Bacillus anthracis str. Ames
MTLNIQGIAASSGIAIAKAFRLENPEFNIEQKSITNEAAEIARLEAALEKAKTELEAIKDHAFAELGADKAAIFEAHLLVLNDPELVNPVKDKVNSEKVNAEFAMDEVASMFISMFENMDNEYMKERAADIRDVTKRVLAHLLGINFSNPGTNSEEVIIIAEDLTPSDTAQLNRKYAKGFTTDIGGRTSHSAIMARSMEIPAVVGTKVVMEKIQNGDIVIIDGLDGEVIVNPSEETLRSFEEKKAKFEEQKAEWAKLKDQATVTSDGHHVELVANIGTLNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEVGTTVSDSIEVGMMVEIPASAVLADQFAKEVDFFSIGTNDLIQYTMAADRMNEQVSYLYQPYNLSILRLVKMVIDAAHKEGKWAGMCGEMAGDSLAIPLLLGLGLDEFSMSATSILPARTQLSKLSKAEMETLAEKALMMSTAEEVVELVKSI

SEQ ID NO: 18839 - protein, 314 aa, Nicotiana tabacum
MVAPTRGRGGGGFRGGRGDGGGRGGRGGRGGFGGGRGGGGSAMKRGGGRGGGGRGGGGRGGGRGGRGGGFKGGNKVVVEPHRHGGVFIAKGKEDALCTKNLVPGEAVYNEKRISVQNEDGTKVEYRVWNPFRSKLAAAILGGVDDIWIKPGAKVLYLGAASGTTVSHVSDLVGPGGVVYAVEFSHRSGRDLVNMAKKRTNVIPIIEDARHPAKYRMLVGMVDVIFSDVAQPDQARILALNASYFLKAGGHFVISIKANCIDSTVPAEAVFAQEVKKLQAEQFKPMEQVTLEPFERDHACVVGAYRVPKKQKAAA

SEQ ID NO: 18840 - protein, 101 aa, Schizosaccharomyces pombe
MSSVESFVDSAVADNDVVVFAKSYCPYCHATEKVIADKKIKAQVYQIDLMNDGDEIQSYLLKKTGQRTVPNIFIHQKHVGGNSDFQALFKKGELDSLFNTA

SEQ ID NO: 18841 - protein, 540 aa, Mycobacterium avium subsp. paratuberculosis K-10
MTAIVEPSVTTGPIAGSSKVYRELDGVPGARVPFRRVHLSTGDHFDLYDTSGPYTDPDATIDLTAGLPARPGRVRDRGTQLQRARAGEITAEMAFIAAREGMPAELVRDEVARGRAVIPANHNHPEIEPMIIGKAFATKVNANIGNSAVTSSIAEEVDKMVWATRWGADTIMDLSTGKNIHETREWILRNSPVPVGTVPIYQALEKVKGDPTLLTWEIYRDTVIEQCEQGVDYMTVHAGVLLRYVPLTAKRVTGIVSRGGSIMAAWCLAHHRESFLYTNFDELCEIFARYDVTFSLGDGLRPGSIADANDAAQFAELRTLGELTKIAKSHGVQVMIEGPGHVPMHKIVENVRLEEEWCEEAPFYTLGPLATDIAPAYDHITSAIGAAIIAQAGTAMLCYVTPKEHLGLPDRKDVKDGVIAYKIAAHAGDLAKGHPHAQQRDNALSQARFEFRWNDQFALSLDPDTAREYHDETLPAEPAKTAHFCSMCGPKFCSMRITQDVRDYAAKHGLDSEEAIEAAMADKSREFAEHGNRVYLPLAQ

SEQ ID NO: 18842 - protein, 190 aa, Synechococcus sp. CC9311
MTQARRKRRSFLLLVDSAEQQVAKLLTVITAVVIVAALIQLTIRVSLALIYTDRNSYWLGDGLIKILGDLLTVLIALEVLQNVTSYLRKHVIQIELVLVTALTAVARKVIVLPAGSENKPQLLIGLGIASIALAGSYWLVKRSSPLDSAARQEDWSSETNTERAIQSQDADLSSPGGGDDGLKSRADLQR

SEQ ID NO: 18843 - protein, 464 aa, Rhodospirillum rubrum ATCC 11170
MTVVDRGTAHWQKLDADHHWHPFTNTKALNQKGARVIVRGEGVYLWDSEGNRILDGMAGLWCVNLGYGRTELAEAAAAQFATLPFYNTFFQTTHTPAVELAHLIASVTPGDLNHVFFASSGSEAVDTALRMARAYWVVAGKPSKTWVIGRKNAYHGSTLAGASLSGMSGMWKYGAPLVPDIAHIAQPYWYGEADAAETDPEAFGLARARLLEAKILELGAENVAAFIGEPIQGAGGVIVPPASYWPEIERICRKYDVLLIADEVICGFGRTGSWFGSQTFGITPDIMTMAKGLSSGYLPISAVAVGNRVADELINGGGEFTHGFTYSGHPVSAAVAKRTIEILRDEKIIERVHDDIGPYFQERLRTLEDHPLVGKVDGVGLIAGIALVASKSPKRFFEKGDEVGLICRDHCFAEGLVMRAVGSRMVCAPPLIISRDEVDELVRLARRCFDLTLRDVGPLIETAK

SEQ ID NO: 18844 - protein, 262 aa, Triticum aestivum
  misc_feature (227)..(227): Xaa can be any naturally occurring amino acid
  unsure (1)..(262): unsure at all Xaa locations
HYRTSLYKKAGWYRSGIPGISSTHASANENESSDEKIALLGAIQSLFEGSMYTFVFLWTPALSPNDEDIPHGFIFATFMLSSMLGSSIASRLLARKMKVEGYMQIVFAVSAFTLFLPVATSLLVPTSSVKGSGISFGGSLQLLGFCTFESCVGIFWPSIMKMRSQYIPEEARSTIMNFFRIPLNLFVCVVLYNVNAFPITVMFGMCSIFLFMAAILQRRLMVVADLXQTIHKSQEMTAEDQPLNPGRPTHSPHLTWVADKKF

SEQ ID NO: 18845 - protein, 250 aa, Thermus thermophilus HB8
MRRVLVAGNWKMHKTPSEARVWFAELKRLLPPLQSEAAVLPAFPILPVAKEVLAETQVGYGAQDVSAHKEGAYTGEVSARMLSDLGCRYAIVGHSERRRYHGETDALVAEKAKRLLEEGITPILCVGEPLEVREKGEAVPYTLRQLRGSLEGVEPPGPEALVIAYEPVWAIGTGKNATPEDAEAMHQAIRKALSERYGEAFASRVRILYGGSVNPKNFADLLSMPNVDGGLVGGASLELESFLALLRIAG

SEQ ID NO: 18846 - protein, 162 aa, Brassica napus
NASHMVYDLENVEKSSATEATLLLVDSAGCDMEEKKDEEESTYNEGEAEVAMAHAKRLIKSGVRSCDIGIITPYAAQVMVLRILRGKEEKLKEMEISTVDGFQGREKEAIIISMVRSNSKKEVGFLKDQRRMNVAVTRARRQCCVVCDTETVSSDAFLKRMI

SEQ ID NO: 18847 - protein, 528 aa, Synechococcus sp. CC9311
MSSVQSEGQRKPAIVILDFGSQYSELIARRVRETEVFSVVLGYSTSAEELRALAPRGIILSGGPSSVYADEAPLCDPAIWDLGVPVLGVCYGMQLMVQQLGGQVVAATGKAEYGKAPLKVDDPTALLTNVESGSTMWMSHGDSVEALPDGFLRLAHTANTPEAAIANHKRRLYGVQFHPEVVHSTGGMVMIRNFVYHICGCEPDWTTEAFIDEAVANVRDQVGQKRVLLALSGGVDSSTLAFLLKKAIGDQLTCMFIDQGFMRKGEPEFLMEFFDRKFNIHVEYINARERFIKKLDGITDPEEKRKIIGTEFIRVFEEESRRLGPFDYLVQGTLYPDVIESAGTNVDPKTGERVAVKIKSHHNVGGLPKDLRFKLVEPLRKLFKDEVRKVGRTLGLPEEIVSRHPFPGPGLAIRILGEVTEEKLDCLRDADLIVREEVNAAGLYHDIWQAFAVLLPVRSVGVMGDKRTYAWPIVLRCVSSEDGMTADWSRLPYDLMEVISNRIVNEVKGVNRVVMDITSKPPGTIEWE

SEQ ID NO: 18848 - protein, 434 aa, Aspergillus niger
MLPKDLQWGFAKAAYQIEGAVDQDGRGPSIWDTFCAQPGKIADGSSGVTACDSYNRTAEDIALLKSLGAKSYRFSISSRIPEGGRGDAVNQAGIDHYVKFVDDLLDAGITPFITLFHWDLLHQRYGGLLNRTEFPLDFENYARVMFRALPKVRNWNEPLCSAIPGYGSGSFAPGRQSTSEPWTVGHNILVAHGRAVKAYRDDFKPASGDGQIGIVLNGDFTYPWDAADPADKERLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWTSKRYGSPPIYVTENGTSIKGESDLPNEKILEDDFRVKYYNEYIRAMVTAVELDGVNVRFGVTYVDYENGQKRFPKKSAKSLKPLFDELIAAA

SEQ ID NO: 18849 - protein, 372 aa, Gibberella zeae PH-1
MPSATQLYQYNHVPETKANLDWADFPNISIIKVPTIDLSLYGTESGNAELAQTLIEAIRTKGFFYVTNYGISQEEVDTQFSLGQQFYELPLEEKVKYQPDLDAGDYNGYRPAGRRVLSGGIKDKTEVWNMATNDGHITQPLPELLQKNKTLIENFSKDLHDKVLDPLLHLIAIALELPADFFTKLHQWNIHDESHLRYMKYSKFSPEEREKLSDGLWSLGHTDLGTITLLFRQPVAALQIKDHKTGEWKWAKPLDGSLTVNTCDALSFLTGGYIKSTVHRVSAPPKDQEHVDRLGLLYFARPQNDLILKTIDSPVLKRAGFTQNEFEAGNHKVPTMGEFTTLKQTWQQRKGKVYKEEDGAEILPGFQGKYHA

SEQ ID NO: 18850 - protein, 354 aa, uncultured bacterium
  misc_feature (272)..(272): Xaa can be any naturally occurring amino acid
  unsure (1)..(354): unsure at all Xaa locations
AIGAANNLLAAMLDNHIYQGNALGIDPRKITWKRCMDMNDRQLRLIVDGLNGKTNGSPREDGFDITVASEIMAILCLSRSLDDLKQRIRRIIVGYTWDDKPVTAGQLKAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKFGLPAVVAINRFPTDTEAEMKLVEASCQKHGAXVALSEVWAKGGSGGRELAEEVVRLAATPNDNFRFIYDTELPIREKVKAIVSQIYGGDGVDFGPAALKQMKRLEELGFGNLPI

SEQ ID NO: 18851 - protein, 348 aa, uncultured bacterium
  misc_feature (266)..(266): Xaa can be any naturally occurring amino acid
  misc_feature (280)..(280): Xaa can be any naturally occurring amino acid
  unsure (1)..(348): unsure at all Xaa locations
NLLAAMLDNHIYQGNALGIDPRKITWKRCMDMNDRQLRLIVDGLNGKTNGSPREDGFDITVASEIMAILCLSRSLDDLKQRIRRIIVGYTWDDKPVTAGQLKAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKFGLPAVVAINRFPTDTEAEMKLVEASCQKHGAXVALSEVWAKGGSGXRELAEEVVRLAATPNDNFRFIYDTELPIREKVKAIVSQIYGGDGVDFGPAALKQMKRLEELGFGNLPI

SEQ ID NO: 18852 - protein, 348 aa, uncultured bacterium
  misc_feature (266)..(266): Xaa can be any naturally occurring amino acid
  unsure (1)..(348): unsure at all Xaa locations
NLLAAMLDNHIYQGNALGIDPRKITWKRCMDMNDRQLRFIVDGLNGKTNGSPREDGFDITVASEIMAILCLSRSLDDLKQRIRRIIVGYTWDDKPVTAGQLKAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKFGLPAVVAINRFPTDTEAEMKLVEASCQKHGAXVALSEVWAKGGSGGRELAEEVVRLAATPNDNFRFIYDTELPIREKVKAIVSQIYGGDGVDFGPAALKQMKRLEELGFGNLPI

SEQ ID NO: 18853 - protein, 469 aa, Synechococcus sp. RS9917
MAPSLQRREADQRIQFILRLAIAAALGGFLFGYDTAVINGAVSSIQATFNASAMGLGLAVSSALLGSAAGALGAGWLADRIGRRRSMWLAAVLFIASAVGSALAPTLRDLVIWRVIGGVAVGFASVLAPAYIAEISPANLRGRTGSLQQLAIVVGIFIALLFDYVIVLATVDQEPLSSVGPLPAWRWMLMSELIPALLYGGMVLRIPESPRYLVQIGCIEHAREVILKTLGEPTQEVIDRIQASLGHRNGGQIQDLFSKRSLLLPVVWTGVLLAIFQQFVGINVIFYYSSSLWKAVGFSTTDSLSITVVTSITNVVTTFLAIATIDRLGRRPLLLAGSVVITISLGLMSWTFAGAPIVNGEPQLTGAASLVALISANVFVFAFGFSWGPVMWVLLGEMFSNRIRALALGLSATVNWLANFLISTTFPVLLQSSGPALAYGLYATAAAISFFFVLFMVRETKGRELEDMA

SEQ ID NO: 18854 - protein, 690 aa, Oryza sativa (japonica cultivar-group)
MMEVADKIVEPKGPLVATAQLPNNVELLKSVVLNPSREGGSSQEQYEKDLLAEGEESFRSEESSDEGGRSSFSGVSHPPEPIDVDLMSTVYVAIDEEKPEPPECLMRGLSVKGASMEDLSVHAMDAKPDVIVCTVNVNGLVEERKVHCAVVAPDAVEAVSSTQASEEKDCVWDASFPPSGNVSPHSSSDSTGAVAATSIRGRSTSTCRSGVLTSESILTVEKTCESAKDSTRGNSMESTKTSMSRASDSSGVSDDSNWSNITGSANKPHKGNDPRWRAILAVRGRGNVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQPRKHFSEYAARFYAAEVLLALEYLHMLGVVYRDLKPENVLVRDDGHIMLSDFDLSLRCAVSPTLIRASASDSDPRRAGGSFCVQPACMEPSSVCIQPACFMPKLFGQRSKKQGRRPRSELGQGGGAALPELVAEPTSARSMSFVGTHEYLAPEIIKGEGHGSAVDWWTFGIFLHELLYGKTPFKGSGNRATLFNVVGQQLRFPESPSTSYAGRDLIRGLLVKEPQQRLGVKRGAAEIKQHPFFEGVNWALIRCSTPPEVPRHVEAELPAKYGVAEPVASGGGGGKRVVGAEVRSGGKYLDFEFF

SEQ ID NO: 18855 - protein, 246 aa, Brassica napus
  misc_feature (169)..(169): Xaa can be any naturally occurring amino acid
  misc_feature (180)..(180): Xaa can be any naturally occurring amino acid
  misc_feature (189)..(189): Xaa can be any naturally occurring amino acid
  unsure (1)..(246): unsure at all Xaa locations
VLPDTPNSMLERGKYEQAREMLQKIRGADNVDEEFQDLCDACESAKKVEHPWKNIFQEAKYRPALVFCSMIPFFQQFTGINVIMFYAPVLFKTLGFADDASLISAVITGVVNVVSTLVSIYAVDRYGRRLLFLEGGIQMIICQIIVGSLIGAKFGTTGSGTLTPATADXVLAFICIYVAXYAWSWGPLXWLVPSEICPLEVRPAGQAINVSVNMVFTFLIGQFFLTMLCHMKFGLLYFFGRMGLIM

SEQ ID NO: 18856 - protein, 566 aa, Cryptococcus neoformans var. neoformans JEC21
MITGSSAHLDHALAPQVNTCLGTMNFYKSAALALDHLDKHQGSVKGSLAAAGVKASGAEAKRILALIIETLKYRPVLQQLLKTVPILALERTTFPSRTPAKTPTSQSLVLVLLHDLLFSSRSRIEASDKWPPKPAVMRHQARLKAELVRIQIREGKTKKEDLAKTSGEGEAVRYIRYNPNAGRPFEELGEYLKKKGYTKLDEPVYPIPEGKYFADPHLSDVLLAFPGSANWWVNDEWYEGGGVILQDKASCFPARVLMEGWVEGEGECLDATSAPGNKTSYVSALMANRGKLHAFERSPNRFKTLEKMLEKARCSNVQAQRADFTDTDPKSKEFKNVTRILLDPSCSGSGIVNRLDYLVDDDAEESDSKTERLEKLASFQLQMILHAFKFPSAQRIVYSTCSIHPEEDERVVMAALQSNTAKENGWGLASRESVLPKWERRGRPEEMEGDEELANGVIRCLPEDKTNGFFVSCFMRGDTGIRPKATKKAKDQRPPKRPLIEEQEEIAEEKGSPTVAVDEEGGEQAGKQDRLAANIPRKEKTKAQLERAKRKKAQQKVKGKKRKVEL

SEQ ID NO: 18857 - protein, 434 aa, Oryza sativa (japonica cultivar-group)
MEVFYYLVFGGLAAVVAGLELGKSAKDRVTTSQAFNSFKNNYVLVYSLMMSGDWLQGPYVYYLYSQYGFDKGDIGRLFIAGFGSSMLFGTIVGSLADKQGRKRACITYCISYILSCITKHSPEYKILMIGRVLGGIATSLLFSAFESWLVAEHNKRGFDSQWLSITFSKAIFLGNGLVAIVSGLFANLLADNLGFGPVAPFDAAACFLAIGMAIIMSSWSENYGDPSESKDLMSQFKVAAKAIASDEKIALLGAIQSLFEGSMYTFVFLWTPALSPNEEDIPHGFIFATFMLSSMLGSSIAARLLARKLKVEGYMQIVFTISAFTLFLPVVTNILVPTSSVKGGSISFGGTLQLLGFCTFEACVGIFWPSIMKMRSQYIPEEARSTIMNFFRIPLNLFVCVVLYNVSESVLTESHDSNLLISFKNNIFFCEFCR

SEQ ID NO: 18858 - protein, 543 aa, Cryptococcus neoformans var. neoformans JEC21
MNFYKSAALALDHLDKHQGSVKGSLAAAGVKASGAEAKRILALIIETLKYRPVLQQLLKTVPILALERTTFPSRTPAKTPTSQSLVLVLLHDLLFSSRSRIEASDKWPPKPAVMRHQARLKAELVRIQIREGKTKKEDLAKTSGEGEAVRYIRYNPNAGRPFEELGEYLKKKGYTKLDEPVYPIPEGKYFADPHLSDVLLAFPGSANWWVNDEWYEGGGVILQDKASCFPARVLMEGWVEGEGECLDATSAPGNKTSYVSALMANRGKLHAFERSPNRFKTLEKMLEKARCSNVQAQRADFTDTDPKSKEFKNVTRILLDPSCSGSGIVNRLDYLVDDDAEESDSKTERLEKLASFQLQMILHAFKFPSAQRIVYSTCSIHPEEDERVVMAALQSNTAKENGWGLASRESVLPKWERRGRPEEMEGDEELANGVIRCLPEDKTNGFFVSCFMRGDTGIRPKATKKAKDQRPPKRPLIEEQEEIAEEKGSPTVAVDEEGGEQAGKQDRLAANIPRKEKTKAQLERAKRKKAQQKVKGKKRKVEL

SEQ ID NO: 18859 - protein, 127 aa, Roseovarius nubinhibens ISM
MDLIAQLEAEQIASLGKEIPDFKAGDTVRVGYKVTEGTRTRVQNFEGVCISRKNGVGIAGSFTVRKISFGEGVERVFPLFSTNIDSIEVVRRGRVRRAKLYYLRARRGKSARIAEDSNYKPKTGASA

SEQ ID NO: 18860 - protein, 552 aa, Gibberella zeae PH-1
MGLTINNIFAVNEDRPTPKAVYNWRVYTCAAIASFASCMIGYDSAFIGTTIALPSFTAEFDFASYEPDALALLKANIVSVYQAGAFFGSLFAYVTSYFIGRRYSLIAFSFVFMLGAGMMLGANGDRGLGLIIGGRVLAGVGVGACSNMVPIYCSELSPPAIRGRLVGIYELGWQIGGLVGFWINYGLAETMAPSHKQWIIPFAVQLIPAGMLLFGAFWIKESPRWLFAKGRREEAMKNLCWLRQLPADDLYIVEEVSYMDQELERYNREVGPGFWKPFSCLKSRNIQWRFFLGGMMFLWQNGSGINAINYYSPTVFKSIGITGTNTGFLTTGIFGVVKTTVTIIFILFLIETVGRRKLLIIGSVGGSLCMWFIGAYIKVANPAGKVAAAEAAGTAAPGMSSGGIAAVFFFYLWTVFYSPTWNPIPWVLNSEMFDEKSRSLGQASAAANNWFWNFIVSRFTPQMFIKMGYGVYFFFASLMIMSATFVFFFIPETKGLPLDTMNRLFEIKPVWKAHGQLSQELRDQEEEFRRNAEGSKISDEKAQAIADEREDV

SEQ ID NO: 18861 - protein, 401 aa, Lactobacillus plantarum WCFS1
MSDLDQTNNYRYVIVGGGMVAGYAIKGIRQEDPEGAILVISQEADVPYERPALSKKLWLDDEFTEENIRIGAENYPNVTFKFKTTVTAINRQDKVITLTDSEQIKYEQLLLATGGEPRQIQGPADPHVLVFRQWSDYRKLRKFSGPNKRVVIIGGGYVGTELASSLTQNGTKVTMIFPEKALGEGKFPESIRAEYEATFKRNGVTLMSGQFVQSYQRQGDHLTLLTKDGTAIAADTIIVGLGVTPRISLAEDSSLDLADGGVKVDEYLNTSDPAIWSAGDIASYPDHILGRQRIEHVDHARLSGELVGRNMAGAHMSYQHTPYFYSMIFDISWQAIGNIDPKLQLIFDRRTHGLLVYFIDADKLVGVLVWNVKVNLDDVRALLANAPATDDLVGSIREQEG

SEQ ID NO: 18862 - protein, 262 aa, Campylobacter jejuni subsp. jejuni NCTC 11168
MKFLAVIGDPISHSKSPRMHNNAIKALGLDSIYTRYHLRNANCLREDFFKLGLSGANITLPFKEKALDIADVKDDFARNIGSANTLCLKEDKIYAYNTDALGFLEAIKDFDNIKKALILGAGGTALALAYVLKQKGVEVYIANRSKERFKDFLAYPTYLYKNLQDFDFDLVINSTSAGLKDENLPCDRELLDRILPKAKFAFEVIYGRETPFYRLCKEYHLKIKDGLDMLLWQGVFAFELFFEIQDKREMIKNAMQQALILK

SEQ ID NO: 18863 - protein, 525 aa, Schizosaccharomyces pombe
MSKAATVPVAFQDREKPQEVRLSNIMAARSVADAIRTSLGPKGMDKMIQTGKGEVILTNDGATILKHLSVLHPAAKMRVDLSAAQDVEAGDGTTSVVILAGSMLACAEKLLKKGIHPTVIAESFQRAAGFTVDCMKENALAIELSDRESLLRAATTSLNSKIVSQYSNLLAPIAVDAVLKVIDPRVATNVDLKDIRIVKKLGGIIDDTELIPGLALTQTAVKSAGPTRIEKANIALIQFQLSPPKPDMENQVVVNDYRQMDKILKEERQYLLNMCKKIKKAGANVILIQKSILRDAVNDLALHFLAKLKIMVIKEVIERDEVEFICKSTGCKPIADIESFAEDKLGHADLVEETSSSGEKIVKFSGVKNAGKTVSILCRGANLLTLEEAERSLHDALCVIRCLVKQRALIAGGGSPEIEAAQRLLEHARQLEGREAICIGAFSEALEIIPVTLAENAGLNAIRIVTELRKSYLREDCGYNVRKGIVTNILEENVLQPLLVNISAIQLAAETTKMIMKIDDITLAR

SEQ ID NO: 18864 - protein, 299 aa, Thermus thermophilus HB8
MFRGSIPPLPTPFRRGRLDEEALRRLVERVVQGGSHGVSVGGTTGEPGTQTLEERKRAIEVVLDQVAGRVPVIPGTGALRLEETLELTRFAKEAGAQGAMVIVPYYVKPNQEGLYRYFAEVARTVPDFPLLIYNIPGRAGVEIAPKTVGRLRRDFPNIVGLKHSSKDLEYLSHLFLEAGRDFLVFCGLESLTLPMMSLGAVGTIAATANWLPKEVALLCEKALAGDYQGARELHFHLLEANEAIFWDTNPIPLKTVLSWMGLLEKEWRPPLGPTTPEVEERLRRMAERYGLLPKEKEAA

SEQ ID NO: 18865 - protein, 356 aa, uncultured bacterium
  misc_feature (274)..(274): Xaa can be any naturally occurring amino acid
  unsure (1)..(356): unsure at all Xaa locations
FHAIGAANNLLAAMLDNHIYQGNALGIDPRKITWKRCMDMNDRQLRFIVDGLNGKTNGSPREDGFDITVASEIMAILCLSRSLDDLKQRIRRIIVGYTWDDKPVTAGQLKAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKFGLPAVVAINRFPTDTEAEMKLVEASCQKHGAXVALSEVWAKGGSGGRELAEEVVRLAATPNDNFRFIYDTELPIREKVKAIVSQIYGGDGVDFGPAALKQMKRLEELGFGNLPI

SEQ ID NO: 18866 - protein, 351 aa, Arabidopsis thaliana
MGRAARWFKGMFGTKKSKDRSHVSGGDSVKGGDHSGDFNVPRDSVLLGTILTDTEKDQNKNAIAVATATATAADAAVSAAVVRLTSEGRAGDIIITKEERWAAVKIQKVFRGSLARKALRALKGIVKLQALVRGYLVRKRAAAMLQSIQTLIRVQTAMRSKRINRSLNKEYNNMFQPRQSFDKFDEATFDDRRTKIVEKDDRYMRRSSSRSRSRQVHNVVSMSDYEGDFVYKGNDLELCFSDEKWKFATAQNTPRLLHHHSANNRYYVMQSPAKSVGGKALCDYESSVSTPGYMEKTKSFKAKVRSHSAPRQRSERQRLSLDEVMASKSSVSGVSMSHQHPPRHSCSCDPL

SEQ ID NO: 18867 - protein, 442 aa, Arabidopsis thaliana
  misc_feature (229)..(229): Xaa can be any naturally occurring amino acid
  misc_feature (242)..(242): Xaa can be any naturally occurring amino acid
  unsure (1)..(442): unsure at all Xaa locations
MNALAATNRNFRHASRILGLDSKIERSLMIPFREIKVECTIPKDDGTLVSYIGFRVQHDNARGPMKGGIRYHPEVDPDEVNALAQLMTWKTAVADIPYGGAKGGIGCSPRDLSLSELERLTRVFTQKIHDLIGIHTDVPAPDMGTNAQTMAWILDEYSKFHGHSPAVVTGKPIDLGGSLGREAATGRGVVFATEALLAEYGKSIQGLTFVIQVKPLSANLRSQALLCIXYKTEMLRDLDDMXQGFGNVGTWAAKLIHEKGGKVVAVSDITGAIRNPEGIDINALIKHKDATGSLNDFNGGDAMNSDELLIHECDVLIPCALGGVLNKENAGDVKAKFIVEAANHPTDPDADEILSKKGVIILPDIYANAGGVTVSYFEWVQNIQGFMWEEEKVNLELQKYMTRAFHNIKTMCHTHSCNLRMGAFTLGVNRVARATQLRGWEA

SEQ ID NO: 18868 - protein, 354 aa, uncultured bacterium
  misc_feature (272)..(272): Xaa can be any naturally occurring amino acid
  unsure (1)..(354): unsure at all Xaa locations
AIGAANNLLAAMLDNHIYQGNALGIDPRKITWKRCMDMNDRQLRFIVDGLNGKTNGSPREDGFDITVASEIMAILCLSRSLDDLKQRIRRIIVGYTWDDKPVTAGQLKAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKFGLPAVVAINRFPTDTEAEMKLVEASCQKHGAXVALSEVWAKGGSGGRELAEEVVRLAATPNDNFRFIYDTELPIREKVKAIVSQIYGGDGVDFGPAALKQMKRLEELGFGNLPI

SEQ ID NO: 18869 - protein, 230 aa, Mannheimia succiniciproducens MBEL55E
MKKLFAEFFGTFWLVFGGCGSAVLAAAYPELGIGFAGVALAFGLTVLTMAYAVGHISGGHFNPAVTLGLVAGGRFQAKEAFSYILAQVVGGVMGATVLYAIASGKVGFDAVNGGFASNGFGEHSPNGYSLAAVFIAEVVLTAFFLIIIHGATDKRAPAGFAPIAIGLALTLIHLISIPVSNTSVNPARSTAVAVFQGGWALEQLWVFWVAPIIGGIIGGIIYRVLLESKD

SEQ ID NO: 18870 - protein, 356 aa, uncultured bacterium
  misc_feature (57)..(57): Xaa can be any naturally occurring amino acid
  unsure (1)..(356): unsure at all Xaa locations
FHAIGAANNLLAAMLDNHIYQGNALGIDPRKITWKRCMDMNDRQLRFIVDGLNGKTXGSPREDGFDITVASEIMAILCLSRSLDDLKQRIRRIIVGYTWDDKPVTAGQLKAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKFGLPAVVAINRFPTDTEAEMKLVEASCQKHGPNVALSEVWAKGGSGGRELAEEVVRLAATPNDNFRFIYDTELPIREKVKAIVSQIYGGDGVDFGPAALKQMKRLEELGFGNLPI

SEQ ID NO: 18871 - protein, 370 aa, Chlamydomonas reinhardtii
MARGPGDTDMDEASADAAIPSSTPNPTVAFRCTHALSGHTKAVAAVKFSPDGSLLASGSADRTVALWDAATGARVNTLAGHSCGVSDVAWNPNGRYLATAADDHSLKLWDAETGACLRTLTGHTNYVFCCNFDGAAGHLLASGSFDETLRLWDVRSGRCLREVPAHSDPVTSAAFSYDGSMVVTSSLDGLIRLWDTQTGHCLKTLFDRDSPPVSFAAFTPNAKYVLCNTLDGRAKLWDYAAGRTRRTYAGGHVNTQFCISSGFLGGSSSASFDLGCSMVVTGSEDGSLAAYDISTGHVVGRGAAAAAAAEGGGDEGSAAAAAAGGVAGGHTAAVLSVNVHPSAPLVATGGHHPDNSVRVWAASRTEPAAA

SEQ ID NO: 18872 - protein, 307 aa, Clostridium perfringens SM101
MDINLDALVEANRKYTKDGHVATYIPALAKVNPNQLGVCIYDLKENKKFSAGEYDVRFAIESISKVPTLILAILDNGIEKVFSEVGTEPSGFAFNSIMNMQINHKNKPSNPFINAGAIKVVSLLKGKNDEERFKRILDFYRKIMNDDEITLDTEIYLSERETGDINRSLAYYMKGNGIMEGDVTDILDSYFKQCSVLVTAEDLARLGAVLANEGVMPWNGERLFSVETATVVKSLMTTYGLYDESGAFSVHIGLPSKSGVGGGILSSVPNKCGIGLFSPALDVPGNSVTSMKLLKEIADKLKLDIFR

SEQ ID NO: 18873 - protein, 350 aa, Triticum aestivum
  misc_feature (59)..(60): Xaa can be any naturally occurring amino acid
  unsure (1)..(350): unsure at all Xaa locations
RERERELGHSFDAPLASTFVDMYAKCGNLDDACRMFDRAPMKNVALWTSMLCSYASHGXXRMAIELFNRMIAEKIKPNEVTLVGVLSACSHGRLVSEGEHFFKLMQEEYGIVPSIEHYNCMVDLYGRAGLLNKANNFINENKIKHESIVWKTLLSACRVHKDMEHAKLASESLIQLEQCDAGSYVMLSNMYATHSKWRDTSKLRSLMRERGVRKQPGQSWIHLKNIVHTFVAGDTAHPRSSEIYTCLAKLMERIKELGYTSRIDLVAHDVEEEQRETALRFHSEKLAMAFGIISTPSGTPLRIFKNLRICVDCHEAIKYVSRATDREIVVRDLYRFHHFKDARCSCEDFW

SEQ ID NO: 18874 - protein, 448 aa, Streptococcus pneumoniae TIGR4
MREYDIIAIGGGSGGIATMNRAGEHGAKAAVIEEKKLGGTCVNVGCVPKKIMWYGAQIAETFHQFGEDYGFKTTDLNFDFATLRRNREAYIDRARSSYDGSFKRNGVDLIEGHAEFVDSHTVSVNGELIRAKHIVIATGAHPSIPNIPGAELGGSSDDVFAWEELPESIAILGAGYIAVELAGVLHTFGVKTDLFVRRDRPLRGFDSYIVEGLVKEMERTNLPLHTHKVPVKLEKTTDGITIHFEDGTSHTASQVIWATGRRPNVKGLQLEKAGVTLNERGFIQVDEYQNTVVEGIYALGDVTGEKELTPVAIKAGRTLSERLFNGKTTAKMDYSTIPTVVFSHPAIGTVGLTEEQAIKEYGQDQIKVYKSSFASMYSACTRNRQESRFKLITAGSEEKVVGLHGIGYGVDEMIQGFAVAIKMGATKADFDATVAIHPTASEEFVTMR

SEQ ID NO: 18875 - protein, 120 aa, Anabaena variabilis ATCC 29413
MSAQEIIRSIEAEQLKSNLPEIYIGDTVRVGVKIKEGDKYRVQPYEGVVIARRNGGINETITVRRVFQGVGVERVFLLHSPRIDNIKVLRRGKVRRAKLYYLRGRVGKATRIKQRFDRSL

SEQ ID NO: 18876 - protein, 437 aa, Streptomyces clavuligerus
MFHPVLPRGREDRTVLVSGRGCTVRDTEGRTYLDASSVLGLTQIGHGREEIAQAAAEQMRTLGHFHTWGTISNDKAIRLAARLTDLAPQGLQRVYFTSGGGEGVEIALRMARYFHHRTGSPERTWILSRRTAYHGIGYGSGTVSGSPAYQDGFGPVLPHVHHLTPPDPYHAELYDGEDVTEYCLRELARTIDEIGPGRIAAMIGEPVMGAGGAVVPPPDYWPRVAALLRSHGILLILDEVVTAFGRTGTWFAAEHFGVTPDLLVTAKGITSGYVPHGAVLLTEEVADAVNGETGFPIGFTYTGHPTACAVALANLDIIEREGLLENAVKVGDHLAGRLAALRGLPAVGDVRQLGMMLAVELVSDKTARTPLPGGTLGVVDALREDAGVIVRATPRSLVLNPALVMDRATADEVADGLDSVLRRLAPDGRIGAAPRRG

SEQ ID NO: 18877 - protein, 478 aa, Rickettsia akari str. Hartford
MINNFFNLIRIFRIISKKRILIDSRSPKYFTFIGYILALFSAPLSLFKKPYEDYGKRLIDCLSDLGPIYIKFGQTLSTRPDLVGAEIAGNLRVLQDKLAPFDGVVAREIIEREFGKCIVSPWLDHGIQKKIKKDWIPQSSLGMTLFLNNSPIAAASISQVHKAQLATGEYVAVKILRPGIHKKYNRDIKLLYFLAKIIAKFSKAKRLKPIKVVDKFHETMRFELDLRLEAAAASELMDNMRHDVNVIIPKIYWDLTSENILTTEWLEGTSIYDTLRLEELGLEPTKIAQNFAVMFFNQAYRDGFFHADLHAGNILVNKQGKIILLDFGIMGRLKEKDRLAVAESLFGFLKRDYKLVAKVHLRAGYIPSNTDLDLFAQSCRAVTEPIVGIPTKNISIGKLLAHLFKITEEFGMEVQPELLLLQKTLIMVEGIGRQLDGNVNMWQLAEPWIKKWAVKNLSTEAKLLRLVKHYLDILEDIV

SEQ ID NO: 18878 - protein, 317 aa, Rhodococcus sp. RHA1
MTEPLLAHYRQMYRIRVLENEILRLRKIEEVVGSVHLCNGQEAIYVGAAAGLDLSRDAVFPTYRGHGWALALGATMHSILAELLGRSTGTNGGRGGSAYFSTPDTAMYGENSIVGAGAPIAAGAALAATFDGSGRVAVAAFGDGALNQGAVHEAMNFAAVQQLPIIFLVENNHYSEMTPIVDMVKNPVLFKRAAAYGITGARIDGNDPIAVRDAVSKAAQHARAGKGPVLLEAMTHRIVGHYIGDAQQYRPAGEIDDIEADEPLVRAARNLLQESGVTQTELDALIADVNDEVRAASLAALADPVADPTTVLEHLYA

SEQ ID NO: 18879 - protein, 334 aa, Rhodococcus sp. RHA1
MPDTKNLSYAGAVNEALRQILDDDPKALVFGEDVAAPGGVFGVTKGLQKTFGRRVFDTPISESAILGGAVGSALFGMRPIVEIMWADFTLVAFDQLVNQAANVRYVSQGALTAPITVRMQQGSAPGACAQHSQSLEALFAHIPGLQVCMPATHQDAYDLLLTAAASPDPTIVIENRTLYHRDKQPVTLGGPVAPLGGAVVRREGTALTAVTWGAMQFQVLEAADALASRGIDIEVIDARWLRPLDMGHILSSVARTRRLAVIHEAHTIGGVGAEIVAAVAAAGIELDQPPLRIGTPDARIPAAPSLAQALIPNADRIIREIDSAFAAHAAKVSV

SEQ ID NO: 18880 - protein, 557 aa, Zea mays
  misc_feature (356)..(356): Xaa can be any naturally occurring amino acid
  unsure (1)..(557): unsure at all Xaa locations
EAAPSAAPPSSRGHRFRLCPRISLRHRFLRRFSATTEGDPVAVAFNTMVTPPTVEQEDEEMLVPRQEAVDTDAAQPMEGTVVAQTEVVSTAESQPVEDPQTSRFTWTIENFTRFSEKKHYLEVFVVGGFKWSVLIFPKGNNVDHFSMYLDVADSTSLPYGWSRYAQFSLAVVNQIQPEFTIRKETQHQFNARESDWGFTSFMPLSELYDASRGYLVNDTVVVEAEVAVRRMVDYWTYDSKKETGYVGLKNQGATSTCYMNSLLQTLYHIPYFRKAVYHMPTTENDIPSGSIPLALQSLFYKLQYSDSSVATKELTKSFGWDTYDSFMQHDVQELNRFLSKKLGDKMKGTVQQGTIXQLFEGNHINYVECLNVEHNSNRRESFYDSFDKYVEVERLEGDNKYHAENHGLQDAKKGVLFLDFPPVLQLQLKRFEYDYMRDSMVKINDRYEFPLQLDLDRDGGKYIAPNADRSTRNLYTLHRYKFDDERVTKEDAKKALEEQYGGDEELPQINPGFNNAPFKFTKYSNAYMLVYIRESAKEKIMCTVDEKDIAEHLRVRL

SEQ ID NO: 18881 - protein, 400 aa, Bacillus cereus ATCC 14579
MMTYTLATRMKAFQSSIFSELGAYKKEKIAAGHNMIDLSIGNPDMPPADFVRETMVHTASEKESYGYTLSGIQEFHEAVTEYYNNTHNVLLNADKEVLLLMGSQDGLVHLPMVYANPGDIILVPDPGYTAYETGIQMAGAISYYMPLKKENDFLPDLEVIPEEIADLAKMMILNFPGNPVPAMAHEDFFKEVIAFAKKHNIIVVHDFAYAEFYFDGNKPISFLSVPGAKEVGVEINSLSKSYSLAGSRIGYMIGNEEIVRALTQFKSNTDYGVFLPIQKAACAALRNGATFCEKNREIYQERRDTLIDGFRTFGWNVDKPAGSMFVWAEIPQGWTSLDFAYALMDRANVVVTPGHAFGPHGEGFVRIALVQDKEVLQQVVENIRNSGIFVLEKVNELVKN

SEQ ID NO: 18882 - protein, 99 aa, Zea mays
TNDLPHMTFVSSRDDVGKCMAFYFAQGILQHDPFKVLDQRGVADLLNFATERGLNASPNLKVAICGKHGGKPSSVAFFTKAGLNYLSCPPFRVPIARLT

SEQ ID NO: 18883 - protein, 384 aa, Arabidopsis thaliana
MCNGSDRLGQREAEEICTNNVRVFSYNSLRSATDSFHPTNRIGGGGYGVVFKGVLRDGTQVAVKSLSAESKQGTREFLTEINLISNIHHPNLVKLIGCCIEGNNRILVYEYLENNSLASVLLGSRSRYVPLDWSKRAAICVGTASGLAFLHEEVEPHVVHRDIKASNILLDSNFSPKIGDFGLAKLFPDNVTHVSTRVAGTVGYLAPEYALLGQLTKKADVYSFGILVLEVISGNSSTRAAFGDEYMVLVEWVKLKASEERRLLECVDPELTKFPADEVTRFIKVALFCTQAAAQKRPNMKQVMEMLRRKELNLNEDALTEPGVYRGVNRGRNHRGIGLRVGQGGSSQESSSTQRDKGKSSAVPQGSTSNSNISFQSITELAPR

SEQ ID NO: 18884 - protein, 356 aa, uncultured bacterium
FHAIGAANNLLAAMLDNHIYQGNALGIDPRKITWKRCMDMNDRQLRFIVDGLNGKTNGSPREDGFDITVASEIMAILCLSRSLDDLKQRIRRIIVGYTWDDKPVTAGQLKAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKFGLPAVVAINRFPTDTEAEMKLVEASCQKHGANVALSEVWAKGGSGGRELAEEVVRLAATPNDNFRFIYDTELPIREKVKAIVSQIYGGDGVDFGPAALKQMKRLEELGFGNLPI

SEQ ID NO: 18885 - protein, 1252 aa, Coccidioides immitis RS
MEKDTIKDRSQTKRQPFRDASNRLNIVHNSSRQTRYDHVALSSEKQMTSSDPPDALNGHDFPPATAENKRISAVLDYHSDPRRNSAISTTSTNSGRSRRKTHIGPWQLGKTLGKGSTGRVRLAKHSVTGQAAAIKIVSKQSAALAQSQSIAAMDKNIDVAPGSRTIPSGIEREVVIMKLIEHPNVISLYDVWENRGELYLVLEYVEGGELFDYVSERGPLPEIEAVRLFRQIIAALSCCHQYNICHRDLKPENILLDFRKNIKLADFGMAALQPAGHWLNTSCGSPHYASPEIINGQRYHGDKADIWSCGIILFAMLAGFLPFDGGDLANTLKLVKRGEYIIPPWFSPEAIDLIQRILQKRPENRISIDQMWLHPLLMKYQAHPIFANSPMDSIGPPPPLPSKDFKKIVTHRRDIDLEVLRSLQTLWHEKRKEDLIENLLNDKPNHEKLFYKALLKFREEQLENYEGPPLGYSSSDYHHISRPLFRLQRRMPSNHGESNVWRRSKFSIATNSSGMREGSSRGPTSAPTIASYDPYRSSRTAIAEPKVEYANVTIHRHQSNDSSAALNSKSSPPTGKLSMDRASVNMRSSPNGGPGTSSRRSSLASYQSRSSVGSHCQRAKSRHSYKRNVSFRHLRGHNPNRDDKRIGMPPGHSQYSLCQERNKMGKRESERVKRLSSERFSSPSLPSPPTCVRPATNKVGELEVGAKPRQSYQYWKEEARKVSQELEQICEEAFNSSSLSSSYTIETGSKYPESPVTSISTPGNLNRYYGQTNTKPVRGQTFESSSSYATRELAETRRRLIEHSKKARADGLPSHLSEVISHLDRLIEGKPSHSVAKNAALAAEAARPPHNVTRNLPSILEERHSVKDFLSGETTSSYIPPPLDLDVWEKKTIRVVPDSTNNLDNIRPLTIRKKRTTLELPTPSNESTSFSQPQRSLSQSLTRNRSTGRRSNTGRFFSGLEPIEENPKSSKKNEFRNSGDTRKWSRFKYRSQSYSDVGPPTPPKDDVPLSRQSSISHMTSGASQGTEEYPVVEDDNLNWIKKNKPVETGKKLLKLFGMKKREKAVHEFGQESNCFNISVTSLDNKDESDIFGTKNHFLSNTQNEAGSPTHPASSQNWFMKFFRIKAASKVIALNAPKARARKEVIKILREWKKYGMEGIRVDKQNSVIRGRVGELNFLRLRPVEFSAELFTVLEYGRHVSLSLIRLKQERGAASSFRKVVETLIAVLKQRKLLVEDTVKAKKMAKVLSLTGQ

SEQ ID NO: 18886 - protein, 782 aa, Saccharomyces cerevisiae
MNILKKFMESGNKPELITIPSGQFNLLRSKNSPKAALECIYNNATLSVRKIGKFDYELAVYRVEDDSEGGTGDEAENFEDDTISVLSTQSKKKEEEWSVEISDKIMFHKTWDKQGNVALVWENLRGDEQDEKVQFVVAADVSFSDVEQFIQTVYRCQFEVRNKKSSLTASADDLKEIEHRSTRLFVQDDDDELDSSSDDFQDAKDTSFEHEKESEILERTPSPLKKVPEGEYCCLVMSSLYMYDPIQEKFILQEPVVKVAIIDTGKYEFWLAIEGKDNRLGTQVAPNINPTFELATDAFLFNYTLQNITLSYMLKFKDLDKCIQFRFAWVKCLWMTLNKETWTDVPEKEKDYILDSSSVPLEKQFDDILHIDDRSNEERDKESSESENDSEDEDDENDHSKRIISSEAFEEPRRATSKGNSSLTVAFRNNRSYVTRDNRIGVFKTDDEDDSLEFVAAIKNISNLGGKSIDPHKPMLYMEDRNLILTDGENENKLYKMDIERGKVIEEWSTGDKNVVQYGPTKKFDQMTPEQTIVGVSQKGVFKIDPRINGKNKIAVDESKDYVGKYNFSSIGTTESGYIAIGSEKGDIKLYDRLGIRAKTAIPSLGQAIKFITTSADGKWLLATCESTLLLMDLKIKDGKNAGNIGFLKSFPASENVKTYVLKIRPEHSASILTYTKKPIRFTKAYFNTGIGQQEQTIVTSTGPYAISWSLKGILNQDGSNNYPYRIRRYNADVVADNFEFGSDKKVIVALKDDVSLSKVKSFKQPSKGVLMPSASLQDFYG

SEQ ID NO: 18887 - protein, 356 aa, uncultured bacterium
  misc_feature (274)..(274): Xaa can be any naturally occurring amino acid
  unsure (1)..(356): unsure at all Xaa locations
FHAIGAANNLLAAMLDNHIYQGNALGIDPRKITWKRCMDMNDRQLRFIVDGLNGKTNGSLREDGFDITVASEIMAILCLSRSLDDLKQRIRRIIVGYTWDDKPVTAGQLKAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKFGLPAVVAINRFPTDTEAEMKLVEASCQKHGAXVALSEVWAKGGSGGRELAEEVVRLAATPNDNFRFIYDTELPIREKVKAIVSQIYGGDGVDFGPAALKQMKRLEELGFGNLPI

SEQ ID NO: 18888 - protein, 719 aa, Oryza sativa (japonica cultivar-group)
MKKEFPGQAPTSRLHSEMDAAAAGGGGAAKRKRSFSEDDAYLILHRYQPATILTMLQEMGKQVGAGKGIDWRALVRRTSTGITSAREYQMLWRHLAYGHEFVESVEPASLPLDDGSDLECEIEIVPAPGNEALAEATSFAKTIITGSSREQTSGQRVNSEAAALNTPNEKIVRVPSDKQLVPGHRLTNGTGPVSSSKQPSHTGSSPDPLDPNGHPKKKKKPKPWSREEDMELGAGVQKHGEGNWMEILHKYKFDSSRTHLQLQQRWALICKRQGSTKPATPKIPNVMSEELKAAQKAFSLAIGTTRSSTLRPGGVPHHNPMVTTTNPEVKSVTAPSPLPVPVHVVPVPVPVQPVQVQLPPPQLHQAPAQSAPPPPKVSNASNKSRNNSKKQVAQSIPVNGPLSIQEAALAAGGRIAEPSVATNFLKAAQSTKAVHIRSRGTGSSKSSTGSKTPTVAGEPGTQLGSDQHLELQSTGGPSQVLTAHATEQVHNVSEVAGVNPLGQSAGVHLSETKKALNTTPVSGSSDKMEIDDNSNYFAVTMEDLFPEDVKQEDVQDPKIEEAIDPKDADMLEFDRFVAQGCLNKDNVDKSKAAKIAPEAQSVIGSQKKQLKTLPTVGKSNPVFAGPPATAKKTKAPVPQGGMSSGIVGVLNRSLGGKAPAPATTGTQSTVQKQQSMSSKGNLLVPKNVAPGTVTPANNRANTAVNGASKVNPPASQKPA

SEQ ID NO: 18889 - protein, 564 aa, Arabidopsis thaliana
MAIAEEEAALIEDSVSDSVDHRGLPAGKSSTGGWRSAWYIIGVEVGERFAYFGIGSNLITYLTGPLGQSTATAAVNVNTWSGTASILPVLGAFIADAYLGRYRTIVVASLIYILGLGLLTLSSILILMGLSEQRQHNRNASAKPFFWVNILFFCSLYLVAIGQGGHKPCVQAFGADQFDVGDPKERISRGSFFNWWFLSLSAGITLSIIVVVYVQDNVNWALGFGIPCLFMVMALALFLFGRKTYRYPRGDREGKNNAFARIGRVFLVAFKNRKLKLTHSGQLEVGSYKKCKGQLEFLAKALLPGEGGVEPCSSRDVEDAMALVRLIPIWITSVVSTIPYAQYATFFTKQGVTVDRKILPGFEIPPASFQALIGLSIFISVPTYERVFLPLARLITKKPSGITMLQRIGAGMVLSSLNMVVAALVEMKRLETAKEHGLVDRPDATIPMSIWWFVPQYLLLGMIDVFSLVGTQEFFYDQVPTELRSIGLALSLSAMGLASFLSGFLITVINWATGKNGGDSWFNTNLNRAHVDYFYWLLAAFTAIGFLAFLLLSRLYVYRRVDQV

SEQ ID NO: 18890 - protein, 626 aa, Streptococcus pneumoniae TIGR4
MGYDVFYLTGLDEHGQKIQQKAEEAGITPQAYVDGMAVGVKELWQLLDISYDKFIRTTDDYHEKVVAQVFERLLAQDDIYLGEYSGWYSVSDEEFFTESQLAEVFRDEAGNVTGGIAPSGHEVEWVSEESYFLRLSKYQDRLVEFFKAHPEFITPDGRLNEMLRNFIEPGLEDLAVSRTTFTWGVPVPSNPKHVVYVWIDALLNYATALGYAQDEHGNFDKFWNGTVFHMVGKDILRFHSIYWPILLMMLDVKLPDRLIAHGWFVMKDGKMSKSKGNVVYPEMLVERYGLDPLRYYLMRNLPVGSDGTFTPEDYVGRINYELANDLGNLLNRTVSMINKYFDGQIPAYVEGVTEFDHVLAEVAEQSIADFHTHMEAVDYPRALEAVWTLISRTNKYIDETAPWVLAKDEALRDQLASVMSHLAASIRVVAHLIEPFMMETSRAVLTQLGLEEVSSLENLSLADFPADVTVVAKGTPIFPRLNMEEEIAYIKEQMEGNKPAVEKEWNPDEVELKLNKDEIKFEDFDKVEIRVAEVKEVSKVEGSDKLLQFRLDAGDGEDRQILSGIAKYYPNEQELVGKKVQIVANLKPRKMMKKYVSQGMILSAEHDGKLTLLTVDPAVPNGSVIG

SEQ ID NO: 18891 - protein, 356 aa, uncultured bacterium
  misc_feature (274)..(274): Xaa can be any naturally occurring amino acid
  misc_feature (288)..(288): Xaa can be any naturally occurring amino acid
  misc_feature (295)..(295): Xaa can be any naturally occurring amino acid
  unsure (1)..(356): unsure at all Xaa locations
FHAIGAANNLLAAMLDNHIYQGNALGIDPRKITWKRCMDMNDRQLRFIVDGLNGKTNGSPREDGFDITVASEIMAILCLSRSLDDLKQRIRRIIVGYTWDDKPVTAGQLRAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKFGLPAVVAINRFPTDTEAEMKLVEASCQKHGAXVALSEVWAKGGSGXRELAEEXVRLAATPNDNFRFIYDTELPIREKVKAIVSQIYGGDGVDFGPAALKQMKRLEELGFGNLPI

SEQ ID NO: 18892 - protein, 494 aa, Sphingomonas sp.
MTSVSSSPITDTILNFIDGSYREGSEGKSFSNVNPATGAEIGVVHEASQADVADAVAAAKAALTGPWGKMTTAERVKLITAVATEIERRADDFLAAEVADTGKPRHVASHIDIPRGAANFRMFADVVSTMPGESFNTPTPDGGQAFNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAATGVRDISFELGGKNPAIVFADADLDKAVEGLSRSVFLNTGQVCLGTERVYVERPIFDAFVARMAAAAQDFKPGVTGDRAYLGPLISAEHREKVLGYYRRAVEDGATVVTGGGVPEISGAEAGGFFVEPTLWIDVAHGDTVMREEIFGPCCGILPFDSEDEVIALANDTVYGLCASVWTENLSRGHRVAAAMEVGVCWVNSWFLRDLRTAFGGSGHSGIGREGGVHSLEFYTEITNICVKL

SEQ ID NO: 18893 - protein, 348 aa, Brassica napus
  misc_feature (53)..(53): Xaa can be any naturally occurring amino acid
  misc_feature (325)..(325): Xaa can be any naturally occurring amino acid
  unsure (1)..(348): unsure at all Xaa locations
MAPTGEKPLIVSFGEMLIDFVPTESGVSLAEAPGFLKAPGGAPANVAIAVSRXSAERSAFVGKLGDDEFGHMLAGILRKNGVADQGINFDTGARTALAFVTLKADGDREFMFYRNPSADMLLRPDELDLELIRSAKVFHYGSISLIVEPCRSAHLKAMEVAKEAGALLSYDPNLREPLWPSKEEAKTQIMSIWDKAEIIKVSDVELEFLTGSNKIDDETAMSLWHPNLKLLLVTLGEKGCRYYAKNFRGSVDPFHVNAVDTTGAGDSFVGALLNKIADDHSILEDEERLRKVLRFANACGAITTTKKGAIPALPSEAEVLSFLEXSRKQKTTLKLSPSKSVFAYVILL

SEQ ID NO: 18894 - protein, 782 aa, Cryptococcus neoformans var. neoformans JEC21
MPPLVRRSTTSSIPTLLSLTKLVQLVPRSAQQWSSFGAATPPIEPEDPPDSPKFWWKLGLSVVLVLAGGVFAGLTLALMGSDDLNLRVLSTSSCNPKERKAANKVLRLLARGRHWVLVVLLLGNVIVNESLPIFLDDVLGGGLSAIIVSTTMIVIFGEIIPQAICVRYGLSIGGVCAPVVWALMILFAPIAWPIAKLLDRILGKDEGHTYKKAELKSFLQFHREGEEPLRDDEIVILNSVLSLNDKHAKEIMTPIEDCLILPSNKILNHDTIDEILLSGFSRIPIHEPGQKDNFIGMLLVKKLISYNPDDEWPVSKFPLLPLPEAKPEINCFQALDYFQTGRAHLILISDTPGQRGGALGIVSLEDLIEEIIGEEIVDETDRYQDNHSKKAVKRSGTAAVMRGIIERRRVLNAFSRAPSRSDPQTPVGLSGPDGKGANSTNGILVQVSEGSLIAETVDLSNDGATAAADPSRRLVISAAEPMSPIQEISTSPEIMYEAIQNGNRENGVQEESKDVKDAKRSALDQEAKNGSNLESEAYPDHEIFEMACKALVDKYCLTKEGEVGPGRTNKGWEWREHKFVAHQGYLYRRIVRYAPSTLFSYPLGQTHSDQSFNQTNEDEEDLEDAEDSALLPQQQDVLRSTKVEIEQYIVYSRTYRVPMYCFRAWDEAGAPLSISLLLKLNILHPPSPPQPLGFGDFGAALDTLMLPPENLPGEDTSPFPLVQSTEHPTTGELVFSIHPCRIGGAVEEVLTTEGLGKGAQAGLEWLEVWMAMTSKIADLTYA

SEQ ID NO: 18895 - protein, 461 aa, Arabidopsis thaliana
MASSSSQRRCVFVGNIPYDATEEQLREICGEVGPVVSFRLVTDRETGKPKGYGFCEYKDEETALSARRNLQSYEINGRQLRVDFAENDKGTDKTRDQSQGGPGLPSTTTVTESQKQIGGPVDSNMHQPVGLHLATTAASVIAGAIGGPQVGSQFTQSNLQVPASDPLALHLAKMSRSQLTEIISSIKLMATQNKEHARQLLVSRPQLLKAVFLAQVMLGIVSPQVLQSPNIVQAPSHMTGSSIQDAQLSGQNLLPPLAQRSQQLSRAPHSQYPVQQSSKQPFSQIPQLVAQPGPSSVNPPPRSQVKVENAPFQRQQVVPASTNIGYSSQNSVPNNAIQPSQVPHQALPNSVMQQGGQTVSLNFGKRINEGPPHQSMNRPSKMMKVEDRRTTSLPGGHVSNSMLPNQAQAPQTHISPDVQSTLLQQVMNLTPEQLRLLTPEQQQEVLKLQQALKQDHMMQPS

SEQ ID NO: 18896 - protein, 415 aa, Pseudomonas fluorescens PfO-1
MDAFNYRGGELFAEGVALSAIADRFGTPTYVYSRAHIEAQYLAYADALAGMPHLVCFAVKANSNLGVLNVLARIGAGFDIVSRGELERVLAAGGSPDKIVFSGVGKTRDDMRRALEVGVHCFNVESTDELERLQVVAAELGVRAPISLRVNPDVDAGTHPYISTGLKENKFGIAIADAEDVYVRAAHLPNLEVVGVDCHIGSQLTTLPPFLDALDRLLDLVDRLGDCGIHLRHIDLGGGLGVRYRDEEPPLAADYIKAVRERLVGRDLALVFEPGRFIVANAGVLLTQVEYLKHTEHKDFAIVDAAMNDLIRPALYQAWMDVTPVKPRETAARTYDVVGPICETGDFLAKERELALEEGDLLAVHSAGAYGFVMSSNYNTRGRAAEVLVDGDQAFEVRRRETVAELFAGESLLPE

SEQ ID NO: 18897 - protein, 535 aa, Oryza sativa (japonica cultivar-group)
MVPPALGAAGAAEGFPGRWKAIAAKLEGLPACLSDLSSHPCFAKNALCRELLQSVAATLAEAAELAARCREPPAAGKLQMQSAIDALAGKLDLNLRDCALLVKTGVLSDAFTPPPPTDEATSTATAAQADVRELLARLQIGHTEAKSLAVDGLLEALNKDEKSVLSVLGRANVAALVQLLTAPATKVREKAATVICQLAESGGCEGLLVSEGALPPLIRLAESGSLLGREKAVITLQRLSMSSDTARAIAGHGGARPLIEMCQTGDSISQSAAAGALKNLSAVPEVRQALADEGIVRVMVGLLDCGTVLGSKEHAADCLQNLTSSSDSFRRAVVSDGGLRSLLVYLDGPLPQESAVSALRNLVSAVSPDSLVSLGVLPRLAHVLRVGSTGAQQAAAAAICRISTTTDMKRVVGEHGCVPLLVRMLDAKSNGAREVAAQAMASLVGYPPNAREVRRDGKSVPCLVQLLDPSPANTAKKYAIACLLSLAAAKRCKKLMISHGAIGYLKKLSDMDVAGAKKLLERLERGKLRSLFSRD

SEQ ID NO: 18898 - protein, 603 aa, Ostreococcus tauri
MGGAVRRTRAGRFGAASATETAKAEDDEVASAEVGVSVGASAMGGAEDEASGTACPYTAAKEALGLAPPPPTRRDENGNPAMVDNVSFLKSLIKASQHPVGMPIAMLDWAAEKGECVGIKNAIGPFCVSILDPEIVEYVCFTNAKNYRLRMLPDAFRYVIQNKGITGSDGQYNRDHRLMCQKPFINSFSLAEFSSTVEERIAHMCNTWQQAHAMGGGKPYEINIDYDSQQVTLDVIGKVAFAYDFKRCEAHEAKTLRGEADEDGNVSKLLAAYNGSSEIMGELFITPGPILKLQNFLGLGRVRELKEQYAILESVGTKLMSERRAIVKERLAAGDEEDYCLLDVLVKAKDADGQPLSDADLWGDINDIMAAGHRTTASNFTVNLWHVARYEHIQEQIEKEVAALGGRPPTFQDVQEGKLPYTQRVVKESLRKYAPINLFPRLAEGPDTLPSGHKVEEGDFILLSTYAMGRNPRVWEDPNKFDPDRFTDEALYAQAEKQASAVARGDPAKLEQARERMRRRMNAGRDFTYTPFGAGPRSCIGGVFALLAATTMLASTVQKFKLSKASHSKGAVGEELNIMYDTTICFPEGVWINLEPRERPLGA

SEQ ID NO: 18899 - protein, 1305 aa, Ostreococcus tauri
  misc_feature (888)..(894): Xaa can be any naturally occurring amino acid
  unsure (1)..(1305): unsure at all Xaa locations
MPDDDVEDDDIDAWLASDSDADDADADDGRADGDADAVGTAEGVDPSMDDAGSTAEETRGDDDDDDDDDDDDDDDGREGASTVPTSTVPTGGESRDDGTRETRETRALEPLFPSEVNALAANVTRWASFGLNAAREKMREVGSSERARALKRDLREFGSHVVGDDDARTRVLAPSDDEDADDGSDAETSRGRGGDLGGPGAKDAMRLAESFASGAWAALGGAASKAREALEKADVDKARSVGIGALGALKNVVKATADVAARATADVLAGEDSAEEEEEARLALLERLDEFGLGEVRTSIDRASDAARAALARSCVKEADIVRVRESVRRWEEHITTSAEAPSAGKPSSPGVEATLVAVPLDDDEEDAEHAAQVESAAKTLTSLIGFVDARAEDMTSSLARYAEKKVSERHGAAAVVEALEDGLDTICQEFARDGLAKLTVSALRAIEEIIESIERGEDARWVVRDDATRVATRARNIVAKWESDIEVFAHAVKEALLSVATAVEDATRDSWPASAPEPSAVAQVSTAALDRDRATCVGIHRDAAMQLAWIIESAASLTTPRAPIAMPPSATSTETTRVEFSPALNATQRKQLHAWSEKNGFEHVSSGTGSDRRIAIGSSDATNVVSAFDALRDDEIASVLTTKLGLTCAASDLRRAGRGGGETSERDSDESLAGWTTRTLGLLELERVAETESAEEILRGLSPAAAQRRGRALLGLTATDVRGGLLGQTVITLELAKRIDPSHPTPLPPNRLSPHDVVCLRANKATNEGEPLASGVVYRIRDAQIEIACDDAPDDLSGTLRLERLSNEETHKRLVAAVERVGKYGGASDAKQPGAHLVGVAFGDSSPRVAKSGKEVKWLNENLDSSQREAIEHALRCVDFALIHGPXXXXXXXYVAQEVARGSRVLACTASNIAIDNLVERLMRVKLPGGGEMRLVRVGHPARLLPSVLEASLEAQLLACDNSKLAKDCAKESKALRRKLAKLTDRKDRAERNEVRKELRILGKEERARQKEAMKDVVNGARVVCSTLSGALSGTLKFQDFDVVVIDEAAQALEAATVLGGRSPAAASTVLSMKAQAKGLSDTLFQRLHDAYGNTISRMLTVQYRMHADIMTWSSEAMYQGKLTAAESVATHRLRGDGEDDPPVLLLIDTAGCDMEERVEEDGESKENPGEAEVVVEVVRRLVSQHEVPVDEIGVITPYNGQVTLLRELRARDDALKNLEISTVDGFQGREKEAIIISAVRSNTRGEVGFLSDSRRMNVAVTRARKHCCLIIDSDTSRSDTFLANLVEYFESHGDVASAAEYAH

SEQ ID NO: 18900 - protein, 394 aa, Rhodococcus sp. RHA1
MRAVTVVGGSLAGVQVVKTLRSRGFDGAITLVGDEVHLPYDRPPLSKSVLTGDADANTLGYLDRAWFDENGVELRLGERATRLDITDRTIYTDSSTLHFDDLVIATGARARNPFTNTPTGVFTLRTIDDALRIRDALADAKHVVVVGGGFIGLEVASAARSRGTQVTIVEAAEIPLSRNVGTDVAPALSALAGTHGITLTCGRSVASIDGTAHVESITLDNGTLIRCDTVIVGVGAIPNTDWLTDSGLELGPAGLVCDRTGRAAPHIWAAGDVCAWRDTNGTPHRHEHWTSAGEQARTVAHNLLDNGIRTVEAAPFVWSDQFGKRISIIGDTTGHDTVRFLSRGTEDLGALYSRDDKFVGACVVDQLRLVLKCRKWAAAGTHTSEIPEWELADL

SEQ ID NO: 18901 - protein, 412 aa, Oryza sativa (japonica cultivar-group)
MEAKLSAASRRVAPSPIQQLSHLAQRAGAVNLAEGFPDFPAPAHVKAAAAAAIAADLNQYRHVQGICDALAETMKRDHGLRVDPLTDFAVCCGQSEAFAAAIFAIIDQGDEVLLFDPAFETYQTCIELARGVPVYVPLDPPSWTLNEDKFLKSFTNRTKAVVLNSPHNPTGKVFSREELLIIAQACQKMDCFAITDEVYEYITYDENKHISLASLPGMQERTIITSSLSKTYSVTGWRIGWACAPANIASAIRNIHVKLTDSAPAPFQEAALVALTSPPDFYSSLKQDYTARRDFILQVLTDFGFRISFKPQGSIFVFVELPRSWQLSDMDFVTNLIKNAGVAAVPGRGFFHSSTDDPSYHHRYVRFAFCKSNDTLNAAAEKMRKLAVSHDARLLRPTDDGEAGQTASATSP

SEQ ID NO: 18902 - protein, 321 aa, Robiginitalea biformata HTCC2501
MKDSKAILEIARQTIALEGDAIHHLATLLTEDFSRAVSCILEADGRVVITGIGKSAIIASKIVATLNSTGTPAIYMHAADAIHGDLGTIQQNDVVICISKSGNTPEIKLLVPLIKQGGNPLIGMTGSPDSFLGRRADYCLNTYVEKEACPNNLAPTTSTTAQLVLGDALAICLLELRGFSSRDFARYHPGGTLGKKLYLRVGDIAAQNQVPQVSGDTPVKDAIVEISEKMLGVTAVMDGDRVAGIITDGDIRRMLNKHDNIAGLRARDIMTTGPKTVDSEVLAVKALQMMEENDISQLLATRDGRYIGVVHIHNLIKEGIL

SEQ ID NO: 18903 - protein, 747 aa, Bacteroides thetaiotaomicron VPI-5482
MDNITPKEIADEEMINQAFQELLNDYLHTKHRKRVEIITKAFNFANQAHKGIKRRSGEPYIMHPIAVAQIVCNEIGLGSTSICAALLHDVVEDTDYTVEDIENIFGPKIAQIVDGLTKISGGIFGDRASAQAENFKKLLLTMSNDIRVILIKIADRLHNMRTLGSMLPNKQYKIAGETLYIYAPLANRLGLYKIKTELENLSFKYEHPEEYAEIEEKLNATAAERDKVFNDFTAPIRTQLDKMGLKYRILARVKSIYSIWNKMQTKHVPFEEIYDLLAVRIIFEPRNVEEELNDCFDIYVSISKIYKPHPDRLRDWVSHPKANGYQALHVTLMGNNGQWIEVQIRSERMNDVAEQGFAAHWKYKEGGGSEDEGELEKWLKTIKEILDDPQPDAIDFLDTIKLNLFASEIFVFTPKGELKTMPQNSTALDFAFSLHTDIGSHCIGAKVNHKLVPLSHKLQSGDQVEILTSKSQRVQPQWEVFATTARARAKIAAILRKERKANQKIGEELLNEFLKKEEIRPEEAVIEKLRKFHNFKNEEELLAAIGSKAITLGEADKNELREKQTSNWKKYLTFSFGNSNKEKPEEKEPQEKEKINPKEILKLTEESLQKKYIMAECCHPIPGDDVLGYVDENDRIIIHKRQCPVAAKLKSSYGNRILATEWDTHKELSFLVYIYLRGIDSMGLLNEVTQVISRQLNVNIRKLAIETNDGIFEGKIQLWVHDVEDVKTICNNLKKIQNIKQVNRVEE

SEQ ID NO: 18904 - protein, 276 aa, Triticum aestivum
PFRPARDPCGPGCGGKQVRACRREAPQGGGCPRREVQDGQLGLHRPRTTGESFSCLSAEEEKTVVVEDDGFSTPEDEWSEAVIRSLSRTTSSTGRFFFDQGPATNSILSAAAASTTGSTPPEEENDKPAALSKNGKPGDGGKSLVVEESVAVPMDSADPYGDFLSSMEEMVAAHELRGWDALEELLVWYLRVNAKHHHPLIVSAFVDLLVRLTTSATASTSTTTMTMTSSSSTSSSSSGTSSTSTTSSRTRGSTISREFRTGTSLLFCTNLFYSVT

SEQ ID NO: 18905 - protein, 411 aa, Synechococcus elongatus PCC 7942
MSESLESLARLAHWRHELRTPINAILGYSQLLLEDWAGTAIATDLERIESAGQELLRLVNEILDPHSSDRGLSLDTYQARLRYALRTPVNTVCGYVELLLEEDSPELAESRVDLERISAAGERLLEQLEAMAAWDQPASQASAVALSEMEVEVAESVLRYRQAAVSASAVTGGRLLVAEDNEINRDVLERRLRRLGHDVVCVASGQEALNQLAQQPFDLLFLDVMMPGLTGFEVLQQLKADPTLAELPVLMISALDDLESVIRCLRLGATDYLTKPFEPTLLQTRLETCLQHKRLRDRELDYLRNVAIVTDRRWPVEAGDYDRDRLQTVAERSDALGQLARMFRQMTRSVEQRETQLKQTIRRLELQIDTATVKSQVKEITESDYFRDLESRARQIRRDRSYRSSPPDRHA

SEQ ID NO: 18906 - protein, 134 aa, Synechococcus sp. CC9311
MTMSSTPLKAVITQEAPAPVGPYNQAVIAGGWLYCSGQIPLDPATGTMVGEGNVEAETRQVLRNLKAVLLEAGTDPTKVVRTTVFLVDLGDFQAVNAIYAEMFGDGISPARACVQVAALPKGSKVEIDCIAWLN

SEQ ID NO: 18907 - protein, 356 aa, uncultured bacterium
FHAIGAANNLLAAMLDNHIYQGNALGIDPRKITWKRCMDMNDRQLRFIVDGLNGKTNGSPREDGFDITVASEIMAILCLSRSLDDLKQRIRRIIVGYTWDDKPVTAGQLKAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKSGLPAVVAINRFPTDTEAEMKLVEASCQKHGANVALSEVWAKGGSGGRELAEEVVRLAATPNDNFRFIYDTELPIREKVKAIVSQIYGGDGVDFGPAALKQMKRLVELGFGNLPI

SEQ ID NO: 18908 - protein, 451 aa, Haemophilus influenzae R2846
MKKFSSKTIKAKNSVKMTALSTRAIAANLILQVLDEGKSLSALIPEVQLSVKAQDLPLLQEICFGVCRVLPRLEQIIKRLVDKPLKGKTRIVHCLLLVGLYQLLYMRVPAHAAVDEVVNATKSLKSDSFRGLVNAVLRRFLREQDEILAIIDKNWQTLHPEWFVNKLKKAYPNWREIIEVNNQKPPMWLRVNSQKNALETYRTLLEEQGISSKTSHHPNALCLDIPIAVQKLPHFEEGAVTVQDLSAQWAATLLEPKNEEWILDACAAPGGKTTHILELAPQANVIALDVESHRLKRVEENLERLNQQAIVVCGDASKPDEWLAEIGKSAAKFDRILLDAPCSATGVIRRHPDIKWLRKETDIAQLVELQKKILSALWEKLKPNGVLLYATCSVLPEENCEQIQEFLNAHADAELLSLPFSDDKSAVGFQFIPQPNSGDGFYYAKLLKRAS

SEQ ID NO: 18909 - protein, 456 aa, Mannheimia succiniciproducens MBEL55E
MTKHYDYISIGGGSGGIASINRAAGYGKKCAIIEAKHLGGTCVNVGCVPKKVMFYGAHIADAINHYAEDYGFDVSVNKFDFAKLVESRQAYIGRIHTSYGNGLSKNKVDVFNGFARFVDAKTVEVSYEDGSSEQITADHILIATGGRPSIPNVKGAEFGISSDGVFALNELPKRVAVVGAGYIAVELAGVFNSFGVETHLFVRQHAPLRNQDPLIVDTLVEVLVQDGIQLHQKAIPQEVVKNADGSLTLKLEDGRETVVDSLVWAIGREPATDVINLQAAGVETNDRGFIKVDKYQNTNIPGIYAVGDIIEGGIELTPVAVAAGRRLSERLFNNKPDEHLDYNLVPTVVFSHPPIGTVGLTEPKAIEKYGAENVKVYTSSFTAMYTAVTQHRQPCRMKLVCAGADEKIVGLHGIGFGVDEMIQGFAVAIKMGATKADFDNTVAIHPTGSEEFVTMR

SEQ ID NO: 18910 - protein, 137 aa, Thermus thermophilus HB27
MERTFVMIKPDGVRRGLVGEILARFERKGFRIAALKLMRISQELAERHYAEHREKPFFPGLVRFITSGPVVAMVLEGPGVVAEVRKMMGATHPKDALPGTIRGDFATTIDENVIHGSATLEDAQREIALFFRPEELL

SEQ ID NO: 18911 - protein, 867 aa, Thermus thermophilus HB27
MEGPERVEELLRLLDEYLFRHGVYPANRLSTPYLNTLPKEKEPPYPGDLELERRIANILRWNVAMMVTRANKKADGIGGHIATYASIAELYEVGFNHFFRGPEAGLDRDLVFFQGHASPGNYARAFLEGRLKEEDLENFRREVHPPVPGGRGLSSYPHPWLMPDFWEFPTVSMGLGPIQAIYQARFMRYLEDRGLKPKSSAKVWAFLGDGEHDEPETVGALHLAARENLDNLIFVVNCNLQRLDGPVRGNSKVIQELERLYRGAGWRVIKVVWGSAWDELLAKDEEGHLLRRFEALVDGESQRYAAFGGKELRERFFNTPELKKLIEGMTDEELTELTRSRGGHDMVKIYAAYKAAVEHKGSPVVILARTIKGYGMGPTVMAKNVAHQVKKLTEEDLKEARRFLGIPIPEEKLPELPYYHPGPDSPEVRYLLERRKALGGFVPERRVRFKGGLEVPEEEFFREFYEGSGGREISTTMAFVRILAKLLRHPKIGKYIVPIVPDEARTFGMEALIAQVGVYSPQGQLYVPVDAGTLTAYKESQKGQILEEGITEAGAMAEFIAAGTAYAHWGIPTIPFFITYSMFGLQRIGDLVWAAADQRTRGFFLGATAGRTTLAGEGLQHQDGQSHVYALAAPNLLAYDPAFAYEFAVILEDGLRRMYGRGEDVFYYITIENENYVHPPMPEPREKVKEGILKGLYLFRAGEGKGPKVQLFGTGPILNEALKAQELLAKYGVVADVWSATSYKTLYVDAIEAERETRLLGKARRPYVQEALEGHEGPIVAATDYLKALPNLIRGYVDRPFAVLGTDGFGRSDTREALRDFFEVDARHIAYTALALLHGEGKVTKRTLNQARKDLGLKLEEVPPHRR

SEQ ID NO: 18912 - protein, 420 aa, Thermus thermophilus HB27
MEVKLPELGDNVTQATVVGVLVKEGDRVEPGQPLLELETDKAVVEVPAEAGGVVKRVLVKVGDEVRPGQPFLELAEAEGGAEAPPLKAEERPEAPAPKAEEAPRPAPKEAPPAPQEAPSERRLIPAAPSIRRLARELGVDLTRLRGTGLAGRITEEDVRRAAGLGEAAPAALPAAPAPRLPDFTKWGPVRREPMSGVRKATVRSMSQAWAQVPMVTHFDEADVTELEALRKQYAKKAEEKGFRLTLTAFLLKALALTLKAFPKFNASLDVEAQEIVYKDYIHIGVAVDTPHGLLVPVIRDVDRKGVLRLAEELQEISQRARERKLSPEEMQGATFSLSNLGGIGGTGFTPIVNWPEVAILGVSRSQMKPLWDPGKEAFVPRLVMPFSLTYDHRLIDGADAARFCRHLAGILEDPLGLALA

SEQ ID NO: 18913 - protein, 485 aa, Mannheimia succiniciproducens MBEL55E
MENFMFGPFKPAPAIAELPADKIDSTYRRLRWQVFMGIFFGYAAFYFVRANFDLAQKGLIEAGMYTKTELGIIGTGAGLAYGLSKFVMAGMSDRSNPKVFLPFGLLLSGLCMTLMGLIPWATSGILIMFVLIFLNGWFQGMGWPPCGRTMVHWWSKSERGTIVSIWNCAHNVGGMVPGMMVLLASAVYFSNTGVQATAKDVWQQALYYPGIAAMIAAIPVYFVMKDTPQSCGLPPIEKWRNDYPDDYNEKTYEHDLTTKEIFVNYVLKNKLLWYIAIANVFVYLIRYGVLKWSPVYLGEVKHFNIKGTAWAYTIYELAAIPGTLLCGWVSDKIFKGKRGLTGFIFMILTTIAVFALWKNPATPEAELAQYAGLPFYKNPYQLMDFILMTTVGFLIYGPVMLIGLHALELAPKKAAGTSAGFTGLFGYLGGTVSASAVVGWAADKFGWDGGFYVMITGGILAVILMFIVMVAEGKHKAKLSDHYGK

SEQ ID NO: 18914 - protein, 512 aa, Rickettsia akari str. Hartford
MNNTYYITTPIYYVNDVPHIGHAYTSVASDVIARFMRLRGLDVIFLTGTDEHGQKVEKAAINKNIDPQKFTDQTSESFRHLMAVMHISNDDFIRTTENRHKEAVAVFWQKLLDNGTIYEGFYEGWYAVRDEAFFDESELTSDGLAPTGAPVEWVKEPSYFFNLSQWQDKLLEFYEANPDFIRPISRRNEVISFVKSGLKDLSVSRTTFNWGIKVPNNEKHVIYVWLDALANYISALGYPDEQSSYGKFWPADLHVVGKDILRFHTVYWPAFLMAAEIPLPKTIMAHGWWTNEGQKISKSLGNTIDPIKLINEFGIDQIRYFLMREVTFGADGNFARSNLITRINSELSNKIGNLLQRSTAFVYKNNEGKVPLLTQSVIDKIYELPILKTASKFAEQNILLMDKTEINKILDNIINLAEEANIYIDSEAPWNLKKTDPDKMLEVLYTLLEVLRYIAIMLQPFIPSSANKMLNQLGISKEERLFKHLIRDYALRAGSNILEPTIIFPRFEGDVV

SEQ ID NO: 18915 - protein, 583 aa, Atractylodes lancea
MDVRRRPVKHLLHRSLKQHKSGELLKHQDQPKAIDAFPLPLYLTNGLFFTIFFSVIYFLLHRWREKIRNSTPLHLLTFSEMAALVSLLASVIYLLGFFGIDFVQSIIRPSPSSWIIEDDNAEQIMLQEDTPVKPCGQALIPHSLPTNPTSEMEVEKEKPPPTIEYTSEENEEIVKQVVGGSIPSYALETKLGDCKRAASVRREALERITGKSLTGMPLEAFDYESILGQCCEMPVGYIQIPVGIAGPLLLNGAEFSVPMATTEGCLVASTNRGCKAIYMSGGATCMLLKDGMTRAPVVRFGSAKRAAELKLFLEDPENFDTLAVVFNKSSRFGKLQSIKCAIAGKNTYIRFCCSTGDAMGMNMVSKGVQNVLDYLQTDFPDMDVMGISGNYCSDKKPAAVNWIEGRGKSVVCEAVIKEEVVRKVLKTNVASLVELNMLKNLTGSAMAGALGGFNAHASNIVAAIYIATGQDPAQNVESSHCITMMEAINNDKDLHISVTMPSIEVGTVGGGTQLASQAACLNLLGVKGASKEAGSNSRVLATIVAGSVLAGELSLMSAIAAGQLVKSHMKYNRSTKDMTKLAT

SEQ ID NO: 18916 - protein, 212 aa, Brassica napus
SIEIKPGKPTKVEQEDGYMIHVSQIAIGEFNKVGDKTVQVFVKVGGDDKQKLVIGNLSQKVPQVYLDLLFEQDFEVSHECKSSSVYLLGYKTVDTMDGELNSDFDSEDEDIPMDMFRSELEKSKANELNGQKANLEDGESDSDEMGSDVDEDDSEEEEEDTPVKVEPPSKKRPNGGAMNNNNTVASKKAKVANQQGGHKGHKCGGVHPPKRN

SEQ ID NO: 18917 - protein, 138 aa, Arabidopsis thaliana
  misc_feature (5)..(5): Xaa can be any naturally occurring amino acid
  misc_feature (30)..(31): Xaa can be any naturally occurring amino acid
  misc_feature (34)..(34): Xaa can be any naturally occurring amino acid
  misc_feature (42)..(42): Xaa can be any naturally occurring amino acid
  misc_feature (46)..(47): Xaa can be any naturally occurring amino acid
  misc_feature (50)..(52): Xaa can be any naturally occurring amino acid
  misc_feature (58)..(58): Xaa can be any naturally occurring amino acid
  misc_feature (60)..(61): Xaa can be any naturally occurring amino acid
  misc_feature (66)..(66): Xaa can be any naturally occurring amino acid
  misc_feature (69)..(69): Xaa can be any naturally occurring amino acid
  misc_feature (72)..(72): Xaa can be any naturally occurring amino acid
  misc_feature (79)..(80): Xaa can be any naturally occurring amino acid
  misc_feature (84)..(84): Xaa can be any naturally occurring amino acid
  misc_feature (89)..(90): Xaa can be any naturally occurring amino acid
  misc_feature (95)..(96): Xaa can be any naturally occurring amino acid
  misc_feature (98)..(99): Xaa can be any naturally occurring amino acid
  misc_feature (101)..(102): Xaa can be any naturally occurring amino acid
  misc_feature (107)..(108): Xaa can be any naturally occurring amino acid
  misc_feature (111)..(113): Xaa can be any naturally occurring amino acid
  misc_feature (115)..(116): Xaa can be any naturally occurring amino acid
  misc_feature (118)..(122): Xaa can be any naturally occurring amino acid
  misc_feature (124)..(133): Xaa can be any naturally occurring amino acid
  misc_feature (136)..(136): Xaa can be any naturally occurring amino acid
  unsure (1)..(138): unsure at all Xaa locations
RRTMXSSMLSSATMVASPAQAIMVAPFNGXXSSXAFPATRKXNNDXXSFXXXGGRVNXLXXWPPIXKEXFLXFFFYFFXXTDSXWGGGXXLLYPXXLXXLXXIFLLXXVFXXXWXXNXXXXXLXXXXXXXXXXSFXWL

SEQ ID NO: 18918 - protein, 131 aa, Zea mays
MAGKASVALFLAVNLVVFAMASACGGNCPTPTPSTPSTPTPTPASFGKCPRDALKLGVCANVLGLIKAKVGVPPTEPCCPLLKGLVDLEAAVCLCTAIKGEVLGIKLNLPVDLSLILNHCGKTVPTGFKCL

SEQ ID NO: 18919 - protein, 439 aa, Thermotoga maritima MSB8
MTIETIKRIIEEENVRFIRLQFTDINGTLKNLEITPDVFLESWEDGIMFDGSSIEGFVRIEESDMYLKPVLDTFAVLPWTVDGAKSARVICDVYTPDGKPFEGDPRYRLRRMMEKAEQLGYTPYAGPEMEFFILPINEKGEPVPEFLDHGGYFDLLPLSKVEEIRRDIAIALEKMGITVEATHHEVAPSQHEVDFRYDTFLRTADNAQTVKLVIKTMAIFHGYHATFMPKPFYGVNGSGMHVHMSLFRGDKNAFYDPDDPLGLSKELRYFVGGILKHAKALAAVTNPTINSYKRLVPGYEAPVYISWSVGNRSALIRIPKARGKATRLEYRSPDPSCNIYLAFAAILAAGLDGIINKIEPPAPVEENIYHMTSERREELNIESLPGSLKEAVEELKKDDVIIDALGEHIFEKFVEAAEKDWKEFSTYVTNWELQRYLYL

SEQ ID NO: 18920 - protein, 639 aa, Ostreococcus tauri
  misc_feature (364)..(370): Xaa can be any naturally occurring amino acid
  unsure (1)..(639): unsure at all Xaa locations
METLPTRRAVARVGQHASGEERTEQGWESGAEGFVQDVLDDGERDAKRERKGERESDRARGGGDATPFLIAVDEKLVPDYYSVIERPMAVVTMREKLMRGEYLSKDMFLEDLRLIESNAVVYNGSDSVFAKMARAVVGRGEELLSHMPRVDFVTCVRAAEYAEKLVNEPMLDTSNDMDMDDDDEDDDAETKAWRERTLAKRVRRVFRAEALAGLPIGQRRALPRRSALGMDAFMRSSDDHSKCWPEADDANRARRPEDDDFVADAVPTVPRYAACASVARIEDIRADLSVVALKIALDDRRPIPGVGTRSITNVAARALEELAHECVSRVARAVADRPHKRPRDDHDDRNLFLRCWSRSRPMSXXXXXXXHWVPSEKPSRPLDTVVLPTGARDMIERDVREFLDSERWYVDRGLPYRRGYLLHGLPGTGKTSLVFALAGHFGLPLYVVRLSDERLCDEGLHRLFRTTEKRSIILLDDVDAPGANAVFRELQPGESTGNLSVQSTLSLLDGVTSVDGRLIFLSCRDKSALNQTLIRPGRFDVILRFDAPGKEQIESYFNHFFADFGGDVPSMGAEFAELAGHVDTQPKSMGALQVLFLSHKSNPRDALESMRARISGQKRSITFGARSRNSRRDHSAAAA

SEQ ID NO: 18921 - protein, 507 aa, Mycobacterium avium subsp. paratuberculosis K-10
MTVFARPGSAGALMSYESRYDNFIGGQWVAPARGRYFENPTPVTGQTFCEVARSDEADVDKALDAAHAAAPAWGKTAPAERAAILNKIADRIEENLESLAVAEVWDNGKPIREALAADIPLAADHFRYFAGALRAQEGSLSQIDDDTVAYHFHEPLGVVGQIIPWNFPILMGAWKLAPALAAGNAVVLKPAEQTPVSVLYLMSLIGDLLPPGVVNVVNGFGAEAGKPLASSNRIAKIAFTGETTTGRLIMQYASQNLIPVTLELGGKSPNIFFSDVMAKADDYQDKALEGFTMFALNQGEVCTCPSRSLIQADIYDEFLELAAIRTKAVRQGDPLDSETMLGSQASNDQLEKVLSYIAIGKDEGATIITGGERAELGGDLSGGFYMQPTIFAGNNKMRIFQEEIFGPVVAVTSFTDYDDAISIANDTLYGLGAGVWSRDGNTAYRAGRDIQAGRVWVNCYHAYPAHAAFGGYKQSGIGRENHKMMLDHYQQTKNMLVSYSNKAQSFF

SEQ ID NO: 18922 - protein, 151 aa, Oryza sativa (japonica cultivar-group)
MGNASSMLTQYDIEEVQEHCNYLFSQQEIVSLYERFCQLDRSAKGFISEDEFLSIPEFSLNPLSKRLLRMVDGLNFKDFVSFLSTFSAKASVQQKIELIFKVYDIDGKGKRVITNVLEEAGYTRDCTLSLEDFTRIIDHPGLKMEVEVPID

SEQ ID NO: 18923 - protein, 175 aa, Arabidopsis thaliana
MGNTSSMLTQYDIEEVQSHCHDLFEQQEILSLYQRFCQLDRNAKGFISADEFLSVPEFAMNPLSQRLLKMVDGLNFKDFVAFLSAFSAKASLRQKVQLIFKVYDSDCNGKVSFKDIMEVLRDLSGSFMSDEQREQVLSQVLKESGYTSDSFLTLEDFIKIFGSSRPEMDVEIPVD

SEQ ID NO: 18924 - protein, 409 aa, Haemophilus influenzae R2846
MTIEILVPDLPESVADATVATWHKKLGDTVKRDEVIVEIETDKVVLEVPALSDGVLAEVVQAEGETVVSKQLLGKISTAQEGDVSSATLKATNEPTPSDRQNAAIENSHNHNADQSPAIRRLLAEHDLQADQIQGSGVGGRLTREDIEREIAKRQAQQVKQEAATEQNTISTVAYSARSEKRVPMTRLRKRIAERLLEAKNSTAMLTTFNEVDMQPIMTLRKTYGEKFEKQYGVRLGFMSFYIKAVVEALKRYPEVNASIDGDDVVYHNYFDISIAVSTPRGLVTPVLRDCDKLSMAEIEKQIKALAEKGRDGKLTVEDLTGGNFTITNGGVFGSLMSTPIINPPQSAILGMHAIKERPIALNGQVVIHPMMYLALSYDHRLIDGRESVGFLVTIKELLEDPTRLLLEI

SEQ ID NO: 18925 - protein, 253 aa, Borrelia burgdorferi B31
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYSKSASDNIIIQYGGSVNSNNVKELMNEPNIDGALIGGASLKAESFLSIINNVL

SEQ ID NO: 18926 - protein, 393 aa, Borrelia burgdorferi B31
MSIKTVKDFSSFAGKRALVRCDFNVPLKEGSISDDTRIRAALSTIEYLKERGARIVLVSHLGRPDGKKNPKYSLKPVANRLSELLGQDVKMLSDCIGSEVVNSTLQMKDGDVVLLENVRFYAEEEKNDKNFAKKLSENGDVFVNDAFGAAHRAHASTVGVADYLPSVGGFLMEKEDKFLGGILKNPERPFVSIIGGSKVSSKIAVLESLLSKSNVVVIGGGMAYTFLHSEGYSIGKSLLEDEYIGIASSFLKKAKELGVKVILPLDHIVADDFNKNSIPEYIDSFNIPENKIGMDIGANTLKEIENVVKTAKTIIWNGPLGVFEFDSFSKGTAKVAEMVASCSGLTVVGGGDSVAAVNKFNLSDKITHVSTGGGASLEYLEGRILPGIKVLEN

SEQ ID NO: 18927 - protein, 335 aa, Borrelia burgdorferi B31
MKLAINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKILSWYDNEFGYSTRVVDLAQKLVK

SEQ ID NO: 18928 - protein, 1104 aa, Aspergillus nidulans FGSC A4
MPLLDGPRNGETVTASAHNGIPIIDGVDPSTLRGDIDQDPNRRQKIVVVGLGMVAVAFIEKLVKLDSERRKYDIVVIGEEPHIAYNRVGLSSYFEHRKIEDLYLNPKEWYGSFKDRSFDYYLNTRVTDVFPQHKTVKTSTGDIVSYDILVLATGSDAVLPTSTPGHDAKGIFVYRTISDLERLMEFAANHKGQTGVTVGGGLLGLEAAKAMTDLEDFGSVKLIDRNKWVLARQLDGDAGSLVTKKIRDLGLEVLHEKRVAKIHTDDDNNVTGILFEDGQELDCCCICFAIGIRPRDELGGSTGIQCAKRGGFVIDESLRTSVNDIYAIGECASWENQTFGIIAPGIEMADVLSFNLTNPDKEPKRFNRPDLSTKLKLLGVDVASFGDFFADRDGPKFLPGQRPSAESIGAADPNREEEPQVKALTYRDPFGGVYKKYLFTMDGKYLLGGMMIGDTKDYVKLNQMVKSQKPLEVPPSEFILGAQSGGEENADDLDDSTQICSCHNVTKGDVVESVKSGTCKTIADVKSCTKAGTGCGGCMPLVQSIFNKTMLDMGQEVSNNLCVHIPYSRADLYNVIAIRQLRTFDDVMKSAGKCPDSLGCEICKPAIASILSSLFNPHLMDKEYHELQETNDRFLANIQRNGTFSVVPRVPGGEITADKLIAIGQVAKKYNLYCKITGGQRIDMFGARKQDLLDIWTELVDAGMESGHAYAKSLRTVKSCVGTTWCRFGVGDSVGMAIRLEQRYKSIRAPHKFKGAVSGCVRECAEAQNKDFGLIATEKGFNIFVGGNGGAKPRHSELLAKDVPPEEVIPILDRYVIFYIRTADKLQRTARWLESLPGGIEYLKDVVLNDKLGIAAEMERQMQELVDSYFCEWTETVRNPKRRKYFQQFANTDETVENVEIVKEREQVRPTYWPKDGANEDFKGHQWSSLSWQPVIKADYFSDGPPAISSANIKRGDTQLAIFKVKGKYYATQQMCPHKRTFVLSDGLIGDDDNGKYWVSCPYHKRNFELNGEQAGRCQNDEAMNIATFPVEEREDGWIYMKLPPVEELDSVLGTEKWKVKKGEAVDPFEAYDKKYSGMKGKRAGAKGIEGSKPTRSPSNTIDW

SEQ ID NO: 18929 - protein, 176 aa, Oryza sativa
  misc_feature (65)..(65): Xaa can be any naturally occurring amino acid
  unsure (1)..(176): unsure at all Xaa locations
MGYSFTLLSADIDEKEIRKEKPEELVVALAHAKADAIMEKLRDNGMMKEILDSQETTLLITADQXKPSTPEEARKFIKGYSESHAATIGSVLVTNVKSGARKEGWDKAEVYFHKIPDEVVESLIEEGDVFYVAGGLLVEHPLTSPLVEAIVGTIDSVMGLPKSLTEKLIKESLEEP

SEQ ID NO: 18930 - protein, 395 aa, Bacillus halodurans C-125
MKTFEQAKMMKRLPEQFFAKLVEQVQEVKKDHDDIINLGQGSPDLPTPEHIVEKLQEAAENPLYHRYAPFSGYPFLKEAVSKYYEREYGVSVDPKTEVAVLGGAKTGLVEVSQCFLNPGDMALVPDPGYPDYWSGIAIAGGSMYGMPLKKELGFHPDLRGIPAPVLYEAKLMFLNYPNNPTGAVATEELFAEAIELAEEYDICVVHDFAYSAIGFDGQKPLSFLQVEGAKNVGIEMITLSKNYNMAGWRIGFAVGNPSVIKAIETLQDHYFCSLFGGIQAAAAHALLSDQSNVTTLVQTYEERRNALVKAARAIGWDVEAPKGSFFAWFPVPSGFTSEEFATYLLKKARVVVAPGKGFGEHGEGYVRVALLADIAKLEEAMGRVGKLDVFSNKRG

SEQ ID NO: 18931 - protein, 348 aa, uncultured bacterium
FHAIGAANNLLAAMLDNHIYQGNALGIDPRKITWKRCMDMNDRQLRFIVDGLNGKTNGSPREDGFDITVASEIMAILCLSRSLDDLKQRIRRIIVGYTWDDKPVTAGQLKAEGAMTALLKDAMKPNLVQTLEHTPALIHGGPFANIAHGCNSVIATTTALKLADYVVTEAGFGADLGAEKFLDIKCRVAGLKPSVVVIVATVRALKMHGGALKKDLGLENLEALEKGLPNLLKHIENITVKFGLPAVVAINRFPTDTEAEMKLVEASCQKHGANVALSEVWAKGGSGGRELAEEVVRLAATPNDNFRFIYDTELPIREKVKAIVSQIYGGDGVDFGPAALKQMKRLEE

SEQ ID NO: 18932 - protein, 205 aa, Mannheimia succiniciproducens MBEL55E
MTEFKLNYHKTHFMTSAANIHQLPKDEGMEIAFAGRSNAGKSTALNALTNQKNLARTSKTPGRTQLINLFEVEPQYKLVDLPGYGYAAVPEQMKLQWQKSLGEYLQHRECLKGVVILMDIRHPLKDLDQQMIEWAVSSDLPVLLLLTKADKLSQSARSKQVKTVREAILPFQGDVQVEAFSAQNKIGIDKLAAKLDSWFSSLLTE

SEQ ID NO: 18933 - protein, 145 aa, Oryza sativa (indica cultivar-group)
MGFSETQEELVLRSWQSMKKDSESIALKFFLRIFEIAPAAKQMFSFLRDSGDDVPLESHPKACESATQLRKTGDVKVREATLRRLGATHVKAGVADAHFEVVKTALLDTIKDAVPEMWSPEMKGAWEEAYDQLAAAIKEEMKKAA

SEQ ID NO: 18934 - protein, 279 aa, Flaveria bidentis
MFKNCIALCCAKRPSVAEDMEANGVPVYIDDVIDRLNKLLSEKNDLQIFAAEKIKQLTAELEVSDAGEFKAVERIRNGFARFKKEKYDTNPTLYGELAKGQSPKFLVFACSDSRVCPSHILNFQPGEAFVVRNIANMVPPYDTIKHSGAGAAIEYAVLHLKVENIVVIGHSCCGGIKGLMSIPDDGTTASDFIEQWVKIGLPAKSKVKADCSDLEYSDLCTKCEKEAVNVSLGNLLTYPFVREAALNKKLSLKGAHYDFVNGSFDLWNLNIGFSSSIIY

SEQ ID NO: 18935 - protein, 185 aa, Oryza sativa (indica cultivar-group)
MDAGDQSPEEVYSVWALPPEPVRARLRGVMAGLRAAHGGPAFEPHATVVGAIRLRRSAAVEALRAAAAGVRPYTARVVGVARGDFFYQCVYLLLEPTPEVVEASDHCCGHFGYERSTPYMPHVSLLYGDLTDEEKEVARKKVEEIDKEICGLQFEISELALYRTDTEDKSLESWELVEICHLERK

SEQ ID NO: 18936 - protein, 350 aa, Thermus thermophilus HB27
MKDYYAILGVSREASQEEIKKAYRRLALKYHPDRNPGDKEAEERFKEINEAYAVLSDPKKRAAYDRGHLEAPEYRPEDLFDLFFQEVFGVRGHRRPPRGEDLEAEVEVELQDLLHGAEKEVRYTRLVPCEACGGEGGRRTPCPTCRGQGVVESYRQSFFGTVVTRTACPHCKGRGYLLAETCPACRGRGRVPREERVRVQVPPGMDEGHLLRVPGYGNLGPGGPGDLYLRIRVRPHPHLERQGPDLVYRLRLGLAQAALGARVVVPGLEGPIPLDIPPGTGHGEVFALEGGGLPLPGGRGRGTLRVVVELAVPKKLSPKAQKLLRAYAEEVGEEVAPEGFWERLKGFFRK

SEQ ID NO: 18937 - protein, 258 aa, Flaveria bidentis
MGSKSYDEAIAALKKLLSEKKELAPMAAAKIDQITAQLQTLDSTKPGFDPVERIKTGFAKFKTEKYLKNPALYGELSKGQSPKFMAFACSDSRVCPSHVLDFQPGEAFVVRNVANIVPPFDKLKYAGVGSAVEYAVLHLKVEQIVVIGHSKCGGIKGLMTFPDEGPTSTDFIEDWVKVGLPAKSKVKAEHGSASIDDQCVSCEKEAVNVSLANLLTYPFVRNGLINKTLAIKGAHYDFVNGTFELWALEFSLSPTTSA

SEQ ID NO: 18938 - protein, 212 aa, Francisella tularensis subsp. holarctica
MFQFILALVGTWASQKGPLWWSGHHRYHHIHSDKYTDLHSPKNGIFQSHVGWVFESRSDHVDPKFTKDWVKYPELVWIDKYAHVSFALYLVGLFALGSLISHFYPSLETSGLAFVFWGGILSTVLLYHTTFNVNSICHIFGSKDYETSDNSCNNWFIALITFGEGWHNNHHKFAYSVRNNLKVWQIDITYIILCVLRKFRIVWDFKQPKKTI

SEQ ID NO: 18939 - protein, 361 aa, Crocosphaera watsonii WH 8501
MTRQYRITLLPGDGIGPEILAVTVDILKVVGKQLEIDFQFQEALIGGVAIDETGKPLPEATLKMCRSSDAVLLAAIGGYKWDNLPREKRPETGLLAIRAGLNLFANLRPATILPQLINASSLKPEIVQGVDIMVVRELTGGIYFGKPKGIFETETKEKRGVNTMAYTESEVDRIAKVAFETAQKRGGKLCSVDKANVLDVSQLWRDRVTLMAEKYPDVELSHLYVDNAAMQLVREPKQFDTIITGNLFGDILSDAAAMLTGSIGMLPSASLGLEKPGLFEPVHGSAPDIAGEDKANPLAQVLSAAMMLRYGLNEPKAATKLEKAVLEALAQGYRTGDIMSDGMKAVGCKGMGEVLLRILES

SEQ ID NO: 18940 - protein, 609 aa, Bacillus cereus ATCC 14579
MCMCGITGWVDWKEDLSNQHVILKKMANSIEHRGPDAEGFWFSPHAAFAHRRLIVIDPEGGTQPKTFRAGDYTYALTYNGEIYNFRELKEQLQKCGHAFETHSDTEVLLHAYLEWKEDCVQHLNGIFAFALWDDQKQQLFLARDHLGVKPLFYTERNDSIIFGSEIKALLAHPSVPAEIDADGINEIFGLGLFRTPGCGVFKHIQEVRAGHSITFTRHKKVVTKYWNLESKFHTDSIEDTSSHILSILQDTVKRQLIADVPLVCMLSGGLDSSGITALAGKEFAAENKTLHTYSVDFVNSAKDFELTFARTGLDAPWVKRVSEHVGTAHHDIIVNAEELANHLFVPLHAKDLPSAGEMETSLYLLFCEMKKDATVALSGESADEVFGGYPWFHQEELLYVDKFPWLTNWKNTSPLLLNEVSNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALQPALPDDVRNRRKSAYPTSQDPHYLQTIRNLTLDMCSHKNNPIFSLINHSILLSIADQSNKEINNFEARSAMEYMLQVNEWLKTYHIHIA

SEQ ID NO: 18941 - protein, 433 aa, Treponema denticola ATCC 35405
MSDIIYIEGREILDSRGNPTVEVEVQLSDFSYGRACVPSGASTGEYEALEMRDGDKSRYMGKGVLKAVDQVNTVIAEELDGADALDQAEIDNMLINLDGTENKSKLGANAMLGVSMAVARAAADSLGLPLYRYLGGVHAMQMPVPMANIINGGRHSDNKIDFQEYMIMPVGAPSIREGIRMTAEVFHALKDILKKEGHVTAVGDEGGFAPNIENVQALDYIMKAIEKAGYKPGKDVVIALDCASSELFDAGDRKGYKFWKSEPSKILNADEMVDLFKDWISKYPIVSIEDPLDQNDWEGYAKMTKELGNQIQIVGDDFFVTNTKRLARGIEEGACNSILIKLNQIGTVTETIDAVRMAQKAGYTAVISHRSGETEDAFIADLAVALETGQIKTGSMSRSDRIAKYNQLMRIEDELGYNARYAGMATFANLIKK

SEQ ID NO: 18942 - protein, 88 aa, Oryza sativa (japonica cultivar-group)
MSGRGKGGKGLGKGGAKRHRKVLRDNIQGITKPAIRRLARRGGVKRISGLIYEETRGVLKIFLENTVTAMDVVYALKRQGRTLYGFGG

SEQ ID NO: 18943 - protein, 307 aa, Thermus thermophilus HB8
MVEKPAIALVGESLVDLVLEGESPLTFTGSLGGSVLNTATVLARLGYPVRFFSEVGEDWLSAWSEAEMARRGLNPKLRRHPGPMPLALVRLDPEGNARYSFHRPFQAPFLPEAGALRGVGAFHFGSLFALEARTAKGVAALLEEAARAGALLSYDPNLRGLPSPEERARVEAYLGRVDLLKLSLEDARLLFPEAPLEAVRRLPPRLKVLTLGPEGALAFLGEGEVRVPGVRVRVVDTVGAGDTFTAGLLALLLRRGGGRGVLEGLDLEGLREALEAAVALSALACTVRGAGLPEEGLAAWRARWLAG

SEQ ID NO: 18944 - protein, 311 aa, Haemophilus influenzae R2846
MNYLKIAQNSLSVESNALLQLSQRLGEDFNQVVDLILACKGRLVIGGIGKSGLIGKKMVATFASTGTPSFFLHPTEAFHGDLGMLKPIDIVMLISYSGETDDVNKLIPSLKNFGNKIIAVTSNKNSTLARHADYVLDITVEREVCPNNLAPTTSALVTLALGDALAVSLITARNFQPADFAKFHPGGSLGRRLLCKVKDQMQTRLPTILPTTNFTDCLTVMNEGRMGVALVMENEQLKGIITDGDIRRALTANGAETLNKTAKDFMTSSPKTIHQDEFLSKAEDFMKAKKIHSLVVVNDENHVVGLVEFSS

SEQ ID NO: 18945 - protein, 192 aa, Oryza sativa (japonica cultivar-group)
MDSSPSPAPASRGRWSWGSALVGAASTAAAAAVLLCRPRDPTFELISISLSTFHFRPPAALDIGLTLTVHATNPNVVPVRYGPSTVSILYDGAHLGTARLDAGEQPPTSCRLLHLPARLDAVELAHHARSILADTARRHMELDAAVKIAGEAAVALWSRRFSVSIDSHIVVDPVFLDVIEQENHSEMQLYLT

SEQ ID NO: 18946 - protein, 475 aa, Thermus thermophilus HB8
MEVKEAPTEALIGGAWRRLARRFPVVSPATGERVAEVADCGEEEAREALEEAVLAFPAWSRATAYERAQVLRRWYERILEHKEPLARLMALEMGKPLKEGRAEVAYAAGFVEWYAEEAKRVYGETVPSQFPHKRILVRYEPVGPVYGITPWNFPAAMVTRKVAPALAAGCTFVLKPAEESPLTALYLAKLFLEAGGPPGVFQVLPTSRPAEVSRPFLEDERVRKLTFTGSTEVGVRLYEEAAKTLKRVSLELGGGAPVLVFADADLDRAVEETLRAKFRNAGESCVAANRIFVQAEVAEAFAEAYARRVQALKVGDPLSEETDIGPLVNEAALRKVRTHVEDALAKGARLVAGGEAKGLFFAPTVLLDVKPESLLFREETFGPVAPLTVFREEEEAVRWANGFPVGLAAYVFTRDLSRAFRVAEALEYGIVGVNDGVPSTPQAPFGGVKRSGLGREGGKWGLLEYLEVKYVSFGL

SEQ ID NO: 18947 - protein, 444 aa, Synechococcus sp. CC9311
MLEAILRPIAYYRRCFFRNSGVVRVRMSPTLPPQQVLISDPSVIKELINEDGGRHITAPGQLNGLLSQVLGKHSIILLAPATHRQRRKLLTPPFHGERLKAYGQLISSLADQSLIDLNVGDVFDAREQMQGITMRVILTAVFGLHEGDAFRQLERSLASSISIRSGPLGSLLLFFPFLRRDLGRWSPGGRIKAADAAIRRLLLEQIASRRRAVERCGEENMSADILSLLLSCKDDEGQGLSDDELHDELLTLLFAGHETTATALTWAFYWIHRNPLVLERLMNELNGLLDHSDPEAIARLPYLSAVVNEVLRIHPVAMLTFPRRIESAITLGGYAFRSGDVVMACIQAVHERPDLYPKPLQFNPERFMNQTYGLHEFLAFGGGSRRCIGAALALYEMKLILAKILLNNQFELTPKSNRWNKPRRRGFTLGPSIPVKLKMVSLRP

SEQ ID NO: 18948 - protein, 543 aa, Synechococcus sp. CC9311
MNVPNDLEGNLLRNAPVAPVVLAILDGWGICDSAEHNAIRSASTPVIDALWHAYPHALIEASGSHVGLPDGQMGNSEVGHLTIGAGRIIRQELVRISETVRERRLGSISALQSVAERLRRTGGTLHLLGLCSDGGVHSHVDHVCGLLEWAAEEGLKNVAIHAITDGRDTPTQSAPTHLSKIQAAISTYGIGRIASLCGRYWAMDRDHRWERTERAYALLTDPDLDRQEDDPASVLVSSYAKGITDEFLEPVRFSDDPLRDGDALLMFNFRPDRARQIIQALSLQEFEGFRRVHQPTLDVVTFTQYETDLPVSVVFPPESLDQLLGQVVADAGLKQYRTAETEKYPHVTYFMNGGIEQPLPGEKRHLVPSPRVATYDQAPEMSADTLTESCVAAIQQGEHSLVVINYANPDMVGHTGMMEAATQAIETVDRCIGKLLDAVGRMGGTLLITADHGNAERMQGPDGQAWTAHTTNPVPVILIEGEKRKVPGFGNSIRLRENGGLADIAPTLLQLLNLDKPEAMTGTSLIEPIEASAPATTKLPQPV

SEQ ID NO: 18949 - protein, 223 aa, Synechococcus sp. WH 5701
MRDILISTGVCVACLLLAVASQLISPSTVEASGDGAVNSASLGSVAVAATGTATKQAPAARSGRIELDPDDPNPSLFTMASDSPNDPGALADASVAQSGAAGLGGELVAAKEVVTPSGLRITDLVVGEGAEAVSGQPVQVNYRGTLASGKEFDSSYGRGPFSFPLGAGRVIKGWDEGVAGMKVGGKRKLVIPPDLAYGERGAGGVIPPNATLTFEVELLGVGG

SEQ ID NO: 18950 - protein, 153 aa, Borrelia burgdorferi B31
MIRALLTNDLFLSCLVSGISAQVIKYGIQTVKTRKLKLTPVHLLKKIFLETGGMPSSHSSTVTALSTSIALTEGIDTNFIIALAFALITIRDSFGVRYMSGVQAEYLNALSEKLKKEIKIDTTKIKVVKGHKKKEVLTGIIIGIVSAYIVCYF

SEQ ID NO: 18951 - protein, 449 aa, Synechococcus sp. WH 5701
MATHEIFMPALSSTMTEGKIVEWLKKPGDRVERGESVLVVESDKADMDVEAFQEGFLASVLLPSGGTAPVGETIGLIVETEAEIAAVQASAPAAPAAAPVAPAPAEAPASVAAAVPPPAAPAAPVPAPVAVPSSAPVAMATGGRLVATPRARKLAGQLGVALESLRGSGPHGRIQAEDVERAAGQAASLPRVAEGTAPAVTSAPAAAASANGSAAPAPVGQAFGNPGDTVAFNTLQAAVNRNMVASLAVPCFHVGYTITTDRLDAFAKSVKSKGVTMTALIAKAVGVVLARHPQVNASFSEGGMVYPPAINVAVAVAMDDGGLITPVLAAADRTDLYSLSRSWADLVARSRSKQLKPEEYSTGTFTLSNLGMFGVDRFDAILPPGTGAILAVAASRPAVVAGKDGSIAVKRQMQVNLTADHRVIYGTHAAAFLKDLAQLIETAPESLAL

SEQ ID NO: 18952 - protein, 353 aa, Bacillus halodurans C-125
MKKITLSVIPGDGVGKEIMPHALRVLDAVAEVHGGLTFEKVEYPWSCEYYLEHGEMMPEDGLVQLTESDAVFLGAVGNPQLVPDHVSLWGLLIAIRRGFQQSLNIRHAKQIRGIDPPIKHANQFDLLVVRENSEGEYSEVGGRIHQGDDEVVVQNAIFTKKATKRAIDYAFQLAATRGKRVTSATKSNGIVFSMPFWDNVFQEVGKQYPDIEQQSVHIDALTAFLVTKPAEFDVIVASNLFGDILTDVSAAIMGSIGIGPAANLNVEGTYPSMFEPVHGSAPDIVGKGMANPIGQIWTGKMMLDHFGEEELGKTLLDIVEDVTEAGIKTPDIGGRATTGEVADAIIERVKSLT

SEQ ID NO: 18953 - protein, 179 aa, Triticum aestivum
  misc_feature (44)..(44): Xaa can be any naturally occurring amino acid
  misc_feature (116)..(116): Xaa can be any naturally occurring amino acid
  misc_feature (155)..(155): Xaa can be any naturally occurring amino acid
  unsure (1)..(179): unsure at all Xaa locations
MEETKPRLALGSEPRRSSRREWSWGSALAGAVTTVAGADVLVCXPGTRASSLMSMNLFTFHFRPPAALDIGLTLTVHATNPNVVPVRYGAYNVYILYGGTLLVTARLDAGQQTGTXCRLLYLPARLNTMELAHHTGAILADSTRRHMELDAASDXSGGEALLLLWARRLSVRIDSHIDY

SEQ ID NO: 18954 - protein, 469 aa, Oryza sativa
MGDHQMMHAAPAAMYNGGGGGGTTSSHGVWWSNAVGVPAAATCSTTTELAGYTAWSSALAAGYDGMVADNGGKQAKSTTTASSESPGNNSSVTFQEPASIPDPAAVAAVPQPGLAGFTDWTQPFMNNGAGLHEFLQDGHHDMSASSLMNHSSNNLALQQAGHHHELLSSFGSDLLLSPTSPYGGFQSSLLRSLMEPTAKQQQQQPALAGLQQYHQYQQQMGHTPAAAAKFAQAVGARDSLQFTNDAPFWNPSAGFGMPAAVAVAAAAAQDQASVRSAKRSSPAPPRAAATLALKTAMEGVGDSSSVITKKETAFKKPRLETPSPLPTFKTDTASVLHETIEYIKFLHDQVGALSAPYLKNGAHQVPHLKNSSPDKSKHGEISLKGRGLCLVPISSTFAVASEVPVELWTPFGANFIRSDGIVRGGGDRGDGRRLRSEVREAEEMEDEPPESRPPAARDSEVSAHEKRQE

SEQ ID NO: 18955 - protein, 247 aa, Triticum aestivum
  misc_feature (76)..(76): Xaa can be any naturally occurring amino acid
  misc_feature (94)..(94): Xaa can be any naturally occurring amino acid
  misc_feature (123)..(123): Xaa can be any naturally occurring amino acid
  unsure (1)..(247): unsure at all Xaa locations
MSGTGYTVEVTNLSSSASENDLHEFFSFSGPIEHIDLIRSGGYGSTAYVTFKEPYALETAVLLSGATIVDQPVCIXRWGQPDEPCNFWDRPTWXSEEEMEYRDYQSMPVQTPLPQEALTVAQXDVRERQCCQRGYILSKDALSRARAFDESHQLSGSAAAKAAELSRRLGLTDRVSAGVGAIRSVDETYHVTETTKTVATATGRTAVKVMNTIVTSSYFSAGAMMVSDALTRAAKAAENLAAHGRQN

SEQ ID NO: 18956 - protein, 888 aa, Oryza sativa (indica cultivar-group)
MNYRFHNLLGAPYRGGDAVFAGDSSVLLSAVGNRVASTDLSASSSLTLPFESSSNVTRLAVSPSGDFLLSVDDAGRALYANLGRRAVLHRIAFKSAPSAVRFSPDGNLIAVAVGKLVQIWRSPAFRKEFFPFHLLRTFPGFAAGVTAFDWSPDSSFLLASCKDLTARLLPVKKGLGGKPFLFVGHRAAVVGAFFATDKKTGRVTGAYTISKDGAIFTWSLVEGSDDSPPPSPGTPEQEAVQDGEAELDGDEPVLDGGSRKRKSFRESEEPDTTPLHFARWELQKKDFFMQSPAKLTACDYHRELDMVVVGFSNGVFGLYQMPDFVCLHLLSISREKITTAIFNSLGNWLVFGCAKLGQLLVWEWRSESYILKQQGHYFDVNCIAYSPDSQLLATGADDNKVKVWTVSSGFCFITFSEHTNAVTAVHFMANNHSLLSASLDGTIRAWDLFRYRNFKTFTTASPRQFVSLTADQSGEVICAGTLDSFEIFVWSMKTGRLLDILSGHQGPVHGLMFSPINAILASSSWDKTVRLWDVFESKGAVETFQHSHDVLTLAYCPDGRQIACSTLDGLIHFWDPFDGLLMYTIEGRRDIAGGRLMTDRRSAANTSIGKYFTTLCYSADGTYILAGGNSKYICMYDVGEQVLLRRFQITRNLSLDGVLDFLNSKKMTDAGALDLIDDEDSDVEEGIDQQTRGNLGLGLPGSMANRGRPIARTKCVKFAPTGRSFAAATTDGVLLYSVDDSFIFDPTDLDIDVTPEKVEEALEENQQQRALLLSLRLNEDSLIKKCIFSVDPSNVRAICSSTPLKYLQRLIEAFSDLLESCPHLEFILLWSQELCKIHGNYIQQNSRALLPALKSFQKSITRIHQDLADTCSSNEYMLKYLCSSGTRN

SEQ ID NO: 18957 - protein, 441 aa, Cryptococcus neoformans var. neoformans
MDNTPRHLFQTPNNVYILQQPWQFVKELGQGAYGCVSSARNSSTGETCAVKKVTNVFQKKILTKRCLRELRLLHHFRGHKNITCLYDMDIVFDPPGSGQFREVYLYEELMEADLHAIIRSGQPLSDAHFQSFLYQTLCGLKYIHSANVLHRDLKPGNLLVNADCELKICDFGLARGFQPGAVQTDQGQAGFMTEYVATRWYRAPEIMLSFANYTSSIDMWSVGCILAELLGGKPIFKGEDYVDQLNKILNLLGTPTEDTLRRVGSPRAQDYIRSLPIKPRVKFGTLYPNASPLALDLLSKLLTFDPAKRYGCEEALEHPYLAVWHDPADEPLCEVPFDFSFEEEDSVSGMRDLILEEVRSFRYLVRQQTMPPVRKDSHELPPAPPAPQHPGAGVGPAFHEKRTAKAIWRNILGLHWRNSWRGRNYHRIIFVESVTVIGKHR

SEQ ID NO: 18958 - protein, 356 aa, Medicago truncatula
MTKNQNSNLIPSLPDDVAINCLARVPRSHHTTLTLVSKPIHSLLSSSLFFTARSLIPSTQHILYLSLRTRSTSLQFFTLHNNHRLLPLPPLPSPTIGSAYAVIHHKIYLIGGSVNDVPSRHVWILDCRFHRWLPGPSMRVAREFAAAGVIDGKIYVIGGCVPDNFSRSANWSEVFDPVNNRWESVPSPPEIREKWMHASAVVDGKVYAMADRGGVSFDPYNGAWESVGRELDIGWRGRATVVDGILYCYDYLGKIKGFDVKKGLWKELKGLDKSLPRFLCGATMADVGGKLVVVWECQRNLNGKGKEMEIWCAEIDVKKKKKKNKDGELWGEVCWLNNVLSVPKGSSIVHCNSVAL

SEQ ID NO: 18959 - protein, 388 aa, Zea mays
MALHAAAPACAVFCRLPSPSPSHVGGRRSLPAVASPRGVVSAAPLRTRAVPTKAIVNSDGIPETSDSPHVVCFGELLIDFVPTVNGVSLAEAPAFKKAPGGAPANVAVGIARLGGSSAFIGKVGDDEFGYMLADILKQNNVNNQGLLFDPHARTALAFVSLRSDGEREFMFYRNPSADMLLEEKELDLDLIRKAKIFHHGSISLITEPCKTAHIAAARAAKDAGVLVSYDPNLRLSLWSSPEDARDGILSVWRTADIFKVSEEEVSFLTNGEDPYDDAVVKKLIHSNLKLLLVTEGPDGCRYYSKDFSGRVGGLKVSAVDTTGAGDAFVAGVLSQLATDFSLLQDEGRLREALKFANVCGALTVTQRGAIPALPTRQQVLDALTNFVA

SEQ ID NO: 18960 - protein, 235 aa, Griffithsia japonica
ARGGMAPTAYVLFKKFMKFNPKNPDFVNRDRFVLSAGHGSMLQYALLYLFGYDSVSMDDIKQFRQYGSVTPGHPENFETKGIEVTTGPLGQGICNAVGIAMAEAHLAATYNKPDAKIIDNYTYCIMGDGCHMEGISSEACSLAGHYGLGKLIAMYDDNHISIDGHTDISFTEDVGARFEAYGWQVINVPNGNTNIAALEKAIEDAKACTDKPTLIKVTTIIGFGSPNKGDSHDSH

SEQ ID NO: 18961 - protein, 434 aa, Oryza sativa
MACSFHFVPLLLLLTLLLLISSASRTAALPSMRSSSEDTASNATAAARLRPGKELLKYKRIRALLKKLNKPSLKTIQSPDGDLIDCVPSHLQPAFDHPKLKGQKLLDPPERPKNYNLTIAVSSSSSSRVGEVVVQAWHAAGEECPEGTVAIRRTTEKDLLRASSLRRYGRKPARWNIRRDSTSNGHEHAVGYVNNDNYYGAKASVNVWSPRIGDPSEFSLSQIWVISGSFGNDLNTIEAGWQVSPELYGDSNPRFFTYWTTDAYQETGCYNHNCRGFVQTTNKIAIGAAITPESVYNGRQFDITLMLWKDPKHGHWWLELGPGMVVGYWPSYLFTHLAHHGNMVQFGGEVVNTRPSGSHTATQMGSGHFPGEGFDRAAYFRNLQVVDWDNSLIPAANLKLLADHPACYDIQGGSNSYWGSYFYYGGPGRNVKCP

SEQ ID NO: 18962 - protein, 1066 aa, Candidatus Desulfococcus oleovorans Hxd3
MPKRDDIHKVMIIGSGPIIIGQACEFDYSGTQACKALRSLGYTVVLVNSNPATIMTDPGMADITYIEPLNVATLTRIIEKERPDALLPNLGGQSGLNLSSELHQAGVLDKYGVKIIGVNVDAIKRGEDRTEFKNTMERLGIEMARSRTVTTVEDAEKVAEEIGYPVVIRPAYTMGGTGGGFVYNVEELRVIAARGLAASMVNQVLVEESVLGWEELELEVVRDAKNQKITVCFIENVDAMGVHTGDSFCTAPMMTISPALQERLQKYSYDIVDAIEVIGGTNVQFAHDPATGRVVVIEINPRTSRSSALASKATGFPIAMVSALLAGGLTLDEIPYWRDGTLEKYTPSGDYVVVKFAKWAFEKFVGAEDVLGTQMKAVGEVMSIGKNYKEALQKAIRSLENGRHGLGFAKNFNTISLDDLMAKLRKPSSERQFIMYEALRKGATIEALHGLTHIKAWFIEQMKELVDLEETLIKHRGNLPPDDLFVTAKKDGFADAYLSKILAVPETEIRKKRLSLGLAEAWEPVPVSGVENAAYYYSTYNAPDQVAVSENRKVMVLGGGPNRIGQGIEFDYCCVHAAFAIRDQGLESIMVNCNPETVSTDYDTSNKLYFEPLTVEDVLSIYAKEKPDGVIVQFGGQTPLNLARALEAAGVNILGTSPDTIDLAEDRDRFRQVMQDLGIPQPESGMASTLDQALEIAARIGYPLMVRPSYVLGGRAMEVVADEEMLRQYVTAAVDVSPDRPILIDKFLENAIEAEADAIADGTDAFVPAVMEHIELAGVHSGDSACVLPPVSIPEKHINTIVDYTRKIAMTLKVVGLMNIQYAIADDCVYILEANPRASRTVPLVSKVCNIPMARYAAQIMMGETLADLDLKPRKVRHFGVKESVFPFNMFPEVDPVLGPEMRSTGEVLGIADSFGYAFFKAQEATQAPLPTGGAVLITVADKDKQAILETARLFSDLGFTVLATQGTGEFLSRQGIAAQAVTKLGHGRPDIVDLIKNGDIQLLVNTPGGKASKEDDSYIRKAAVKYKVPYMTTVAASLAAARGIAARNRGEEQIHSLQEYHANIT

SEQ ID NO: 18963 - protein, 463 aa, Salmonella enterica subsp. enterica serovar Typhi str. CT18
MLTILKTGRSAHKVPPEKVQATYGRYRIQALLSVFLGYLAYYIVRNNFTLSTPYLKEQLDLSATQIGLLSSCMLIAYGISKGVMSSLADKASPKVFMACGLVLCVIVNVGLGFSSAFWIFAALVVFNGLFQGMGVGPSFITIANWFPRRERGRVGAFWNISHNVGGGIVAPIVGAAFAILGSEHWQSASYIVPACVAVIFALIVLVLGKGSPREEGLPSLEQMMPEEKVILKTKNTAKAPENMSAWQIFCTYVLRNKNAWYISLVDVFVYMVRFGMISWLPIYLLTVKHFSKEQMSVAFLFFEWAAIPSTLLAGWLSDKLFKGRRMPLAMICMALIFVCLIGYWKSESLLMVTIFAAIVGCLIYVPQFLASVQTMEIVPSFAVGSAVGLRGFMSYIFGASLGTSLFGVMVDKLGWYGGFYLLMGGIVCCILFCYLSHRGALELERQRQNALHNQDSLQLADAQ

SEQ ID NO: 18964 - protein, 664 aa, Oryza sativa (japonica cultivar-group)
MAAAAAAAASATAAISGALLPHAVACHRLPPRPQLLAVSSSFRRLSLTASPRRASRLVPRADASAEAGEPEPAAEAEAEAVAASTDAEVEEGEAEAAVAVAEEEQEEEDEPPPPSKPPVKFGEIIGILNKQFIEEAEKVKTLPDLRPGDIIELRMQRPNKRRLSLFKGIIIAKHKSGVHTTIRVRRIIAGVGVEITFPILRYSPRIKEIKVIRHKKVIPCLIVGKMIGTSSASSWKERPDFTLNEDNEGKGVAMGGGGTLISIYPEDLTFLFELDKPCYCNLKVVNNSEHHVAFKVKTTSPRKYFVRPNANIVQPWDSCTITITLQAQKEYPQDMQCKDKFLIQSTRVAASTDMDEIPPDTFNKEVDKVIEEIKLKVVYTVPSGSSDDSGITSLGSRSFKSLSDDFTMLKNASIEEIQTIQRLKDERDNMLQQNQQMQRELDVIRRRRSRKSDTGFSLTFAAFVGLIACCLNAMVAIKRYSVQLNAKKCDAHRGNSSISSSILTPNFSHGKRAGMLGNLRSTSHSILCFGGDGIRSPMSTFLDFRLDAQLVEGPSVQLGVAISLVGPGTHPYRGGASEAGSGVRGLRSARLKLATQAAPSLSSRTLVGHGDDGNGGYGGVAPVPPTSRRWDAADPNTILRVLCHRDDEVASQFLKRTFQLAERR

SEQ ID NO: 18965 - protein, 289 aa, Magnaporthe grisea 70-15
MMFGRLGDDVEKMTDALLVAWNICGPAQVHDPNKIYLDPKSEEWYANHGIPLRRGYLFHGPPGTGKTSLSLALADFFGLDIYVINLAEPALTDNSLLELANDVPERCIVLLENIDTVGLKRFEVKKLKQIRESSGRLAKRNGVTIGGVLNAFDGAASQEGRVLILATNKPASLDEALIRPGRVDLKLCFDNITKNHARDLFWRMYTPDTSAETNELVKLAAEFGCKISEKIFSPAEVPNYLIMHKDQPRQALSGVTDWVEAMKQKSRRHRGKPCAKVPTKCRKKMKRCR

SEQ ID NO: 18966 - protein, 412 aa, Salmonella enterica subsp. enterica serovar Typhi str. CT18
MADSRPERRFTRIDRLPPYVFNITAELKMAARRRGEDIIDFSMGNPDGATPPHIVEKLCTVAQRPDTHGYSTSRGIPRLRRAISHWYQERYDVDIDPETEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGAFTPLQVAAIAALEGDQQCVRDIAEQYKRRRDVLVKGLHEAGWMVEMPKASMYVWAKIPEQYAAMGSLEFAKKLLNEAKVCVSPGIGFGDYGDTHVRFALIENRDRIRQAVRGIKTMFRADGVLPSHPKPVEASTE

SEQ ID NO: 18967 - protein, 548 aa, Synechococcus sp. CC9311
MTTERITDDLNRLVSLLPAELQSSLASTESRDQLLEVVLDLGRVPEARYSGWSTALGSTSVTHADLQAMVERLGQFGSDNRAGIERTLHRISAIRNRRGEVVGLTCRVGRAVFGTVAMVRDLLDSGESLLLMGRPGVGKTTALREIARVLADDLGKRVVVIDTSNEIAGDGDIPHPAIGRARRMQVARPELQHQVMIEAVENHMPEVIVIDEIGTELEARAARTIAERGVTLVATAHGNALSNLIKNPTLCDLIGGIESVTLGDDEARRRRSQKTVLERAAEPTFSMAVEMHSRSRWAVYREVGRAVDALLRGQLPSPEERKMASDGRVLRVEPQLSTSPLRRPSLAPVPLPSPLDPIPLQPVGMGGSTQSELKPSQAPSKMFQVLCCGLSEQRLDEAVRRHDWSIQAVDDLVQADVVLSVRQGLGRQPELRRQAREAGVPILVIKSDTLPQVERALERLLMRRDSGLPHRDSADSGDGDGDQSDASAALEECRLAIEQVVVPQGRPVELLPRTEEVRQMQSDLVTRYRLRSDVYGTSGQRRLRVFPP

SEQ ID NO: 18968 - protein, 321 aa, Salmonella enterica subsp. enterica serovar Typhi str. CT18
MTKYALVGDVGGTNARLALCDIASGEISQAKTYSGLDYPSLEAVVRVYLDEHGVSVEDGCIAIACPITGDWVAMTNHTWAFSIAEMKKNLGFSHLEIINDFTAVSMAIPMLKKEHLIQFGGGEPVDGKPIAVYGAGTGLGVAHLVHVDKRWISLPGEGGHVDFAPNSEEEAMILEILRAEIGHVSAERVLSGPGLVNLYRAIVKSDNRLPENLRPKDITERALADSCIDCRRALSLFCVIMGRFGGDLALTMGTFGGVYIAGGIVPRFLEFFKASGFRGGFEDKGRFKDYVHGIPVYLIVHDNPGLLGSGAHLRQTLGHIL

SEQ ID NO: 18969 - protein, 130 aa, Oryza sativa
MVHMNVLADALKSINNAEKRHKRQVIIRPCSKVIVKFLTVMMKHGYIGEFEIVDDHRSGKIVVNLNGRLNKCGVISPRFDCPIRDIENWTKNLLPSRQFGYVVLTTSHGILDHEEARRKHTGGKVLGFFF

SEQ ID NO: 18970 - protein, 379 aa, Aspergillus nidulans FGSC A4
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYVHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 18971 - protein, 393 aa, Lactococcus lactis subsp. lactis Il1403
MKKNSDFVLKMDESVTLAAANRAKALKAQGRDIIDLTLGQPDFPTPKIIGQAAIEAIDNGKASFYTQAGGLPELKNAVQHYWTRFYNYEIQPNEILITAGAKFALYAYFMATVDPDDEVIIPAPYWVSYVDQVKMAGGNPVIVEAKQENNFKVTVEQLEEARTSKSKILLLNSPSNPTGMIYSKEELTAIGEWALAHDLLILADDIYHRLVYNGAEFTAISSLSDEIRKRTTVINGVSKTFAMTGWRIGLAVGDPEIISAMTKIASQTTSNPTAVAQYAAIEAFEERDNSFEIMHAAFEERLNIIYGQLSEVPGFELVKPNGAFYLFPKVTKAMAMKGYSDVTDFTTAILEEAGVALVTGAGFGSPENVRLSYATSLKNLEVAVARLKDWMNE

SEQ ID NO: 18972 - protein, 249 aa, Mycobacterium avium subsp. paratuberculosis K-10
MGETATLVLLRHGESEWNSLNLFTGWVDVGLTDKGRAEAVRSGELLAEQGLLPDALYTSLLRRAITTAHLALDAADRLWIPVRRSWRLNERHYGALQGLDKAETKARYGEEQFMAWRRSYDTPPPPIERGSTYSQDADPRYADIGGGPLTECLADVVVRFLPYFTDVIVPDLRSGKTVLIVAHGNSLRALVKHLDQMSDDDVVGLNIPTGIPLRYDLDARLRPLVPGGTYLDPEAAAAGAAAVASQGRG

SEQ ID NO: 18973 - protein, 306 aa, Crocosphaera watsonii WH 8501
MHNFLPIAYFENQFVPFENAKISIATHALHYGTAAFGGMRGIPDPENPQQILLFRLDRHCQRLCQSAKFLNYELSPEKLEQIIIDFVQKNQPTKSFYIRPLVYSSGLGIAPRLHNIEKNFFVYGLEMGDYLSPDGISCRISSWTRQEDRSFPLRGKISAAYITSALAKTEAVESGFDEAILMNSQGKVCEATGMNVFIVRKGKLITPGFEQDILEGITRDSVLTIAKNLGIPTIERPIDKSELLIADEVFLCGTAAKIAPVKQIETFKLPENRPITEQLKEKLSGITENKDSDYKNWIYVIPLEGK

SEQ ID NO: 18974 - protein, 368 aa, Bacillus halodurans C-125
MKSLMGVVNLDHDQDLLHELTYFRSVAGVPFGGRYRMIDFVLSNMVNSGIQDIAVFARNKYRSLMDHLGTGAPWDLNRKRGGLFILPPDWNDPTDISKGDLRHFHNHRDFFHRGNADHVLVSGSQFISKVDYEDAFKRHQETKADVTVLYKKVDQLEPEDRYRMKLEFDSFGNVKSITNDEMNSNLYMQMYIIRKELLLELLNHCIGYHKQDLFVDGIMSNLNELAIRAYEYKGYLSIISSVASYYKHSMDLLKPEIYQSLFLAGSPIYTKIKDEPPAKYVNGSEVSNSLVANGCVIEGHVENSILFRGVYVAKGVSIKNSIIMQRCYIHEDTHLDHVILDKDILISPNRQFAGAPEQPFVIAKRKAM

SEQ ID NO: 18975 - protein, 424 aa, Rickettsia akari str. Hartford
MTTMLVIVIIIMIALSALFAATETAITASSPGKIHKLKITGNKRAKTVLEVLKKKEKVIGTLLIGNSLINTVCTTIATTLFISFLGDNGPIVASGVMAFIIIVFAEVVPKAIAVAKPEQLALKMASTIVIFLKLFKPINIALDYITKIFCFIFRINLSPQISGTEEVRGVIEHYHQEGGVYKSDRNMLGGILDIRNMTVSEIMTHRSSIIALNIDLPHEVIIKTLLSGTHTRIPLWQDNRDNIIGILNLKDLLKALYENNNDTKKIDINTLLTPPWFIHENALVVDQLHAFRERNNHFACVVDEYGDLQGIITLEDVIEEIVGPITDEHDRLNNEIIQKSNTEFIIKGTTTIRDINRELDWNLSDEDANTIAGLIIHKIARIPNQGEVIEIFNFKIIILKKIANKIDSVKITVLPTTEEIISSE

SEQ ID NO: 18976 - protein, 474 aa, Crocosphaera watsonii WH 8501
MAETPQEVLKMIQDNNIQIIDLKFIDLPGIWQHCSFYHNQIDEDSFDAGVPFDGSSIRGWKAINESDMCMVPDPKTAWIDPFYEEPTLSLICSIKEPRTGEWYSRDPRTIAKKAVEYLQSTGIGDTAFFGPEAEFFVFDDVRFDQTENKAYYSVDSVEGRWNTGREEEGGNLAYKPGYKQGYFPVSPTDTLQDMRTEMLLTMAKCGVPIEKHHHEVATGGQNELGFRFATLIDAADYLLTYKYVIKNVAKKYGKTVTFMPKPLFNDNGSGMHVHQSIWKGGQPLFWEEGTYADLSKLATHYIGGILKHAPALLAFSNPTTNSYKRLVPGFEAPVNLVYSQGNRSASIRIPLTGSNPKAKRLEFRCPDATSNPYLAFAAMLCAGIDGIKNKIEPAEPLDVDFYELSPEELSKIPSTPGSLEQALECLGKDHAFLTDGGVFTEDFITNWIEYKLDNEVNPLRLRPHPYEFALYYDV

SEQ ID NO: 18977 - protein, 123 aa, Desulfovibrio gigas
MAKNNILIVDDSKTVRNLVAFILKKEGYKVTAAENGLDGLEKLYSMEQVDLIISDINMPKMDGFTFIRHVREQVLYRDLPIVVLSTEGQEKDIQQGLQLGANLYMVKPAQPEKLLRNVKMLLG

SEQ ID NO: 18978 - protein, 497 aa, Pseudomonas fluorescens PfO-1
MTTLTRADWEQRARDLKIEGRAYLNGEYTDAVSGETFECISPVDGRLLGKIASCDADDAQRAVENARATFNSGVWSRLAPTKRKATMIRFAGLLKQHAEELALLETLDMGKPISDSLYIDVPGAAQALSWSGEAIDKIYDEVAATPHDQLGLVTREPVGVVGAIVPWNFPLMMACWKLGPALSTGNSVILKPSEKSPLTAIRIAELAVEAGIPKGVLNVLPGYGHTVGKALALHNDVDTLVFTGSTKIAKQLMIYSGESNMKRVWLEAGGKSPNIVFADAPDLQAAAESAASAIAFNQGEVCTAGSRLLVERSIKDKFLPMVIEALKAWKPGNPLDPATNVGALVDTQQMNTVLSYIESGHSDGAKLVAGGKRILQETGGTYVEPTIFDGVSNAMKIAQEEIFGPVLSVIAFDTAEEAINIANDTPYGLAAAVWTQDISKAHLTAKALRAGSVWVNQYDGGDMTAPFGGFKQSGNGRDKSLHAFDKYTELKATWIKL

SEQ ID NO: 18979 - protein, 201 aa, Rickettsia akari str. Hartford
MICDIINLLKEDLNKADIENEIYMRLKGPYSVLTKMKRKEVPIDALKDLIACRIIVKSKALCYNALDVVKSSSHLDWLYTKDYINRPKSNGYQSLHNIMQCLHSQRNFEIQIRSEDMHKDAELGRAAHLNYKEEQDRHLKKVFDVSNDTILSKARKMVKQFKGLEEQIVEYEKEIMHIWDTKYEEMLKWENAAAVLVFNEE

SEQ ID NO: 18980 - protein, 250 aa, Burkholderia vietnamiensis G4
MQSVPASLSLTDTAFFFDFDGTLVELAPTPDSIHVPPSLLTLLDTLRQRSHGAVAVVSGRGIDNLDTFLSMPDLPIAGLHGAERRDSNGDTQRIGFNDERLLRIERELAAVVDRHPGMLLEIKGAAVALHYRNAADREPVAREAAERLVAEYADAYVLQPGKMVFEIKPKGVDKGRALAAFLDEPPFAGRVPLFAGDDLTDEKGFAVVNARGGLSIKVGAGETSARMRLDSVAALHAQIARWLDLELPGA

SEQ ID NO: 18981 - protein, 156 aa, Zea mays
KSIFFSSCRTSGPFQLAKRSRAAAMAGAGAPAVPQAGRPAPNFDVIVEGAGIMGNCTAHAVASRGARVLLLERFDLLHPLGSSHGDSRIIRDTYAHPQDLRMVRLARRLCGDDGGRGLIACTTRLRTSPCGLRSSACFSTVISSSGAEEMPLTILT

SEQ ID NO: 18982 - protein, 462 aa, Bacillus anthracis str. Ames
MTFSKSTTDKPSYTYEELSVKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKPKKQRFVTLKEAYHGDTIGAVSVGAIDLFYQVYSSLLFEAIKMPYPYTYRSPYGNDKAEIVKKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGSYEEQKTFFHGHSYTGNPLGCAVAIANLELYEKTNLIEEVARKTEYVATQLEELFACKHVGDIRQCGLMVGIELVKNKETKEAFEWTERVGVQVCKRSRELGMILRPLGNTIVFMPPLASTIDEIDEMLRILYKAISDITEGE

SEQ ID NO: 18983 - protein, 290 aa, Zea mays
TPPPLHYHGGTACLCSSALLRTPRSPTPTRGVAKIHRSAYSSLATSPPAAESQREGEDYASDHGGDDIEDNLQSPLISRQATSVEGKEIAAPHGSILGAVGRSSSLQGGEAVSSMGIGGGWQLAWKWTEREGEDGQKEGGFQRIYLHEEGVQGNRGSILSLPGGDVPPGGEFIQAAALVSQPALYSKELLEQRAAGPAMMHPSEAVTKGPRWADLFEPGVKHALFVGIGIQILQQFAGINGVLYYTPQILEQAGVGVLLSNLGLNASSASILISALTTLLMLPSIGIAMR

SEQ ID NO: 18984 - protein, 413 aa, Salmonella enterica subsp. enterica serovar Typhi str. CT18
MTDNRVENSSGRAARKLRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELFFSQPDMAQLGKGMVIPALPNPEAVFLAAGVLGATIMPHVIYLHSSLTQHLHGGTRQQRYSATKWDVAIAMTIAGFVNLAMMATAAAAFHFSGHTGIADLDQAYLTLEPLLSHAAATVFGLSLVAAGLSSTVVGTLAGQVVMQGFVRFHIPLWVRRTITMLPSFIVILMGLDPTRILVMSQVLLSFGIALALVPLLIFTSNATLMGELVNTRRVKQIGWIIVVLVVALNIWLLVGTVMGLS

SEQ ID NO: 18985 - protein, 423 aa, Mesorhizobium sp. HN8A1
VMFDGSSIAGWKAINESDMVLMPDPDTVHMDPFFAHSTMVILCDILDPVSGESYNRDPRGTAKKAEAYMKSEGIGDQIFVGPEAEFFVFDDVKYKADPYNTGFKLDSTELPSNDDTDYDTGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSG

SEQ ID NO: 18986 - protein, 1237 aa, Acetivibrio cellulolyticus
MVNKGRKCLYSLKRISCLLIILCIIISTASISFVQAAEQLQVDIGKVSGEPGSIVSVPVTFSNVPATGIYALSFSVNFDKSMLSVVSVEPGSLIEDPSDFNHYYNNVNGLASMSFEAPVDGSRMIDNNGVFASIKFKISETAPVGESYDITTNYSRTSFYSTGTEEIVNILCNNGAINVGADLKAEIGSVSGKPGSVVSVPITFSNVPKSGIYALSFRIGYDNTKIRVVGVESGSLVEKAEDFNMFINNTYNFTSMTFEAPIDGSRMIKSDGVFAQVKFQISDTALQGETYKISQISSNTSFYSTAVTEITDVIYADGAIKVGSDLQVDIGSTSGKAGSVVSVPITFTNVPKSGIYALSFRTNFDPQKVTVASIDAGSLIENASDFTTYYNNENGFASMTFEAPVDRARIIDSDGVFATINFKVSDSAKVGELYNITTNSAYTSFYYSGTDEIKNVVYNDGKIEVIASPTPTQSATPTVTPSATATPTQSATPTVTPSATATTTPTQSAKPTVTPSATATPTPTQSAKPTVTPSATATPTPTQSAKPTVTPSATATPTPTQSAMPTVTPSATATPTPTQSAMPTETPSATATPTPTQSAMPTVTPSATATPTPTQSAIPTVTPSATATPTPTQSAMPTVTPSATATPTPTQSAKPTVTPSATATPTPTQSAMPTVTPSATATPTPTQSAMPTVTPSATATPTPTQSAMPTVTPSTTATPTPTQSAMPTVTPSATATPTPTQSAMPTVTPSATATPTPTQSAKPTVTPSATATPTPTQSAMPTVTPSATATPTPTQSAMPTVTPSATATPTPTQSAKPTVTPSATVTPTPTQSAMPTVTPSATATPTPTQSAKPTVTPSATATPTPTQSAMPTVTPSATATPTPTQSAKPTETPSATATPTPTQSAMPTETPSATATPTPTQSEMPTETPSATATPTPTQSAIPTVTPEVTTSATPTPTPTGSVTPGVTTSTTPTPTQTVKPTATTVNEGPGVIPGGNPDVNPSPITTPTPKPTATPTSGAVVEPTSEVPGPDGLPLSHTAYLKGYPNGLFLPDNNITRAEAATILAKLSGADVTYVSDKVSFPDVKDTHWALWAIKYTTDKGYFKGYTDGTFKPDQKITRAEFATIVYHFLGIEDTNITKYKFEDVKGHWAQVYIEKLTELKYISGYPNGNFEPQASIKRCESVALLNRALKRGPLYGTTQKFPDVPTTHWAFKDIAEGALDHQYIIEGTLEKLYVK

SEQ ID NO: 18987 - protein, 172 aa, Oryza sativa (japonica cultivar-group)
MPMMEASPVYSAARNASGDAWKALFDLAGGLIQVYDQEAMLSLSKFVDQLPSVMNQVTEGVSEFKPTPPENREFCKNSYNVPNTLLVKFSIDAIDDTEIVEDVLKPRVESIGGQIKKVILSGTHLTPCIQDVKWQVGSEYTPADALAQGLKSLALNETRVLSRTIADWFRSL

SEQ ID NO: 18988 - protein, 575 aa, Haemophilus influenzae R2846
MISGILASPGIAFGKALVLKEEKIVLDTQKITDDQIDAEVARFYEGRAAAVEQLNSIRERALISLGEEKAAIFEGHLMILEDEELEEEILDYLRSNKVNAGVAASKILDQQVTMLSEIDDEYLKERAGDIRDIANRLVKNILGMYIVDLGDIQEESILVAYDLTPSETAQLNLEKVLGVVTDIGGRTSHTSIMARSLELPAIVGTNKVTKLVNTGDYLILDAINNQVYINPTASQIDELKALEAKISEEKAELAKLKDLPAITLDGHKVDVVANIGTIRDCDGAERNGAEGIGLYRTEFLFMDREQLPTEEEQFIAYKQVVEAMNGRLTVLRTMDIGGDKELPYLDLPKEMNPFLGWRAIRIALDRREILNAQLRAVLRASAFGKLAVMFPMIISVEEIRELKAVIETLKAELREEGRLFDNNIQVGVMVETPSAAVNAKFLAKEVDFFSIGTNDLTQYTLAVDRGNEFISHLYNPMHPSVLGLIKQVIDASHAEGKWTGMCGELAGDERATLLLLGMGLDEFSMSAISVPRIKKLIRNVNFQDAKVLADAALQKPTAAEIDQLIEEFLLENSLN

SEQ ID NO: 18989 - protein, 383 aa, Bacillus halodurans C-125
MKKEIVGMLLAGGEGKRLGQLTRKLAKPAVYFGGKYRIIDFPLSNCTNSGIDTVGVLTQYEPLALNGHIGIGSPWDLDRRHGGVTVLPPYIEKQGGSWYKGTADAIYQNRYYIEQYDPEYVLILSGDHIYKMDYDRMISHHKKLGADATISVIEVPWEEASRFGIMNTNEEMTITQFEEKPTTPISNLASMGIYIFNWSVLKSYLIQDAKQANSSHDFGKDIIPKMLAKDLKLVAYPFEGYWKDVGTIKSYWEANMDLLDEHSSLMLNDPSWRIYSVNRNQPPQYISTRAYVRCSLVNEGCVVHGNVEQSILFPGVHIGANSSVFESVLMPNVKVGENVVLRRTIIMEGACIPSGTHLAPSDPDDILVIDKDTEFSPSIAANQ

SEQ ID NO: 18990 - protein, 248 aa, Vicia faba
MASSFSTQLVQSQNLLPRFHAVQGKPHVVSSIGCSKLSSTYHYAPRLSVSQQSKAKSITSRRITCASGAQGEVAELQAKVTSKIFFDIEIGGESAGRIVIGLFGDAVPKTVENFKTLSTGAKGYGYQGSFFHRIIPNFMIQGGDFTEGNGTGGVSIYGSKFEDESFDLKHVGPGVLSMANAGPNTNGSQFFICTVPTPWLDNRHVVFGHVIEGLDVVKQLESQETSKLDNSPKKPCKIAKSGELPLDG

SEQ ID NO: 18991 - protein, 451 aa, Mycobacterium sp. MCS
MSPETSSEATEQVQDEPATGGKLKRKITGPLLFLFILGDVLGAGIYALMGVLAQDVGGVLWAPLLVALLLALLTAGSYAELVTKYPRAGGAAVFAERAFKRPVVSFLVGFSMLAAGVTSAAGLALAFAGDYLSTFIDVPAIPAAMVFLGLVAALNARGINESVKSNVVMTVIELSGLLIVIVAVAMMVGGGRGEVGRVVEFPDGATPALAILAGAIVAYYSFVGFETSANVAEEIRNPSKVYPTALFGALITAGVVYALVGVASAVALPADQLSESSGPLLDVVSAAGVGVPDWLFSAIALVAVANGALLTMIMSSRLTYGMAEHGLLPSVLSRVLPQRRTPWVAIVATTVVAMCLTLVGELSTLAETVVLLLLFVFISTNVAVLVLRRDHVGHDHFRVWTAVPVLGVASCVLLMTQQTAKVWAFAAIMLAVGAVLYGLARIATKRQRTAV

SEQ ID NO: 18992 - protein, 78 aa, Hordeum vulgare subsp. vulgare
RGDINVLMVGDPSVAKSQLLRAVMNIAPLAISTTGRGSSGVGLTAAVTSDQETGERRLEAGAMVLADRGVVCIDEFDK

SEQ ID NO: 18993 - protein, 1250 aa, Oryza sativa (indica cultivar-group)
MPKPTQHIPIVQRLCAHSRQIKIGRDGALRADSETASRSGLGPAPAFGTWAERNIILAHLIPTARTMWAEPEIAVNYGPRRGGCESSSSRPTLQPAPILRHPFAGGFSPPLPPPLHRRPRNLDTSPLAGDHHHGASRFASTSVVKQSSGGLLGWFLGGNSSQLPPLDVPLPGVIISPPLPDFVEPSKTKITTLPKGIKIASETSPIPAVSVRLYIDCGSVYETSSSSGTSHLLERMAFKSTTNRSHLRLVRECYAPEMVEVLIDSGRNPAFLEWEVKEQLQKIKSEISEVSGDPHGLLMEALHSAGYSGALAKPLMASESAVNRLDVATLEEFVSENYTAPRMVLAASGIEHDELVSVAEPLLSDLPSVKRPEEPKSVYVGGDYRCQADSTSTHIALAFEVPGGWRQEKTAMIVTVLQVLMGGGGSFSTGGPGKGMRSWLYLRVLNNYGQIESFSAFSSIYNNSGLFGIHATTNPDFVSSAVDLAARELHEVATPGKVTQEQLDRAKEATKSSVLMDLESRIVASEDIGRQVLTYGERKPIEYFLKTVEEITLNDISSTAKKIISSPLTLASWGDVACCVFVQTHANIVLPVLHFNIESDVMASWLSHLPIHRCQLSFPAAQASYATPGIDSALLLDVDDMAGGDAGLNEGLKKQAKPRLRLPKPAAKRSESEFLRSRPLALLMASSHIILPPDDDDEEQRRLEEEEDEDPWARSGPPPAAPEHAVKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPHQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGFIAMYATLASRDVDCCLIPESPFYMDGEGGLLQYVERRLKENKHMVIVVAEGAGQDLIAKSLSTSEQQDASGNKLLLDIGLWLTHKIKDHFKSKKIEMTIKYIDPTYMIRAIPSNASDNVYCTLLAHSAIHGAMAGYSFTVGNVNGRHAYIPFYRVTSTRNKVKITDRMWARLLSSTNQPSFLSQKDIDEAKENDRTANKPPLPTGLSHHVANSFDQSASSSSNSQI

SEQ ID NO: 18994 - protein, 308 aa, Zea mays
MAENFQLQGRHGKSRVRVSRVWRRPAAAGGDVIVEWNVAVSIVSDCLPSYTSSDNSAIVATDSIKNTVYVKAKECTEVVSMEEFAVILGRHFTSLYPQVSEATVTIVERPWERVTVDGRPHSHGFKVGVEKHSTEVIVKKSGSLLINSGIQGYSLLKTTQSGFEGFVTDRYRLLPDTRERIVATEVTAWWRYPFEHVSQLPSKKPFCFTQRYQDVKKVLAETFFGPPDVGVYSPSVQNTLYLMAKEVLTRFPDIASVQLRMPNLHFLPVNLGSKEAPLVKFADDVYLPTDEPHGTIEATLISRPMSKL

SEQ ID NO: 18995 - protein, 758 aa, Burkholderia vietnamiensis G4
MTPFARYARVRTTDAAASCVRARQPVPLFRMSRQPAPLYPTITTMTRSTRRDFLRVAAGTAGAAALNLFPPVIRDALAIPANRRTGTIRDIEHIVILMQENRSFDHYFGTMRGVRGFGDPRPLRLASGKSVFHQPAGPAEVLPFHPGADNLGLQFLQDLPHGWQDMHAAWNKGRYDQWVPNKGTTTMAYLKRDDIPFHYQLADAFTICDAYHCAIPSSTDPNRYYMWTGYVGNDGTGGGPVLGNEEQGYGWTTYPEVLEQAGVSWKIYQDVGTGLDAKGSWGWTQNPYIGNYGDNALLYFNQYRNALPGTPLYEKARTGTNISAGGTLFDVLEQDVKNGTLPQVSWICAPEAYSEHPNWPANYGAWYIEQVLKVLVSNPEVWSKTALFITYDENDGFFDHVPPPFAPQSRDNGLSTVATTNEVFAGDASHMAGAYGLGPRVPMLVVSPWTKGGWVCSQTFDHTSLLQFIEARFGAQYPITAANVSPWRRAVCGNLTSAFDFSNADAAWPTLPDTSGYAPADRVRHPDYVPVPPALQTVPKQEAGLRPARALPYELFVHGRVEPASGQFRLTFANTGRAGAAFQVQSRNRVDGPWAYTVEAGKRLADTWSAAASLGLYDLDVYGPNGFYCHFRGSFASGVGGTSANPEVVYGYDVANGNITLRLMNRGHKAVRLKVSNAYGHRGARTFELAPGAHVDDYWDLRGSHGWYDLTVSDERPLGFVRRFAGHVETGRPSTSDPAIRTSATQDVVEAASDALAD

SEQ ID NO: 18996 - protein, 628 aa, Francisella tularensis subsp. holarctica
MCGVVGFYSFNKEEGFDSIINQSLLSIKHRGSDDSGYWCDNQVTLGHTRLSIHDITNAGHQPMLSNSGNTAIVFNGEIYNYLSIKNQLLSEYSNLKFKSNSDTEVLVNAIELWGIDKTLEKCIGMFAFGVYSRKTSCLILARDRFGEKPLYFGIQNGILGFASELKALKPLKECGWRFDIDRDALAAYMRYAYVPTPYSIYKNISKLNVGSYIKFDAKGNSKEYKYWDSKKVLDSEKYKDSYDQAILDLEIKLKSTLSIQMQSDVPLGAFLSGGIDSTTVIALMQSMSKDKINTFSIGFNQKEYNEAEHARAVAKHIGTNHTDMYVTERDALDVIPKLAGIYDEPFADSSQIPTYLVSKIAKSKVTVALSGDAGDELFGGYNRYFLAPNIAKKIKFAKLLKYAPDAWIKKAEILNFGKFALLADKLLKLKRVLEKAKTNKELYVLLCSQINDTSFVLGAKEYDILRDKNIYDIPQLSFQEWMMFVDSNTYMIDDILVKVDRAAMANSLETRVPFLDHNIYEFAYSLPIDYKIQRGNGKRILKDLLYKYVPESLVNRSKMGFGIPLAKWLREDLREWADNLLDYSKIDKQGYLSPEVVQKYWQEHLSGKRNWQAILWNILIFQEWLDNE

SEQ ID NO: 18997 - protein, 172 aa, Lupinus luteus
MSNPKVFFDMAIAGNPAGRIVMELYADTTPRTAENFRALCTGEKGVGRSGKPLHYKGSTFHRVIPNFMCQGGDFTAGNGTGAESIYGAKFADENFIKRHTGPGILSMANAGAGTNGSQFFICTEKTEWLDGKHVVFGKVIEGMNVVRDIEKVGSGSGKTSRPVTIADCGQLS

SEQ ID NO: 18998 - protein, 707 aa, Oryza sativa (japonica cultivar-group)
MLRALNTPTPPLRLRPACRVASQCGGRPSTRRRGAGGGPRRAVPQPPVRRPSGDRACTPWRGGVGAAAPAPVTPVAAAGARDELEAFLEVVPARMRRGLARHPEVRELVEVVMDLGRRPLARFPSGDWVISEQAVTADDLHQAVSKVGDFSEDNRSGINHSLHRISAIRNRKAHIIGLTCRVGRAISGSAEMIRDLVVGGGSILVIGPPGVGKTTLISLRCFQQYREIARILADEGKKRVIIVDTSNEIGGDGDVPHSGIGRSRRMQVPKVSMQHNVMIEAVENHMPEVIVIDEIGTELEAMAASTIAQRGVQLVGTAHGVTIESIIKNPCLQVLVGGIESVTLGDEEAKKRKVQKTILERKGPPTFSCAVEMISKTECRVHHKLEATVDAILAGKPPKFEARKMDYKATESGRSLVIPEREYETEPLPSYQEHHFAKAMPSEDNFDDDFSTRRTESKSVPSNDNFNDDFGSTRKTKGKTSVPGKSPVHVYTYQISEADILQVATVMGFDDELDVTDDIGAANVILASSSEMKQNHWIRNVAKYHKLPIFVVKTNTMAQIVKAVRMIVGRDKLNAPTRKQPKVVVGEIEIEDDAPKRKPSLEEIDALEEARLAIEYIVIPGGEPVELLPRCSEIVARQLELVESYQLLAETFGTDSNSRLQILPVKITKKSSSKGSAGSMPKQGSSDLIVSDNGGGSSFSRLPFLPK

SEQ ID NO: 18999 - protein, 105 aa, Citrus sinensis
GEGTATQDSNNSGANSNGTATNGGEEDLKSWDTDFVKVDQATLFDLILAANYLNIKGLLDLTCQTVADMIKGKTPEEIRKTFNIKKDFTPEEEEEVRRENQWAFE

SEQ ID NO: 19000 - protein, 163 aa, Uromyces viciae-fabae
MANCYFDVSSNGKPLGRIVFELYDDVVPRTTNNFRQLCLNPPGKGFKHSIFHRVIPDFMIQGGDFTNGNGTGGESIYGKKFEDENFQKKHVERGMLSMANAGPNTNGSQFFITVTKTPWLDGKHVVFGKVIEGYDQVVKAMEKTGSQSGKTSSVLKIEDCGTL

SEQ ID NO: 19001 - protein, 593 aa, Arabidopsis thaliana
MEISEKWIRHYSSTHKILLVGEGNFSFSLCLASAFGSAMNITATSLDSEDELSIKYMDAVDNINILKRYGCDIQHEVDVHTMSFDNSLSLQRYDRIVFNFPHAGSRFFGRELSSRAIESHKELVRGFLENAKEMLEEDGEIHITHKTTYPFSDWGIKKLGKGEGLKLLKKSKFELSHYPGYITKRGSGGRRSDDYFPVDVDPCDLKGFEVLEIYHPSMSDGFVNSVMVARKLTDRLIKYEWCTGTRSLNSLKKTRQTEPDQFNKREINRSGPGQVAEEEEEVVAVMMMMTSLGGGAGGGGGGGGSGGGRFVTYPPPLSVPPSAPQSPNFSGGLRSQPSFLVEQEKYLSELLAERHKLTPFLPVLPHVCRLMNQEILRVTTLLENALSQSRFDHPSPLASGGIFQNSRADMNGWASQFPSERSVSSSPAPNWLNSPGSSSGLIVKRTIRVDIPVDKYPNYNFVGRLLGPRGNSLKRVEASTDCRVLIRGRGSIKDPIKEDMMRGKPGYEHLNEPLHILVEAELPIEIVDARLMQAREILDDLLTPVEETHDFYKKQQLRELALLNGSLREEGSPMSGSISPYNSLGMKRAKTRG

SEQ ID NO: 19002 - protein, 234 aa, Zea mays
MDIWKSKVLPKIKLVFVKSAGKAAAAAAELVKSFDESKEGIDGEFQEKKADLQPKVVEIYESAPAPLKVLIKERSKVSGIKKNSAAITKFFEELAKIEFPGAKQVSDGISKAGPALLSGPIFATFEKVSTLLPVVAAEEPAKEAPAPPATEEAATKEAPRKPLAPAAAVEKKEETQEEEKKEDTPAPPAAETAPPADAAAATEQPAAEAAAEAEAPPAPAVAEPAKAEEETPKA

SEQ ID NO: 19003 - protein, 462 aa, Streptomyces avermitilis MA-4680
MSSRTTLDTAPETSAADAPLSHGLKQRHLSMIALGGVIGAGLFVGSGAGIAAAGPSIVIAYSVSGLLVMLVMRMLGEMSAAYPSSGSFSAHAERAIGPWAGFTAGWSFWVLLCTAVGLEGIGAAKIVTGWLPGTPEWGWVALFMVVFCVANLAAVKNFGEFEFWFAALKVGAISLFLVLGVLAMTGVLPGTDSPGASNLHDFLPNGSEGLVIGLLASVFAYGGLETVTIAAAESENPVQGVARAVRTAMWRIALFYIGSMAVIVTLVPWDSKEVVEKGPYVAALDHLGIPGAGQLMNVVVLVALLSAMNANIYGSSRIAYSLVERGQGPKALGRVSGGVPRIAVLVSCVFGFVCVVLSYWRPNDVFPWLLNMIGAVILVVWIFIAVSQLLLRRKVEREAPEKLVVRMWAYPVLTWVALAGMAAIFILMARQPDTRVQLYSTGAMTLVLAAVGYAWQRARARA

SEQ ID NO: 19004 - protein, 546 aa, Glycine max
MAPSPQEIIFRSPLPDIPIPTHLPLYSYCFQNLSQFHDRPCLIDGDTGETLTYADVDLAARRIASGLHKIGIRQGDVIMLVLRNCPQFALAFLGATHRGAVVTTANPFYTPAELAKQATATKTRLVITQSAYVEKIKSFADSSSDVMVMCIDDDFSYENDGVLHFSTLSNADETEAPAVKINPDELVALPFSSGTSGLPKGVMLSHKNLVTTIAQLVDGENPHQYTHSEDVLLCVLPMFHIYALNSILLCGIRSGAAVLILQKFEITTLLELIEKYKVTVASFVPPIVLALVKSGETHRYDLSSIRAVVTGAAPLGGELQEAVKARLPHATFGQGYGMTEAGPLAISMAFAKVPSKIKPGACGTVVRNAEMKIVDTETGDSLPRNKHGEICIIGTKVMKGYLNDPEATERTVDKEGWLHTGDIGFIDDDDELFIVDRLKELIKYKGFQVAPAELEALLIAHPNISDAAVVGMKDEAAGEIPVAFVVRSNGSEIAEDEIKKYISQQVVFYKRICRVFFTDSIPKAPSGKILRKVLTARLNEGLVVAN

SEQ ID NO: 19005 - protein, 436 aa, Zea mays
MDQGHLKDSLLVPSSRAAATNGPHHRRATLAPGTGAGGPCGGAGGVSIDVNGLKRRGGGRRSWVRVDAATGAAEAVEVAKPALMRRLDLPARDLRLLDPLFVYPSAILGRERAVVCNLEHLRCIITADEALVLREPDAAGGAAAEEAVRRYVDELQRRLVDRADDLPFEFIALEVALEAACSFLDSQAIELEAEAYPLLDELTAKISTLNLERVRRLKSKLVALTRRVQKVRDEIEQLMDDDGDMAEMYLTEKKIRMEASMLDDEDLQGIGNSHNGFGSSLSAPVSPVSTTPATRRLEKEFSFARSRHSSFKSSDSSQYNIEELEMLLEAYFVVIDYTLSKLTSLKEYIDDTEDFINIQLDNVRNQLIQFELLLTTATFVVAIFGVVSGVFGMNFEVPLFSVPHAFEWTLAITGVCGAVVFCCFIWYFKKRRFFPL

SEQ ID NO: 19006 - protein, 349 aa, Crocosphaera watsonii WH 8501
MSSFKKFLISSRIFQFLFGLLFFLILSKTWLNHTSVNATTAFTELCLNQERLSEEAQYTVSILLEKARNADCEIAARHLAQLDKLDLSATEIKDLTPLSSFQKITELYIADNQIIDITPLSYLKRIEKLELSNNSISDISPLANMKKLETLWMWNNQVSSLKPLAKLKNLTHLYLPNNKIVNLRPIAFLKNLEAIIFDNNQITDISALSLLDKLIGVSLMKNKIEDISSLENLENLKVFMAPYNRINDLSPLEKLSQLNLLILDNNLVKDIRPLSNLLNLEKVHLSHNTIVDITPLSFLPKLSYIQLNNNRIKDTSSLKNLTQVTHLNIANNPLNYLNCPMETDSICRF

SEQ ID NO: 19007 - protein, 279 aa, Thermosynechococcus vulcanus
MTSSLELQPQTSRLNWGFVFFLGAVHILAAVALFFFSWSALAVTIFLHWLFGSIGICLGYHRLLSHRSFQVPQWLEYVIAVVGALAMQGGPIFWVAGHRLHHAHTEDEIKDPYSARRGFWWSHMLWLVYPQSQFFNAEEYARFAPDLTRDPFYRWLDRYFLLLQLPLALLLYGLGGWSWLLWGMFMRAVFLWHSTWLINSATHKWGYRRFETEDNSRNLWWAALLTYGEGWHNNHHAYPHVAKAGWYWWEVDPTWWVIRTLQGLGLAAKVQLPPPKALS

SEQ ID NO: 19008 - protein, 453 aa, Pediococcus pentosaceus ATCC 25745
MTEKIIVVGCTHAGIAAVNEILKYHPQADVTVFERHDTISYLSCATYLTLGKTISNLDEAMYADPDYYRAQGIDMRLRHDVIDINVEEHTVFAQDLETKEFTTESFDKLIMATGSLTSIPTIQGVENPKVKLCKTYEEARDLCDEAQNDERIAIIGGGYIGVELAEGYNKSNHEVILFHKKETPLDRHIEPEIADKITNLLEDKGIQVKTGTIVKSFEDGANDTLIVKTADEAFEVDMAVICTGLLPQADLLQGKVDQLTNGAIVVNDYMETSNPDIFAAGDAASVKHNGLQTDVYMPLASQAVRQGALAGINVLDKRLRSIGTQSTTGMLIFGRTLACSGVTLAMALDAGINATKVAYKGSYRPDFMPNAHKVEIELVYDRNSRKVLGVQLWSKHDVSQAADTISALMHYHGTIDELSFIDMLFSPNFDQPFNYLNLVGQLAVKQENGYLRT

SEQ ID NO: 19009 - protein, 550 aa, Zea mays
MASKKPPGLRLFGGAGSLRTYQTLVLVLTFFAYACFHMTRKITSIVKSALDPQTKMGFSHWGRLHLHTSEAPALNTGWLPFNTADGSALLGEIDVAFLAAYSIGMFFAGHIGDRIDLRIFLTIGMVGTAVFTALFGAGYWLNVHSFYYFLVVQMVSGLFQSVGWPSVVAVVGNWFGKSKRGLIMGVWNAHTSIGNIAGSLLAAFLLEFGWGWSFAVPSLVMALVGLVVYVSLPVSPEVMEIDIAGSGELNCEKDTGTVKEPLLEPGQQVKHKAVGFLEAWRIPGVAPFALCLFFSKLVAYTFLYWLPFYISHTRIGGEYLSDATAGSLSTIFDVGGVLGGVLAGHISDRLNARAITAASFTYCAIPALFLYRTYGSMSMAWNVSLMFVTGMFVNGPYALITTAVSADLGTHSSLNGNSRALATVTAIIDGTGSVGAAIGPLVTGYVSSRSWSAVFTMLMAAALLAGLLLSKLVCAELQGKTHSSVSKDAGGEHGAYSDEVVYVKWRANHLLYTGMANSAFTLNVGLLFCRGNSATTPDIKYCSGESVKED

SEQ ID NO: 19010 - protein, 287 aa, Tamarix sp. ZDY-001908
MEGKEEDVRLGANKFPERQPIGTAAQTHEEKDYREPPPAPLFEPSELTSWSFYRAGIAEFIATFLFLYITILTVMGVKRSDSMCKSVGIQGIAWAFGGMIFALVYCTAGISGGHINPAVTFGLFLARKLSLTRALFYMIMQCLGAICGAGVVKGFMPTIYQVQGGGANEVAHGYTKGDGLGAEIVGTFVLVYTVFSATDAKRSARDSHVPILAPLPIGFAVFLVHLATIPITGTGINPARSLGAAIIYNRSAAWNDHWIFWVGPFIGAGLAAIYHQVVIRAIPFKSK

SEQ ID NO: 19011 - protein, 126 aa, Pseudomonas fluorescens PfO-1
MTKTVITSDKAPAAIGTYSQAIKAGNTVYMSGQIPLDPKTMELVEGFEAQTVQVFENLKAVAEAAGGSFKDIVKLNIFLTDLSHFAKVNEIMGKYFDQPYPARAAIGVAALPKGSQVEMDAILVIE

SEQ ID NO: 19012 - protein, 1128 aa, Oryza sativa (japonica cultivar-group)
MSSSRPTQCSSSSSRTRQSSRARILAQTTLDAELNAEYEEYGDSFDYSKLVEAQRTTGPEQQARSEKVIAYLHHIQRAKLIQPFGCLLALDEKTFNVIALSENAPEMLTTVSHAVPSVDDPPKLRIGTNVWSLFTDPGATALQKALGFADVSLLNPILVQCKTSGKPFYAIVHRATGCLVVDFEPVKPTEFPATAAGALQSYKLAAKAISKIQSLPGGSMEVLCNTVVKELFDLTGYDRVMAYKFHEDDHGEVFAEITKPGLEPYLGLHYPATDIPQAARFLFMKNKVRMICDCRARSIKIIEDESLHLDISLCGSTLRAPHSCHLQYMENMNSIASLVMAVVVNENEDDDEVGADQPAQQQKRKKLWGLLVCHHESPRYVPFPLRYACEFLAQVFAVHVNKEFELERQVREKSILRMQTMLSDMLLRESSPLSIVSGTPNIMDLVKCDGAALLYGGKVWRLQNAPTESQIRDIAFWLSDVHRDSTGLSTDSLHDAGYPGAAALGDMICGMAVAKINSKDILFWFRSHTAAEIRWGGAKHDPSDKDDSRRMHPRLSFKAFLEVVKMKSLPWNDYEMDAIHSLQLILRGTLNDDIKPTRAASLDNQVGDLKLDGLAELQAVTSEMVRLMETATVPILAVDSNGLVNGWNQKVAELTGLRVDEAIGRHILTVVEESSVPVVQRMLYLALQGKEEKEVKFEVKTHGSKRDDGPVILVVNACASRDLHDHVVGVCFVAQDMTVHKLVMDKFTRVEGDYKAIIHNPSPLIPPIFGADEFGWCSEWNAAMTKLTGWHRDEVINKMLLGEVFDSTNASCLVKNKDAFVSLCILINSALAGDETEKAPFSFFDRNGKYIECLLSVNRKVNADGVITGVFCFIQVPSHELQHALHVQQASQQNALTKLKAYSYMRHAINNPLSGMLYSRKALKNTGLNEEQMKEVNVADSCHRQLNKILSDLDQDSVMNKSSCLDLEMVEFVLQDVFVAAVSQVLITCQGKGIRVSCNLPERYMKQTVYGDGVRLQQILSDFLFVSVKFSPVGGSVEISCSLTKNSIGENLHLIDLELRIKHQGKGVPADLLSQMYEDDNKEQSDEGMSLAVSRNLLRLMNGDVRHMREAGMSTFILSVELASAPAK

SEQ ID NO: 19013 - protein, 919 aa, Oryza sativa (japonica cultivar-group)
MATPDVILPGPSLRPMPYMRSAPSARPEYHECATCHGPAKTRCSRCKSVRYCSGKCQIIHWRQGHKQTCQQWNGFGTSSSGGLPPTENTEQMPFLSNLNSPLRGSDVHLHDMDFDTMSEPSFVTTDSYNLDTSPFLSDRSNMNKPNQFLHTSENGAAIGSYEKNDYSIDGEVPSSEILSGNKGLNNSSGSGENCGNRDVIYPLNSVVHQPNNYAPEIRKRPKASITVYESDKGVYLTSDMISSGEGPYASAAESLQRSNSSGNVTGKGNMIHKKPPYPSGKVSSSQKSQEKVLTSHQYDGHEKNPHNKNEQRSTKTAVSTNSSLQGCNGISKAGASKVEALKKPSKFLKTSLVGLINDNKRSKVLFPYEDLVKFFQYEVRGISPRGLFNCGNSCYANAVLQCLMCTKPLMIYLLLRLHSKDCCSKNWCLMCELEQYASTLRESGGPVSPSRILSNLRNIGCRLGGGSQEDAHEFLRHLVMSMQGACLDGLGGEKQVEASLQETTLIQQMFGGRLKSKVKCLRCYHESERYENIMDLTLEIHGWVESLQDALTQFTAPEDLDGENMYKCGRCSAYVKARKQLSVHEVPNILTVVLKRFQTGKYGKINKCVTFPDMLDMVPFVTGAGDNPPLYFLYAVVVHVDTENASFSGHYISYVKDMQGTWLRIDDSEVQAVSLNQVMSEGAYMLFYMRSFPRPPKIYIEKGLSSVPTCSKRHSSKSSKGSKQDLNHTESLFASSDQTYGIYDFRPDNGYIQDQHAALRTRNFYHTDDAFADSISTDFSDATSSEWSLFTSSDESSFTTESTRDSFSVVDYGDNAGLDPISSIFGPYYAQDHPPGSFASCTRLSPSNPQTRYFQENTGFVSDSSMPAHLPGNVHRGRYPDRACSSSAEPPASANPRSVYGRYGLSREGFVQTSGFCQM

SEQ ID NO: 19014 - protein, 124 aa, Thermus thermophilus HB27
MEAVKTDRAPAAIGPYAQAVKAGGFVFVSGQIPLAPDGSLVEGDIRVQTERVMENLKAVLEAAGSGLSRVVQTTCFLADMEDFPGFNEVYARYFTPPYPARATVAVKALPRGVRVEVACVALAE

SEQ ID NO: 19015 - protein, 628 aa, Bordetella bronchiseptica
MCGVLGAWWRHHDEHEDARFAAGLRKLAHRGPDDRGSEHFAAPHGRLSLGHTRLAVIDLSAAGHQPMHADADRLAVVFNGEIYNYRELRSELRQIGASFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGQAGEPMAWDDPASQECRPIGFQEAAEELRARFLDNVRLHLRSDVPIGAALSGGIDSSAIVCAMRWLEPDLPIQTFSFISDDTHRSEERWVDLVNQHCGATGHKIHIAPHELLDDLDDLIRVQGEPVGSTSIYAQYRVFKLAREHGVVVTLDGQGADELLGGYGGYPTERLASLLETGRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALSLPERYLVSDSGQTKHIFRKAMRGIVPDSILDRDDKIGFATPEQQWMQATAPQMRQWLVDAADIPFLRNAEVTAQFDAMIAGATPFSWQAWRWVNFQRWMQHATVLP

SEQ ID NO: 19016 - protein, 568 aa, Bacillus cereus ATCC 14579
MSKFTVASNGALETTLRGAEVLSTPLLNKGVAFTQNEREELGLKGLLPPAVLTLEEQARRAYEQFSSQPDDLLKNVYLTALHDRNEVLFYRILTDHLREMLPIVYTPTVGVAIQRYSHEYRKPRGVYLSINDSSGIEEAFTNIGATAENIDLVVVTDGEGILGIGDWGVGGINIAIGKLAVYTAAVGIDPSRVLPVILDVGTNREELLNNPFYIGNRHPRITGEAYDEFIDTFVQAVNKQFPKALLHWEDFSSRNARKILDKYRHDVCTFNDDIQGTGAVSLAAVLSAVKASGVPLSEHRVVVFGAGTAGIGIADQVRDAMVRVGVSEEESYKRFWCIDRNGLVTDNMEDLLDFQIPYARKEAEVSEWKENDVIGLAEVVKHVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAESVARVNLSDNDIKMAVQEAMWKPRVSPNKSGRKG

SEQ ID NO: 19017 - protein, 217 aa, Brassica napus
  misc_feature (183)..(183): Xaa can be any naturally occurring amino acid
  unsure (1)..(217): unsure at all Xaa locations
MSSSQFRYTQTPSKVVHLRNLPWECVEEELIELCKRFGKIVNTKTNVGANRNQAFVEFAELNQAISMVSYYASSSEPAQIRGKTVYIQYSNRHEIVNNQSPGDVPGNVLLVTFEGVESHHVSIDVIHLVFSAFGFVHKIATFEKAAGFQALVQFTDVETASAARNALDGRSIPKYLLPDHVAXCNLRMSYSAHTDLNIKFQSHRSRDYTNPYLPVNH

SEQ ID NO: 19018 - protein, 473 aa, Xanthomonas smithii subsp. citri
MQHPRAFACLGDRVTDLLVRTSVEEGDAHVCFLRAHKRCRAVRAGQSIECGGVEQEHEIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGEKYDGGNSGYRPGVKGGYFPVPPTDSLHDLRAEMIKTLEQVGIETEVHHHEVATAGQCEIGTKFSSLVQKADELLTMKYIIKNVAYRNGKTATFMPKPIVGDNGSGMHVHQSLAKGGVNLFTGDGYGGLSQLALWYIGGIFKHARAINAFANSGTNSYKRLVPGFEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 19019 - protein, 407 aa, Oryza sativa (japonica cultivar-group)
MALAVDDHEEVADDFRGATMWWRKSKAIPRANVISWAPRQDERRSYHLTFHRRHRALVEADYFPHVLAEGRAVTVRNRQRRLFTNNPGADWSGYDDARVWSHVKLEHPSTFATLAMDPVRKQEIIDDLDMFRDGKDYASVGKAWKRGYLLFGPPGTGKSTMIAAMANFLDYDVYDLELTAVESNTELRRLFIETTGKSIIVIEDIDCSIDLTGKRKKKKKDKKKKKMMPPSDDDDEEKKVTLSGLLNFIDGLWSACGGERIIIFTTNHKEKLDPALIRRGRMDMHIEMSYCCFESFKVLAKNYLGVEQHEMFGEIRQLLEEADMSPADVAENLMPRSKTKDVDACLERLVKALHEAKETKAAGGNDDDDESSSSSDDSDSSSDSEEQDKLAVVTKLDFSLAQPNYII

SEQ ID NO: 19020 - protein, 192 aa, Triticum aestivum
FELEYLNIGGGLGIDYHHTGAVLPTPMDLINTVRELVLSRDLTLIIEPGRSLIANTCCLVNKVTGVKSNGTKNFIVVDGSMAELIRPSLYGAYQHIELVSPSPGAEVATFDIVGPVCESADFLGKDRELPTPDKGAGLVVHDAGAYCMSMASTYNLKMRPAEYWVEDDGSIVKIRHGETFDDYMKFFDGLPA

SEQ ID NO: 19021 - protein, 387 aa, Silicibacter pomeroyi DSS-3
MNISSDTGFRRAGRLDGIELSEIVQISERVAQLRADGADIVALSTGEPDFPTPTHVIEAAHRAALAGQTRYPATAGTPALRAAIAAEAGVEPANVIVSTGAKQVLAGAFLATLDPGDEVITTAPFWTSYADMVRLAGGVPVVLDCPGAQGFKLTPAQLEAAITSRTRWLLLNTPSNPTGAIYSEAELQALGAVLDRHPHVWVISDEIYQHLAYVPFTPFVQAVPTLADRTLIVNGVSKAYSMTGWRIGWGIGPAPLIKAMVAVQGQITSGACSIAQAAALAALSGPQDLLVERRAEMLARRDLVVAGLNAAGLECASPDGAFYVFPKTPARMPVDHDFCHHLLDTAGVALVPGRAFGMSGHLRLSFAYARQSLEEGLARIARAVAAL

SEQ ID NO: 19022 - protein, 331 aa, Arabidopsis thaliana
MAGKSDLPVIARDDNLSEETKTLISSLPTYQDSHVKLCKYQGCWYYHNTLQAVINYQRNFQPQDTDIILASFPKSGTTWLKALSVAIVERSKQPFDDDPLTHPLLSDNPHGIVPFFEFDMYLKTSTPDLTKFSTSSPRLFSTHMPLHTFKEGLKGSPCKVVYMCRNIKDVLISDWHFRSKYSNNEVSRSTLESMFESFCGGVSFYGPFWDHALSYWRGSLENPKHVLFMRYEEMKTEPCVQVKRLAEFLGFPFTKEEEDSGSISKLLELCSLGNLSGLEVNKTGKTWMNYDYKSYFRKGEVGDWKNHLTPEMENKIDMIIEEKLKGSDLKF

SEQ ID NO: 19023 - protein, 494 aa, Streptomyces avermitilis MA-4680
MTSQPTLSKAENGPDRPGEPGGGLQAGLKNRHLSMIAIGGVIGAGLFVGSSTGIATAGPGILLSYALVGTLVVLVMRMLGEMSAANPTSGSFSAHADRALGRWAGFSIGWLYWFFWVVVLAVEATAGAKILEGWMPGVPQWGWALIVMVVLTATNLVSVGSYGEFEFWFAGIKVVAIGAFIVVGGLAIFGVLPGVDAPKAGLGNLTDSGGFLPHGPGAILTGVLLVVFSFMGSEIATLAAGESEDPQRAVTKSTNSIIWRIGVFYLGSILVVVSLLPWNDPSIKDKGSYVAALDSLGIAHAGQIMNFIVLTSVLSCLNSGLYTASRMAFSLGQRGDAPKAFARTTSRGVPLAAIVVSVVFGFVAVFFNYKFPDSVFLFLVNSSGAVALFVWLVICFSQLRMRKIIQRESPEKLVVKMWLYPYLTWATAALIVFVLGYMLTDTEHDGRETVLLSLLVAAVVLVIAVVKQKLDGSRAVAAAGADEPAVAEAVADAH

SEQ ID NO: 19024 - protein, 310 aa, Brassica napus
  misc_feature (188)..(188): Xaa can be any naturally occurring amino acid
  unsure (1)..(310): unsure at all Xaa locations
MAESAGVVAVYGEGSMTETKQQSPFSVKVGLAQMLRGGVIMDVVNAEQARIAEEAGACAVMALERVPADIRAQGGVARMSDPEMIKEIKQAVTIPVMAKARIGHFVEAQILESIGVDYVDESEVLTLADEDNHINKHNFKIPFVCGCRNLGEALRRIREGAAMIRTKGEAGTGNVVEAVRHVRSVMGXIRLLRGMDDDEVFAYAKKIAAPYELVMQTKQLGRLPVVQFAAGGVATPADAALMMQLGCDGVFVGSGIFKSGDPAKRAKAIVQAVTNYRDAAVLAEVSCGLGEAMVGINLDDKVERFANRSE

SEQ ID NO: 19025 - protein, 381 aa, Mycobacterium sp. MCS
MSPPQQRHQRVVVVGAGPCGLAIARQLLHEQRIEPLVLDRATAPASTWRDRYEGFRLNTCGYWSHLPGQPIPRRYGRWPKRDDMVDYFDSYVRRQRIPLSLGVTVTRIDRDGDRWLITTDGDTYTADAVVIATGNYHTPALPAWPGMEGYTGDLLHSADYRNPWPFAGRDVLVVGSGNSATDIALQLSDEVAGRVRLAVREPPHLMPRSAAGIPVDAFSAAFSRLPVPVIDHAAALASRLWFGDLTSVGLPAPRRGIYRALLDDGSIPTLGDELVPQIKAGRIEVVAAVESFEGDSVVLADGRTIRPDVVIGATGYRHGLEPLVGHLDVLDEDGAPLVNGLPPAAPGLWFAGYEEPIIGPLQSFRLQAGPLAAEVAGFAAG

SEQ ID NO: 19026 - protein, 459 aa, Crocosphaera watsonii WH 8501
MRTQWVAKRRGQSNVSQMHYARQGLITEEMDYVAKREGLPPELIREEVARGRMIIPANINHPNLEPMCIGIASKCKVNANIGASPNSSDLDEEVAKLNLAVKYGADTVMDLSTGGGDLDTIRSAIIKASSVPIGTVPIYQAMESVHGNMDKLCADDFLHIIEKHAQQGVDYMTIHAGILIEHLPLVRSRLTGIVSRGGGIIARWMLHHHKQNPLYTHFDDIIEIFKKYDVSFSLGDSLRPGCTHDASDEAQLAELKTLGQLTRRAWEHDLQVMVEGPGHVPMDQIEFNVRKQMEECSEAPFYVLGPLVTDIAPGYDHITSAIGAAMAGWYGTAMLCYVTPKEHLGLPDAEDVRNGLIAYKIAAHAADIARHRPGARDRDDQLSEARYNFDWNRQFELSLDPERAKEYHDETLPADIYKTAEFCSMCGPKFCPMQTKVDADALTELEKFLAEKDREKVAK

SEQ ID NO: 19027 - protein, 533 aa, Pediococcus pentosaceus ATCC 25745
MILMSNEIKNPKKRRKLVEYANGRSLEEINGTVKVPKNIGFWKALFMYSGPGALVAVGYMDPGNWSTSITGGQNFQYMLMSIILISSLIAMLLQYMAAKLGIVSQMDLAQAIRARTSKSLGIVLWILTELAIMATDIAEVIGAAIALYLLFHIPLAIAVFITVLDVLLLLLLTKIGFRKIEAIVVCLIMVILVVFVYQVALSNPNWGAVFSGLVPTTKAFETSPTIGGMTPLSGSLGIIGATVMPHNLYLHSAVSQTREIDHNDEEDVARTLRFSTWDSNIQLSFAFIVNSLLLVMGVAVFKSGAVQDPSFFGLFHALNDTSTLSNGILIGVAKTGVLSTLFAVALLASGQNSTITGTLTGQVIMEGFIHMRMPLWARRLITRLISVVPVLICVMITSGKGDLQEHEALNQLMNNSQVFLAFALPFSMIPLLMMTDSRVEMGDRFKNSWAVKILGWISVIFLTYLNMTGLPNSITAFFGANPSAGEVELAHIIAYMLVAVVLALLAWTVFELHKGNQRYELEMRSKAEAKEEA

SEQ ID NO: 19028 - protein, 348 aa, Triticum aestivum
MESLPVPSVQAMVAATGGADVPPRYLRPAEAVTGIVDGEGEAQIPIIDYRRLLLELDRRGEESARLHSACQEWGFFQLVNHSVPADVVEGMKANIQQFFQLPAETKKRFAQERGQLEGYGQLFVVSEDQKLDWADMLYLYTQPPESRNTKFWPDQPVNFRSTLDRYSGAVKEIADSLLATMAENLGLKQEVIADRCVGGVQSVRMNYYPPCAQAEKVVGFSPHSDADLLTLVLQVNHVQGLQIKRNGSWFPVRPVEGALIVNIGDIFEIFTNGRYRSIEHRAVVDPKEERLSAAAFHSPNIHATIGPLKELTADEDEAYKTVDHENFMRLFFATKLEGKSFLDRMKLK

SEQ ID NO: 19029 - protein, 183 aa, Zea mays
  misc_feature (143)..(143): Xaa can be any naturally occurring amino acid
  unsure (1)..(183): unsure at all Xaa locations
MITAAPALPMFLRLCPASPFLLRPSLHVPSSRRPTPSRLSSFRPARPLFPISAVEKTNEAAAAGEGELEGMPPEFYDELVEAFHCSGDSICARTNKHAVEQEWQARQRERTKEWHAYRQKEEAEEERITNEYREIGMRLKAYXQEEVRKARILVSSFIRAGGDVEESVGQMHQNIAFFGVAVT

SEQ ID NO: 19030 - protein, 440 aa, Oryza sativa (japonica cultivar-group)
MESDTDLISVLPGEVLQHILSFSRIRAIVRMRRLSRRWMRVIECLQFICLDYRDFKHWKVEKFARFVDNLLLIRSKVDLHTFQLYWFHYLPLNCNDLRKWILYAVKHNVKVLDVELDMYDKTALPSRIFTCRSVEELSLQMGEAPDEDLEHVGLVLPDIIQLPSLKKLTLSDVEVDQLSLNQFIGRSPNLEDLHLINSATYLDLIASKVLKRLTLDGFMHGPKRFTISAPHLVHFECQGCALQDVSWGEKPSLESAHIDTWGKKYDGESEFIGVLLSAKTLALFGSDVKFLVMTCSLTQYKVMLEKELPACPVFERLTTLEIARKGAETDAMPIDGMTFQCPFLETVIIQCSKGDDGINKLVNVLAANGINPKKIQVNFYEDIEEMERAENRRIIEEREKELCNFEKMAKKNPEWVDESRYADSNPETDSDEYDDDYDDF

SEQ ID NO: 19031 - protein, 274 aa, Zea mays
SSRLKQRTCAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 19032 - protein, 158 aa, Bacillus subtilis subsp. subtilis str. 168
MELLTNFPLLSSLAAIIFAQVIKVPIQFIVSRKLDWSLVTSTGGMPSSHSAAVTALSTGVALEHGLDSSLFAVSAIFAVITMFDATGVRRHAGEQATVINKLVIDFNRFVNEAKDFPKAAEKEKQKKLKELLGHQPIEVFFGGLTGILLTLVLAYFFM

SEQ ID NO: 19033 - protein, 152 aa, Triticum aestivum
MALRSIKTPSVTPTAAVSSSITNKPQSFRFVSKPSASLAVHNLHQPISITRSNLLPKLKPASPPAKFRCSASAALTPQLRDTLEKLVNSEKVVLFMKGTRDFPMCGFSNTVVQILKNLNVPFEDVNILENEMLRQGLKEYSNWPTFPQLYIG

SEQ ID NO: 19034 - protein, 162 aa, Bacteroides thetaiotaomicron VPI-5482
MEYKDQKYTYLGGLIHGISTLATGMKTSIKVYFRKKVTEQYPENRKELKMFDRFRGTLAMPHNENNEHRCVACGLCQIACPNDTITVTSETIETEDGKKKKILAKYEYDLGACMFCQLCVNACPHDAITFDQNFEHAVFDRTKLVLQLNHAGSKVIEKKKEV

SEQ ID NO: 19035 - protein, 273 aa, Oryza sativa (indica cultivar-group)
MSTAAAAAAAQSWCFATVTPRSRATVVASLASPSPSSSSSSSSNSSNLPAPFRPRLIRNTPVFAAPVAPAAMDAAVDRLKDGFAKFKTEFYDKKPELFEPLKAGQAPKYMVFSCADSRVCPSVTMGLEPGEAFTVRNIANMVPAYCKIKHAGVGSAIEYAVCALKVELIVVIGHSRCGGIKALLSLKDGAPDSFHFVEDWVRTGFPAKKKVQTEHASLPFDDQCAILEKEAVNQSLENLKTYPFVKEGIANGTLKLVGGHYDFVSGNLDLWEP

SEQ ID NO: 19036 - protein, 117 aa, Ostreococcus tauri
MAKKRTNVIPIIEDARHPQKYRMLIGMVDTIFADVAQPDQARIVGLNAQYFLKQGGNFMISIKASCIDSTAAPEAVFAREVKKLQTEGFKPKEQLTLEPYERDHAMVTGIFRAPSKK

SEQ ID NO: 19037 - protein, 538 aa, Bacteroides thetaiotaomicron VPI-5482
MKNEERRIMQEIQFIVPAALHDEMLRLRNEKQMDFLESLTGMDWGVADEKDAPEKLRGLGVVYHLESTVTGERIALKTAVTDRERPEIPSVSDIWKIADFYEREVFDYYGIVFVGHPDMRRLYLRNDWVGYPMRKDNDPEKDNPLCMANEETFDTTQEIELNPDGTIKNREMKLFGEEEYVVNIGPQHPATHGVMRFRVSLEGEIIRKIDANCGYIHRGIEKMNESLTYPQTLALTDRLDYLGAHQNRHALCMCIEKAMGIEVSDRVKYIRTIMDELQRIDSHLLFYSALAMDLGALTAFFYGFRDREKILDIFEETCGGRLIMNYNTIGGVQADLHPNFVKRVKEFIPYMRGIIHEYHDIFTGNIIAQSRMKGVGVLSREDAISFGCTGGTGRASGWACDVRKRIPYGVYDKVDFQEIVYTEGDCFARYLVRMDEIMESLKIIEQLIDNIPEGPYQEKMKPIIRVPEGSYYAAVEGSRGEFGVFLESQGDKMPYRLHYRATGLPLVAAIDTICRGAKIADLIAIGGTLDYVVPDIDR

SEQ ID NO: 19038 - protein, 165 aa, Ostreococcus tauri
MHAAAVSSAKTIRGVSVARVALKNARAHTRSRVVDVRAAKKEIIATDKSPAALGPYSQAVKVGNTVYVSGQIGLTPAMEFAGSTVEEQTEQVMKNMGEVLNAAGATFDDVVKCTIMIANMDDFKTVNGIYGSRFPGENPPARATLAAKSLPLGALVEIDAVAVIG

SEQ ID NO: 19039 - protein, 1227 aa, Oryza sativa (japonica cultivar-group)
MPEPEVGVLGGRGLHRDGLKGWPDLRSLSGKKMTTPPPPPVEKQQQQARPAAVAPPDQTLEFSDGLLLRVLACLPEPHLTGAASLVCRRWMRLAGRLRRRLVVRDWAFVTHRLHHRFPELADLDLFPASIVAPAVPSPTSPLLTCAEVSLTLDTGADPPLVACRFLADDVLDRGLVAVAASFPNLRRLSATAASESGGLMDIAGGCATLQELELHRCTDLALRPVSAFAHLQILRLVAASSALYGTSEDGGVTDIGLTILAHGCKRLVKLELVGCEGSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCSVRRYNACKLQCMDPSMFGVSMPLLLLWRVKFLSLEGCSQLTTRGLESVITSWSDLQSLKVVSCDKIKDEEISPALSELFSTFKELKWRPDNKSRLAASLAGTGMGKKGRVLCKRLREREMKGKGQRTDAGAQLSTNRARMSVKGRAPPPEEGKKNGEKMAAAAAIPIPIPCVAEPTAASRVSPGSSPARSDASEGAAFYAADTEAEPEASVGRSTQMLLAMAAMGGRGGPYGRRPASSYGSCAAWSAGSLTDHRPASPSPICSPVSSNGGEGCRDVERTNPVPPRFIHKATPARLMRRARSSHNYRRRLGAMDAINEWRLPKVSEEEDEAVDQTDWQADTLSSRISSARDWNFEAGGAYEGSDHNGGAFNHSDGENSPVAVQRMGRWPQGSAVKHKENFVHAKLVAWKNAEIEKLIDKLRRKEADIDEWQMNQVTQAKEKMKRIEIKLEKKRARAAEKMQKAIKDAQKKADKKKIKEHAATDNQIASVERAMVKMSRTGKLPWFLEVFVCPSNCNQNNSSALSTIPMRSGEGRDCEVPGSTAVQGTNVPTISQEQDRSVYKELRSQNEEFFELFMLKVSLKRQIDRVNHHLALCRKLWRQANESAGGHRCGNSSCSGGHRHRAVAVPVPHAEATPRAMPSTPLAVPLPATAMAQRTQCNLARMPRPQQPNCGGRPGSSRGGAVGLSAAGRMLETPGQPHVAPNGWPAGHGHPASGTLAAAMACSSRPVARQQGNRREQGWDAHQAQVGAQHQNLPRFPPQQGGGNIGERQGQGQFRPGTPSYVQEQRPPPQSSSSHEALQAGERQQANNNSSGSSRQQRQTDTATVASRREPMSK

SEQ ID NO: 19040 - protein, 515 aa, Citrus unshiu
MASIGSLKVPSSPSTAATSSNSNNHSRRSVVKRLAFSSSQLSGDKIFSKAVTGDRRRERRRSLCLLQAVSDSKNSPLDPEASRRVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKLATAFGLMKIDEEGRIIEFSEKPKGEQLKAMKVDTTILGLDDARGKEMPFIASMGIYVISKDVMLSLLRDKFPGANDFGSEVIPGATSIGMRVQAYLYDGYWEDIGTIEAFYNANLGITKKPIPDFSFYDRSDPIYTQPRYLPPSKMLDADVTDSVIGEFCVIKNCKIHHSVVGLRSCISEGAIIEDTLLMGADYYETDADRRFLAAKGSVPIGIGKNSHIKRAIIDKNARIGNNVKIVNRDSVQEAARETDGYFIKSGIDTIIKDALIPSGTII

SEQ ID NO: 19041 - protein, 872 aa, Burkholderia pseudomallei K96243
MRRAEESQLKQQASHDQIVLVAPLTGPVVPLADVPDPVFSGGMFGDGIGIDPLEGRLLAPCAGVVSHVARTGHAVTIAADGGAEILLHIGIDTVELNGLGFTAKIAEGARVAAGDLLIEFDQDAIARAAHSLVSVIAIANSDAFEVVERAGAGVVKAGETPLLALRARGAGASAGTSASASAGAAADASCAQPAAEARKSITLTQPGGLHARPAARAREAARGLDAHVDVHFEGRKAALQSVVGLLGLGAGEHATIELVATGRDAAKALERVAHELLREAHGEAEEKPARIVSPAPAAAGIARAPLEPNTLAGVCAAPGIAVGTLVRWDDAQIVPPELASGTPAAESRLLDRALAEVDAQLETTVREASRRGAIGEAGIFAVHRVLLEDPALVDAARDLISLGKSAGYAWRETIRAQTAVLADVDDTLLAERAADLRDIDKRVLRALGYASASARELPAEAVLAAEEFTPSDLASLDRERVAALVMARGGATSHAAIIARQLGIPALVAVGDALYAIAQRTQVVVDASAGRLEYAPSALDVERARHERQRLAGVREANRRMSGEAALTRDGHRIEVAANIATLDDARVALDNGADAVGLLRTELMFIHRQAAPTASEHQQSYQSIVDALQGRTAIIRTLDVGADKEVDYLTLPPEPNPALGLRGIRLAQVRPDLLDDQLRGLLAVKPYGSVRILLPMVTDVGELVRIRKRIDDFARAMGRAQAVEVGVMIEVPSAALLADQLAQHADFLSIGTNDLTQYTLAMDRCQADLAAQADGLHPAVLRLVDATVRGAEKHGKWVGVCGALGGDPVAVPVLAGLGVTELSVDPVSVPGIKAQVRRLDYQLCRQRAQDLLALESAQAVRAASREIWPAE

SEQ ID NO: 19042 - protein, 474 aa, Bacillus cereus ATCC 14579
MAQVSNTNNELKRTMKSRHLFMIALGGVIGTGLFNGSGFIISQAGPGGSVLAFIAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFILLGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHFKVKKRNSTNTHSETKISETS

SEQ ID NO: 19043 - protein, 546 aa, Bordetella pertussis Tohama I
MRPSVNSLMNTSHIANEPVLDYRPGSAERQCLANALDALRVAQSHVPLVIGGQRQRGVAARALHCPHDHGHTLGMVEQADELTAGAAVQAAVAAQAEWAAMPFGERAAIFLRAAELLAGPWRQTLNAATMAGQSKTVHQAEIDSACELIDFLRFNVAFAERLQQSQPLSTHGALNRLDYRPLEGFVYAVTPFNFTAIGGNLPCAPALMGNTVVWKPAFTASLSNYLILELLEAAGLPPGVINFVPGDSAAVSAAVLRSADFAGLHFTGSTAVFDGLWQQVARNLPGYRTYPRLVGETGGKDFVLAHASADPETLGVALLRGAFEYQGQKCSAASRAYVPASLWPRARQALLDNLATVRMGDVADFGNFMGALIDRKAYERVMRYIDRAPAQGSTVLAGGRGDDRVGYFVQPTVIEAADPKAATMQEEIFGPVLSVHVYPDAGWNDVLALVDQTSPYSLTGAVFANDRQAIGQAAAALRFAAGNFYVNDKPTGAVVGQQPFGGTRRSGTNDKAGSMLNLQRWVSPRTVKETWVPARHYGYPSMDDAA

SEQ ID NO: 19044 - protein, 399 aa, Oryza sativa (japonica cultivar-group)
MRTFQGHNPNTMKVHSRKSQPSKKKPREFYDTVEVHIIDDDSDGDANIHKDYSMEDTSKHLVMYNPEITYDKQGEVEVTEPIDNYTSLNQRYMKPRHGYNTVLPSIGAYTVQCAHCFKWRIIPTKEKYEEIRENICQDVFVCERAREWNRVISCVDPEDISQDGSRVWAIDKASISQTPPGWDREVRIRGEGCSKFADVYVTVSFPGFAVVRDIWYHIFGRFHIRISNFFLYVPNSIFMYYTSPTGKKLRSLVEVGRYLAENPHYIRQGVNLTQFSFATPKPLQEDYVRKHTYAATPELPELLETAQVDPLCWAAPPTRSELLGELGASTSRSVDVSQSEVSYPVDLHQPEESAPLPPRTKKKTMKRGRVSATGSQSTPPGSSKDQSGGCVSDVEFVSL

SEQ ID NO: 19045 - protein, 288 aa, Robiginitalea biformata HTCC2501
MEDQGEVASYIPELAKVDPANFGVHISTIDHRHFGSGNCYDKFSIQSIAKVLALVMAYRIVGDEIWNRVGVEPSGTAFNSLVQLETDRGIPRNPFLNAGAIVVSDILLSKLKNPREDFIAFVRSITNNTSLDYSRRIAQSEKEVGYRNVALCNFIKSFGQINNEPVDVLDFYYDLCSLEMSCQELSGLFLFLANNGCDVKSKNPVLSESQSKRINALMQTCGFYDESGDFAFKVGLPGKSGVGGGIIAVHPDQYAIAVWSPRLNKKGNSYRGMKFLEEFTTRSELSIF

SEQ ID NO: 19046 - protein, 356 aa, Oryza sativa (japonica cultivar-group)
MARRRRGFPATLVTLLRLVGCLLLAFFLAAPPCAAAQQVKTSHAQFAFHLPSPDGVTGAESLAFDSSNHGPYTGVSDGRVLRWGGAAAGWTTFAHHENYRKIPMCTTPVAPAEETESMCGRPLGLAFHDRTGDLYIADAYKGLMRVGPRGGEAEVLAAGADGVPFNFVNGIDVDQATGDVYFTDSSTTYPRRFNSEIMMNADATARLLKYDAATKRVTVLRAGLPYANGVAVSRDGSHAVVAHTVPCQAFRYWIKGPNAGEYELLADLPGYPDNVRRDANGGYWVALNQEKARLDATAAAAVAPPAKHLVGVRLDGDGVEVEELTAAKGVTLSEVVERGGKLWLGSVELDFIGLMQ

SEQ ID NO: 19047 - protein, 321 aa, Carboxydothermus hydrogenoformans Z-2901
MNSIGVLTSGGDAPGMNAAVRAVVRKALFHGIKVYGIERGYAGLINNEIKEMSLGSVGDIIQRGGTVLKTARSLEFKTYEGRLRAFQNLKNHGIEGLVVIGGDGSFQGALKLYEEFGVKVVGIPATIDNDIYGTDYSIGFDTTVNTVVDAINKIRDTAFSHERTFIVEVMGRNAGFIALEAGIAGGAESIIIPEIPYSIEEICQKLIKSHQRGKLHSIIIIAEGAGSGIKLGEVIKEKTGFETRVTILGHIQRGGSPSAFDRILASRMGAMAVDALREGISQGVMVAFEKGEYVLKPLETAFSGKKQIDLEYYRLADILSI

SEQ ID NO: 19048 - protein, 532 aa, Carboxydothermus hydrogenoformans Z-2901
MKGFGFMNFQLNLGKILKRAASYFGEKTIVSYEALERKEITYREFYSRVLALIGYLKALGVKRGSRVGVFAWNNLAHLMLYYAVPCSEAVLHPVNLRYSKEQMLYTINHAEDEVLFVEKEFLPLVAEIKSELQRVQQILPLDAVFTNFVSFAENFDQIPEDLPAKLCYTTATTGTPKGVMYSHRDLYLQSMALCMTDSFGISEKERILIMVPMFHVNSWGIPYAAAMVGATMVLPGGNFKGQFLAKIISEEKVSLAAGVPTVFQEILKAAQSENIDLGSLRTVLVGGAPLTREIIEGFARYGVEVRQVYGLTETAPFVASNYQKSTLVHLSEEEKKKQQLKIGLPAPGVEVRVVGKDGKDVPWDGESIGELWLKGPWLAREYYNDEKHTREAFVDGWFRTFDLVKIDALGYIEFCDREKDVIKSGGEWISSVAVEKYLLSHPDVKEAAVVGLPHPLWQERPVAFVTLWEQAKVTEEELLSYLRSKLLSFWVPDRILFLRELPRNSVGKVAKKLLREKYHDLLLKNPNEREKV

SEQ ID NO: 19049 - protein, 988 aa, Oryza sativa (japonica cultivar-group)
MQMLLHANSLLLLAPTTSRLSASASPGRSGTARPLPPPQGTRIPPAPPLAGHGGRPPSPQPRRGRDGVGEECAAAVASQGFVTDARAYWVTRSLIAWNVNDQDTSLFLYASRDATMHVSDGAIHGYDSKIELEPEHASLPDNVAEKFPFIRSYRTFRVPSSVDVASLVKCQLAVASYDAHGRHQDVTGLQLPGVLDDMFAYTGPLGAVFSDKDVDLYLWAPTAQDVRVCFYDGPAGPLLQTVQLKELNGVWSVTVPRYPENQYYLYEVKVYHPSTSQVEKCLADDPYARGLSANGTRTWLVDINSETLKPASWDELSDEEPNLESFSDISIYELHIRDFSAHDSTVDCNSRGGFVHLHFRLFRLNLLNDFCSPPITKHPGRIMETVMQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLTVDDLLNWAINYKVDGFRFDLMGHIMKSTMIRAKSAIRSLTRDVHGVYGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPLKNHILSAFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 19050 - protein, 792 aa, Xanthomonas oryzae pv. oryzae KACC10331
MKFSENWLRSHVPIQATRDELAATLTAIGLEVEEVIPLGESLGQVVVARIVEAMRHPEADRLQVCSVDAGQGELLQIVCGAPNARPGLVAPLALVGAKIGELTITAAKLRGVASNGMLCSAKELGLDSDAAGLFELPDDAPVGQALAEYLGLPDASIEIKLTPNRADCFSVRGIAFDVAAACASEVVAFDAGAVAPVSTRTLAVELDAGKDAPRYCGRVIEGIDPAAKTPVWLAERLRRSGVRPVSLLVDITQYVMLELGQPMHAFDLDTLHGPIGVRRSCAGEQLALLDGRQVTLDDSFLTIADAGRPVALAGLMGGLDTRVTETTRNVFLESAYFDPAAIMGRGRKLGLHTDAGHRFERGVDPALPPQAIEVATRLVLELAGGTPGPVVHAQLPQHLPQPARILLRRARIARVLGIQIDDVDVVRMLRALGMQLDAVAEGWEVMAPSRRFDIAIEEDLIEDLARIHGYDRVPTTLPGGASRIAMPSETQLDELSVRRQLVARELQETINYAFVDAALLERWQLTNGLVPLANPLSAELAIMRPCLLPGLVATLGRNAARQAGRVRLFELGKVFAAAADAGAAPQESQHVAAAVCGDALALQWGEAARKVDFHDVKGDLMALAAASGAQLEFQPSTQPFGHPGRSADIYRDGVCIGWIGQVHPRLAKALDIDVDVIAFELQLGPLVQRTLPCAGELSRFPSVRRDLAFLVPDEVSWAAVSASVRTTVGPLLREVQLFDRYVGQGVAPGFKSLAMGLILQDNSRTLTDRDVDAVVTDVVAVIEREHRARIRS

SEQ ID NO: 19051 - protein, 877 aa, Frankia sp. CcI3
MTASVSPPSPSRHSHSPPMSGSTAKNVRRTRGDHNPLRPDLQASLVVFVVALPLSLGIAVASGAPVAAGLLAAVIGGVVAGALGGAPLQVSGPAAGLTVIVADLVHTYGWRVTCLITAGAGILQILLGLCRVARASLAVSPAIVHGMLGGIGLTIVLGQFHVVLGGQAESHAWENVAAVPEAIIDPHGFATLVGFVTIATILLWPRLPKRLPNAVRAIPAYLAAVVTGTLLAAVAGFDLPRVDLPSSLFDAVALPGLPHGDWSGIALGVVTVAIVASVESLLSAVAVDQLATTRGWRGPRVDLDRELLGQGSANLVSGLAGGLPITGVIVRSSTNVASGGRTRKSAVLHGVWVLLFAVFLGRMVEWVPLSALAGLLVVVGARLVNVAHLRHVRRHGELPVYLVTIVGVVALDLLQGVALGLLTALALVLRRVLWSSVRLVRTGELWQVEVEGTLSFLSLPRLARILGRIPAGAPVSIELIVDYLDHAAYEHLRGWCANHEASGGTVSVDEIGQVWFRRPAEVAEQRRRTVVPHLPRWFAPWSQWQELELASSSSDSPSSDSPSSDSPSSGSRSSDSQPAGVTPPAIHPVQGPDPAASVPAQASPDRTFDHVSTMLFGVNEFHRRAAPLLRGTFDALAGGQQPGALFLTCADSRIVPNIITSSGPGDLFTIRNVGNIVPVDDPAGSDPDAPLRRSGDLSVTAALDYAVDVLRVPSLVVCGHSGCGAMQALLSGTLDGAPDSALAGWLSHAAASLERTPPAGTEDLPPVERLGRANVAQQLENLRAHPAVRRALARGTLELVGLYFDIADARIWVLEESTGRFVDPMDALPTAVIGTGSRRRWDAPVRVPAPMVAVGAGPADEQPPPAGRRARWLGLPR

SEQ ID NO: 19052 - protein, 406 aa, Bacillus subtilis subsp. subtilis str. 168
MALNKPKIVILGAGYGGLMTVTRLTKYVGPNDADITLVNKHNYHYETTWMHEASAGTLHHDRCRYQIKDVINQSRVNFVQDTVKAIKIDEKKVVLANGELQYDYLVIGLGAVPETFGIKGLKEYAFPIANINTSRLLREHIELQFATYNTEAEKRPDRLTIVVGGAGFTGIEFLGELAARVPELCKEYDVDRSLVRIICVEAAPTVLPGFDPELVDYAVHYLEENGVEFKIGTAVQECTPEGVRVGKKDEEPEQIKSQTVVWAAGVRGHPIVEEAGFENMRGRVKVNPDLRAPGHDNVFILGDSSLFMNEDTERPYPPTAQIAMQQGITVAKNLGRLIKGGELEEFKPDIKGTVASLGEHNAVGVVYGRKLKGTPASFMKKVIDNRSLFMIGGLGLTLKKGKFKFF

SEQ ID NO: 19053 - protein, 531 aa, Citrus unshiu
MDSCCVGLRANTHVVKASKYGSKIGDNALWGERIRGSVRNDGCTKQLKKSLKAEKRDEKVKPGVAYAIMTSKHPNEVMTLAPPRLERRRVDPKNVAAIILGGGAGTKLFPLTLRAATPAVPVSGCYRLIDIPINSGINKIFVLTQFNSASLNRHIARTYFGNGTNFGDGFVEVLAATQTPGESGKNWFQGTADAVTRFTWVFEDAKNRNIENVAILCGDHLSILCGDHLYRMDYMDFIQSHVDRDADITISCAAVGESRASDYGLVKIDNMGRIAQFAEKPSGANLKAMQVDTSLLGFSPQEARKSPYVASMGVYVFKKDVLLKLLRWRYPTSNDFGSEIIPAAIMEHDVQAYIFRDYWEDIGTIKSFYEANMALTKESPAFHFYDPKTPFYTSPRFLPPTKIDNCRMKDAIISHGCFLRECTVEHSIVGERSRIDYGVELKDTVMLGADYYQTESEIASLLAEGKVPIGVGRNTKIRNCIIDKNVKIGKDVVIVNKDGVQEADRPELGFYIRSGITIIMEKATIEDGMVI

SEQ ID NO: 19054 - protein, 416 aa, Thermotoga maritima MSB8
MPEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRNELERLSRRFFSEIQVIIGPYNDIPAPDVNTNADVMAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 19055 - protein, 78 aa, Mycoplasma genitalium G37
MGGTVIGSSRFKQFQDPSLRKQAVLNLKKRGINNLVVIGGDGSYMGAKALSELGLNCFCLPGTIDNDVNSSEFTIGFW

SEQ ID NO: 19056 - protein, 247 aa, Leptospira interrogans serovar Lai str. 56601
MNDLFNVKNKTVLVTGSTRGIGRYFAEGFKNAGAIVYGTGSSQESIKKFDGSGIKGFAADIRQPDVMTPIIESIVKEHGRLDVLVNNAGIASNKPAAFLKEDEIESIIQTNFTGVFRACTAYYKIHKKKGGNIINIASILGMRGTKLASVYSGTKGAVINMTRALAVEWIGSGYRVNAICPGFIDTDMTEMIKEKPDVLEQMTNAIPMGRLGKPEDLVGAAIFFASDASSYVTGQTIVVDGGITAGL

SEQ ID NO: 19057 - protein, 865 aa, Mycobacterium sp. MCS
MGSNMAEAHPVGFQWVVEAKARGTDVVHIDPRFTRTSALADRYVSLRAGSDIALLGGVINYILSNELDFREYVTAYTNASFIVDERFSDAEDLDGLFSGYDDATASYDPSTWQYQTTDPEEGGAEAKEQSSGDRSGSGGPPVEGGAGDIPRDPTLQDPRCVYQILKRHYARYTPEMVERVCGVPAEQFLEVARKWAENSGRERTAALVYSVGWTQHTMGAQFIRAGAIIQLLLGNIGRPGGGVFALRGHASIQGSTDVPTLFNLLPGYLAMPHAGQETLADYLDDIKSRNQKGFWFNADAYMVSLLKEYWGEHARADNDFCFDYLPRISGDHGTYRTVMDMVDGKVFGYFLLGQNPAVGSAHGRLQRLGMANLDWLVVRDLVEIESATFWKSGPEVETGEITPQTCRTEVFLFPAASHVEKAGTFTQTQRMLQWREKAVEPPGDARSELWFFYHLGRILREKLAGSTDERNRPLLELSWDYVMDGDEPSGEDVLRRISGVDLTTGRAVDDYMSLRADGTTMSGCWIYSGVYADEVNQAARRKPHDQQGPYENEWGWTWPMNRRVLYNRASADPQGRPWSERKKLVWWDTEKQEWTGYDVPDFEKHKPPDYRPAPGAVGVEALHGDDPFIMQADGKAWLFAPNGLADGPLPTHYEPHESPVRNPLYAQQGNPARKVYGRADNPSNPSPPELHGEVFPYVFTAARLTEHHTAGGMSRQLPYLAELQPGLFVEVSPQLAAERGLTHMEWAHVITSRAAVDARVFVTDRMRPLRIDDHVVHQIWMPYHWGNAGLIDGDVVNDLLGVVADPNVFIQESKVATCDIQPGRRPRGPALLEYIAMYRDRARITVDTGTDLDTTKRSTEHTEET

SEQ ID NO: 19058 - protein, 1002 aa, Carboxydothermus hydrogenoformans Z-2901
  misc_feature (196)..(196): Xaa can be any naturally occurring amino acid
  unsure (1)..(1002): unsure at all Xaa locations
MAITRREFLKLSALSTAILMTAELGLDNSKAYAQAQKYRIKTAKKTPTLCPFCSAGCGMLAYTDTKTGELLYVVGDPDHPVNRGGACSKGASIYQIRNIAPGKPNPKRLTKPLYRAPGSKEFKEVTWEWAISEIAKRIKDTRDRTFIKEEDGITVMRTDHIACLGGAALDNEETYLLQKLMRGLGVVYIEHQARLXHSSTVAGLAPTFGRGAMTNHWIDLKNTDCALIIGANPFENHPVSAKWLMEAKLKRGAKIISVDPRFTRTSSKADIYAPLRAGTDIAFIGGMINYILENELYDHDYVANYTNASFIVHDDYKFTDGLFSGYDPRERKYDFSTWEYKKNEKGEIEKDPTLKHPRTVFQLLKQHFSRYTIDKVCEITGTPREIYLEVIKTFAETSQKGKSGTIMYAMGGTQHSCGSQIVRSYAILQLLLGNVGVPGGGVNALRGESNVQGSTDFGLLSNNITGYINSPIAQPEHKDLKAYLESETPKTGFWSNKPKFFISYLKAMYYDKATKENEFGYQWFPKRHPKKNYTYIGLFENLAKGEIEGMLLFGQNPIVGGPNSNREREALKNLKWMVAVDLFMTETMRFWTKEAGSNPEEVQTEVFVLPAAASFEKQGSITSSGRWIQWRWKAVEPLGESKADLDIIHMLALELKKLYASSQRPEDEPIKNLYWNYGNTNECDIDRVAREINGIDLTTGKQVENFLKLADDGSTLCGNWIFSGFYPEAGNLAQRRELEDPSGLGLYPNWTYAWPLNRRILYNRASADPSGKPWHPDKAVIWWDESQKKWVGYDVPDFKATIGPDDPAFVNPFIMQTDGKGWLFVPQGKLKDGPFPEHYEPWESPVQNLLSSVQNNPVIKIWRPEEQSDAQNYPYIATTYRVSEHWQAGAMTRNLPWQAELVPEMFVEIGEELARELGVKSGDEVIVENKRGSIKVKAYVTKRMKPLMVNGIKRHQVGLPWHFGFEGLVTGEIANKLTPYLGDANTMIPEYKGFLVNVRRAK

SEQ ID NO: 19059 - protein, 312 aa, Sulfitobacter sp. EE-36
MTLKLSEPLMPPLPEILAQLNADMRATDDWGDVAAYIPQLASVDPAQFGIAITTADGEVFTAGDADTPFSVQSITKVFTLAIALGRSGDQLWKRVGREPSGRAFNSIVQLEAEQGRPRNPFINAGAIVTTDEVLTGREPRETLAEILQFVRAAASDDDIHINETVAASETAHGHRNFALAHFLASCGNLNNPPEKTLGTYFHHCAIDMSARQLAMAGRFLIETDKLPRMILPPRIRRLNALMLTCGHYDGSGDFAYRVGLPAKSGVGGGILAIVPGRASIAVWSPGLNRYGNSKKGTQAMARLAREMGWSIF

SEQ ID NO: 19060 - protein, 113 aa, Oryza sativa (indica cultivar-group)
MGCAGSTPKVDENSKKLKKPKPWKHTQAITPTQLSKMREEFWDTAPHYGGQKEIWDALRAAAEAELPLAQTIVNSAGIIVSNSDMTLCYDERGAKYELPKYVLSEPTNLIREP

SEQ ID NO: 19061 - protein, 146 aa, Triticum aestivum
  misc_feature (76)..(76): Xaa can be any naturally occurring amino acid
  misc_feature (111)..(112): Xaa can be any naturally occurring amino acid
  unsure (1)..(146): unsure at all Xaa locations
MAPAVMASSATTVAPFQGLKSTAGLPVSCRSGSTGLSSVSNGGRIRCMQVWPIEGIKKFETLSYLPPLSTEALLKXVDYLIRSKWVPCLRVQQGLASSSVEQKQAPPGNYXXRYWDNVGKLPMFPGCNRPQQQGASNGRQKKLPNA

SEQ ID NO: 19062 - protein, 487 aa, Burkholderia vietnamiensis G4
MTIKHWIDGREVASRDTFTTLNPATGDVIADVASGGDAEVDAAVRAAKAAFPKWANTPARERAKLMCRLAELIEKHVPMLAALETQDTGLPIAQTSKQLIPRAAENFNFFAQVCVQMNGRTYPVDDQMLNYTLYQPVGVCALVSPWNVPFMTATWKTAPCLALGNTAVLKMSELSPLTADQLGRLALEAGIPPGVLNVVHGYGATAGDALVRHSDVRAVSFTGGTVTGKRIMERAGLKKYSMELGGKSPVLIFDDADFDRALDASLFTIFSINGERCTAGSRIFVQRTIYDRFVQAFAQRANRLVVGDPADPATQLGAMITRQHWEKVTGYIRLGEQEGARVVAGGAQAPAGLAAHLRNGNFVRPTVFADVDNRMRIAQEEIFGPVACLIPFDDEDDGLRLANETSYGLASYLWTQDVGKVHRLARGIEAGMVFVNSQNVRDLRQPFGGVKESGTGREGGEYSFEVFAEIKNVCISMGSHHIPRWGV

SEQ ID NO: 19063 - protein, 201 aa, Griffithsia japonica
GTRGSNKVSGVNATEVVKPEGGVESSRESRRQQRWLRKGMQQVKARHELVTGSMLQERRKAVFCRRSGIHGFGLYAQEEIEAREFVIEYVGVVIRQSVADVREREYEEGGVGDSYLFRLNGEMVVDATRRGGIARFINHSCDPNLTATTQRVGGTERIVFYSRRHIGKYDELTYDYKFALEGDDKKIRCLCKSLNCRKFLN

SEQ ID NO: 19064 - protein, 377 aa, Mycobacterium leprae
MAANVSSGAQFGYLQLWVVVVANVLAGLVQYLSAKLGLVTGQSLPQAISKQMSHPFRLGFWLQAELVAMATDVAEIVGGAIAFHILFRVSLLLGGVITGTVSLLLLMVKDRRGQLLFERVITGLLFVIVVGFTSSFFVATPSPEDMVNGLLPRFQGTESVLLAAAIIGATVMPHAVYLHSGLALDRHGHPHAGRSRRRLLRVTRLDVILAMTIAGIVNTAMLLVAAINLQHHQVTAYIEGTYTAIQDTLGATIAMLFAIGLLASSLASASVGAYAGALIMQGLLQRSIPMLIRRLITLCPAIAILALGFDPTRALVLSQIVLSFGIPFAVLPLVKLTNNRGLMGNDTNHPATTVLGWAVAILVSLLNVVLIYLTVTS

SEQ ID NO: 19065 - protein, 951 aa, Burkholderia pseudomallei K96243
MTVDTLAQPIAPSTPGAVRETRSTCCYCGVGCGVVIETRRDANGRDTIVGVRGDPDHPANFGRLCSKGSTLHLTATPERYAQTRATHPELRASRDAARTRVSWDDALDHVAQRLARTVERHGPDSVGFYISGQLLTEDYYVFNKLAKGLVGTNNIDSNSRLCMSSAVVGYKKTLGADAPPCSYEDLDHALTVLIAGANPAYAHPILYRRLEAARARNPQMKVIVADPRRTDSASDATLHLALQPGTDTMLFNAMLHVLIWDGALDSAFIAAHTHGFDALRDAVRDATPAAAAQVCGLRADDIVQAARWFGAGPSLSLYCQGLNQSSSGTAKNVALINLHLATGQIGKPGAGPFSLTGQPNAMGGREVGGMATLASAHRDLANPAERAEIARLWGVPDLPAKPGLTAVEMFERLAEGALKAIWIVCTNPAHSIPSQALARAGLERAEFVVLQDAYAHTGTAPYADVLLPAATWGEKEGTVTNSERRISRVRAATQPYGDARADWRIAADVGRRLEARLAPGRPTLFPYEDAEAIWNEHRATTLGRDCDIGGLSWPLLARDGPQQWPFPAGATQGLARLYTDGRFPSADGRARFVPTPYQPVAEAVDARYRFALTTGRLRDQWHGGSRTGSVAKLFAHAPQPCVELNPGDCARLGLGAHDFVHLTSRRGSALMPARADDAVAPGQAFAPMHWGDEYVSGVAGNRAAMGINALTTPARDPHSQQPELKHAAIKLLKADLPWRWLIAARVPPGELLARQRAARAFFARFPYASCVPFGTDAYAGLAWRAAAYEPAPAELQREIEALFELPAQAADVMSYGDARRGTGRRVRIVDGALVVFSVAGAAGATEDSAAVLRDYVDTGASVGALGRLLLFAGRVPLQTAPARGRTICNCVGVSEREIGAVLAADAPSAAPVERLANLQERLKCGTQCGSCIPELRRLIAETATAAAPPPR

SEQ ID NO: 19066 - protein, 814 aa, Burkholderia pseudomallei K96243
MRKMKLVMVGNGMAGVRTLEELFKLAPDLYDVTVFGAEPHPNYNRILLSPVLAGEQTLEQIVLNDYAWYASHGVTLHVGKKIVKIDRMKRVVIADDGTEAAYDRLLLATGSNPFMLPVPGAQLDGVLGYRDIADTQAMIDAAARHTHAVVIGGGLLGLEAANGLKLRGMDVTVVHLAPTLLERQLDAKAGGLLRASLEARGLTFLMPKQTQALVGDEHGRVRAVHFKDGGECKADLVVMAVGIRPNTALAESAGLYCNRGIVVNDTMQTYDPRIYAVGECVSHRGIAYGLVAPLFEQAKVAANHLAQFGIGRYTGSVTSTKLKVTGIDLFSAGDFLGGDDTEDITLSDPIAGVYKKLVIKDDRIVGACLYGDTADGAWYFKLLREGRNIADIRETLMFGETSLGDTGHSGATRAMTMADDAEVCGCNGVCKGTIVSAIKEKGLFTLDDVRKHTKASASCGSCTGLVEQILMSTLGGDYSASPKAKPVCGCTDHTHAEVRAAIREHKLLSVPEAMRFLEWRTPNGCSSCRPALNYYCISTWPHDAKDDPQSRFINERAHANIQKDGTYSVVPRMWGGVTSADELRRIADVVDKYAIPTVKVTGGQRIDLLGVKKEDLPGVWRDLGMPSGHAYAKALRTVKTCVGSEWCRFGTQDSTLMGQQLERALWRMYAPHKVKLAVSGCPRNCAESGIKDVGVIGVDSGWEIYVGGNGGIKTEVAQFFCKVKTHEEVLEYAGAFLQLYREEGWYLERTVHYLERVGLDHVKARVLDDAENRRALWDRLQFALKDEPDPWHDTQDAKVDLRQFIPIAVAPADA

SEQ ID NO: 19067 - protein, 130 aa, Methanococcoides burtonii DSM 6242
MVLLDPLADALSIIKNAEAVGKDSCTIRPASKLIGNVLKVMNDRGYIGDFEFVEDGKAGVYTVELIGRINKCGAIKPRYSVGVTEFERWEKQFLPAKNFGVLILTTPKGVISQYEARENNVGGQLLSFVY

SEQ ID NO: 19068 - protein, 539 aa, Arabidopsis thaliana
MAYASRIINHSKKLKDVSTLLRRENAATIRYYSNTNRAPLNREDTFNSRLGYPPLERISICSTSTLPVSIIFSTTRSNLSSAMGRPIFGKEFSCLMQSARGFSSGSDLPPHQEIGMPSLSPTMTEGNIARWLKKEGDKVAPGEVLCEVETDKATVEMECMEEGYLAKIVKAEGSKEIQVGEVIAITVEDEEDIGKFKDYTPSSTADAAPTKAEPTPAPPKEEKVKQPSSPPEPKASKPSTPPTGDRVFASPLARKLAEDNNVPLSDIEGTGPEGRIVKADIDEYLASSGKGATAKPSKSTDSKAPALDYVDIPHSQIRKVTASRLAFSKQTIPHYYLTVDTCVDKLMALRSQLNSFKEASGGKRISVNDLVVKAAALALRKVPQCNSSWTDDYIRQFKNVNINVAVQTENGLYVPVVKDADRKGLSTIGEEVRLLAQKAKESSLKPEDYEGGTFTVSNLGGPFGIKQFCAVVNPPQAAILAVGSAEKRVVPGNGPDQFNFASYMPVTLSCDHRVVDGAIGAEWLKAFKGYIENPKSMLL

SEQ ID NO: 19069 - protein, 297 aa, Candida albicans SC5314
MAQELTHPAIKDGWFAEISDTMWPGQAMSLKVEKVLHVEKSKYQDVLVFKSTTYGNVLVLDNCIQVTERDEFSYQEMITHLALNSHPNPKKALVIGGGDGGVLREILKHESIEEAWLCDIDETVIEVSKKYLPNMAKSYDDPRTRVHIGDGFKFLEEYKNQFDVIITDSSDPEGPAESLFQKPYFQLLKDALTEKGVITTQAENMWIHMDIISKLKKDCNEIFPVAEYAYTMIPTYPSGSIGFMVCSKDPNANVSKPIRFDWSDEFVAKNLKYYNKKIHEAAFVLPTWADQVLNKKD

SEQ ID NO: 19070 - protein, 137 aa, Streptomyces avermitilis MA-4680
MSQRTLVLLKPDAVRRGLTGEIISRIERKAGWAITALELRTLDQDTLEQHYGEHKGKPFYEPLVEFMASGPVVALVVEGERVIEGVRALAGPTDPIAAAPGSIRGDYGVIVRENLIHASDSEESAERELKIFFPGRV

SEQ ID NO: 19071 - protein, 680 aa, Nocardioides sp. JS614
MTQTHCPYCSLQCGMRLEGGRRLEVRPWPEFPVNEGALCRKGWTAAGLRGHRERLTTPLIRDRATGELRAAGWDEALDLVASRLCGLRDEHGPDSVAVFGGGGLTNEKAYQLGKLARVALGTSQVDYNGRWCMSSAASAGNRALGIDRGLPFPLADVEHTDVLVLVGSNLAETMPPAARHLDRLRENGGRVVVVDPRRTPTAERADLFLQPVPGTDLPLALGLLHLLDAAGAVAEEYVAARTTGWEEVRRSLAGWWPERVERVAGVQASQLRECADLLAGAERVMVLTARGAEQHAQGTDTVLAWIDLALALGMPGKQYAGYGCLTGQGNGQGGREHGQKADQLPGYRMIDDPLARDHVAEVWGVSTDSLPGPGRSAYELLDSLGTGGGPRALLVVGSNIVVSAPNATHVASRLAALDLLVVADLVLSETAAQADVVLPVAQWAEETGTMTNLEGRVILRERAVAPPEGVRTDLEVIAGLAERLGSPVPFAVDPEEVFAELGRASSGGRADYSGIGYDRIRDEHGVFWPCPSPDHPGTPRLFAESFPTADGRARFVAVEHRGPAEPTDPSYPIHLTTGRVLAQYQSGAQTRRVRELPDEGPFVEMHPMLAARIGAHDGQQVVVTTRRGELRVPARVTATIRPDTVFVPFHWVGANRLTHDALDPASRMPEFKVCAAAVRA

SEQ ID NO: 19072 - protein, 174 aa, Oryza sativa (japonica cultivar-group)
MAAVVTNRRVILKRYVTGLPSEDDMEVVTAKTTLAVPAGSEAVMVKNLYVSCDPYMRGRMTRHEVPSYVPDYVPGEVITNCGVMKVVSSGHPDFKDGDLVWGVTGWEEYTLVNNPKPYLHKINYPEFPLSYYTGVLGIAGLTAYGGFFEVSKPKKGDYVFVSAASGAVGQAAQN

SEQ ID NO: 19073 - protein, 320 aa, Oryza sativa (japonica cultivar-group)
MALVAVSNKRVILKRYLTACEIGQLGDEMEVVTAEAVPLSVPAGSSAVLVKNLYISCDPYLRNRMIRHEVPTYISDFVPGEVVTSHGVMKVISSGHLDFKAGDLVWGMTGWEEYTLINNPESLFKINYPEFPLSNYTGVLACGAIGQIVGQLAKIKGCYVVGSAGSDDKVNLLKTKFGFDDAFNYKKETDLEAALKRCFPEGIDIDFENVGGAMLDAVLPNMRLGGRITMCGMISQYHLERPEGVRNLMYIITKRLRMEGFVIFDSIAVYRQFEEEMAGYLREGKVTYLEDIVQGLDAAPAALIGIYNGLNVGKQLVAIA

SEQ ID NO: 19074 - protein, 471 aa, Mycobacterium smegmatis str. MC2 155
MSTDTQDSADARAKTPGQLTGAVVIVALVSAVSGMLYGYDTGIISGALLQITKDFSIAEAWKQVIAASILLGAVIGALVCSHLSQKRGRKGTLLMLAVVFVIGSLWCAISPNPVLLSVGRLVLGFAVGGATQTAPMYVAELSPPKYRGRLVLCFQIAIGVGIVIATIVGASEHIPWRWSIGAAAVPAAIMLVLLLRLPESPRWLIKDGDPDKAREVLERVRPDGYDIDGELDEMTTLVRKEQTAKTRGWPGLRAAWVRPALILGCGIAIFTQLSGIEMIIYYSPTILTDNGFSESVALQVSVALGVSYLVAQLVGLSIIDKVGRRRLTLIMIPGAAVSLFVLGTLFATGHSGRDSVPFIVACLVVFMLFNAGGLQLMGWLTGSETYPLAVRPAGTAAQSAALWGTNLLITLTLLTLISGIGVGPAMWLYGLFNVAAWLFVYFRMPDLTGRSLEEIEGKLRDGKFRPADFAR

SEQ ID NO: 19075 - protein, 347 aa, Pediococcus pentosaceus ATCC 25745
MKAAVFIEPGKVEVKEVPKPQIDGDNQAIIRIVRASVCGSDLWWYRGISERQTDTFIGHEAIGVVEETSADVDNIQVGDFVVVPFTHGCGHCVACLNGFEGDCLNRKSGDNGGYQAEYMKYEPANSGLVKIPGKPEDYTDAQLASFQTLSDVMATGYHAAQNAEVKPGSTVAVIGDGAVGLCGVIGAKLLGASKIILLSHHEDRAELGKAFGATDIVDTRGDEAIQDVLKLTKENAGADAILECVGATSAIEQAGQIARPGAVIGRVGVPQSEPKSNQLFWKNVGLRGGIASVTKPDKEVLLQAVLDGEINPGQVFTKSFDLDHIEDAYEAMSNRQAIKALLVISDK

SEQ ID NO: 19076 - protein, 491 aa, Pseudomonas syringae pv. tomato str. DC3000
MTTQPLNSHRVDPHTAQKFYIDGHWSAPLSPVSIAVVNPATEEVVAHVASGSAADVDRAVAAARAAFAGWSGTSPEVRAQVIGRIHELIIERKEELAQAISLEMGAAISSARAMQVPLAAEHVRVARDLLATYRFQTVEGGTAIEREPIGVCALITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFANAVPPGVMAAFRNVGQSCSAPTRMIVPRNRLAEVEALAAQTAGTIVVGDPQLEHTVLGPIANEAQFHRVQAMINAGICEGAKLVCGGPGRVQGHEQGFYTRPTVFSEVDSSMRIAREEIFGPVLCLIAYDTIDEAVAIANDTVYGLGAHVQGQDLELARSVASRIRAGQVHLNYPSWNPMAPFGGYKRSGNGREYGVHGFEEYLETKAIVGFAPADLM

SEQ ID NO: 19077 - protein, 651 aa, Thermus thermophilus HB27
MKETRDLETLSVNAIRFLAIDAVEKARSGHPGMPMGMAPLAYLLFREVMRHNPLDPDWPDRDRFVLSAGHGSMLLYAVLHLTGYDLPLEELKSFRQWGSKTPGHPERGHTPGVEVTTGPLGQGISTAVGLALAERKLAAEFNRPGHVVVDHYTYVLASDGDLMEGVSGEAASLAGHWGLSKLIVFWDDNRISIDGPTDLAFTEDVLARYRAYGWQTLRVEDVNDLEALRKAIKLAKLDERPTLIAVRSHIGFGSPKQDSAKAHGEPLGPEAVEATRRNLGWPYPPFVVPEEVYRHMDMREKGRAWQEAWEKALEAYARAYPDLYQELMRRLRGELPPLPEEPPSFDKPIATRAASGRALNLLAPRLPELLGGSADLTPSNNTKAEGMEDFSRANPLGRYLHFGVREHAMGAILNGLNLHGGYRAYGGTFLVFSDYMRPAIRLAALMGVPTVFVFTHDSIALGEDGPTHQPVEHLMSLRAMPNLFVIRPADAYETFYAWLVALRRKEGPTALVLTRQAVPLLSLEKARGLLRGGYVLEDVEEPQGVLVATGSEVHLALRAQALLREKGVRVRVVSLPSFELFAAQPEAYRKEVLPPRLPVVAVEAGASLGWERYAHKVVALDRFGASAPYPEVYERLGFTPERVAEAFLSLV

SEQ ID NO: 19078 - protein, 197 aa, Thermotoga maritima MSB8
MMTLYPVVVQERTTGEVLMLAYANEEALELTKKTGYAHFFSRERQKIWKKGETSGNTMRVVEIRRDCDDDAYLYIVDFPEDKVACHTGNRSCFFKVEHRFEETGSPTFWLELYRLVRKRKEEMPEGSYTVKLFKEGKGKIAKKFGEEAVEVITGYLQNDRENLVWEIADMMYHLTVLMADAGVTVQDVMRELEKRRK

SEQ ID NO: 19079 - protein, 316 aa, Salmonella enterica subsp. enterica serovar Typhi str. CT18
MNQLDGIKQFTTVVADSGDIESIRHYQPQDATTNPSLLLKAAGLEQYGHLIEDAIAWGKKHGGTQEQQVAAASDKLAVNFGAEILKSIPGRVSTEVDARLSFDKEKSIEKARHLVDLYQQQDVDKSRILIKLAATWEGIRAAEQLEKEGINCNLTLLFSFAQARACAEAGVYLISPFVGRIYDWYQARSPLEPYVVEEDPGVKSVRNIYDYFKQHRYETIVMGASFRRTEQILALTGCDRLTISPNLLKELKEKEEPVIRKLVPSSQMFHRPTPMTEAEFRWEHNQDAMAVEKLSEGIRLFAVDQRKLEDLLAAKL

SEQ ID NO: 19080 - protein, 666 aa, Salmonella enterica subsp. enterica serovar Typhi str. CT18
MSRKDLANAIRALSMDAVQKANSGHPGAPMGMADIAEVLWNDFLKHNPTDPTWYDRDRFILSNSHASMLLYSLLHLTGYDLPLEELKNFRQLHSKTPGHPEIGYTPGVETTTGPLGQGLANAVGLAIAERTLGAQFNRPDHEIVDHYTYVFMGDGCLMEGISHEVCSLAGTLGLGKLIGFYDHNGISIDGETEGWFTDDTAKRFEAYHWHVVHDIDGHAPEAVKKAILEAQSVKDKPSLIICRTVIGFGSPNKAGKEESHGAALGEEEVALTRQKLGWHHPAFEIPKEIYRAWDGREKGEKAQQQWQEKFAAYEKAYPELAAEFTRRMSGGLPEAWESATQKFINDLQANPAKIATRKASQNTLNAYGPLLPELLGGSADLAPSNLTIWKGLTSLKEDPAGNYIHYGVREFGMTAIANGIAHHGGFVPYTATFLMFVEYARNAARMAALMKARQIMVYTHDSIGLGEDGPTHQAMEQLASLRLTPNFSTWRPCDQVEAAVGWKLAIERQHGPTALILSRQNLAQVERTPEQVKAIARGGYILKDSGGKPDIILIATGSEMEITLQAAEKLTGEGHNVRVVSLPSTDIFDAQDEAYRESVLPAHVTARVAVEAGIADYWYKYVGLKGAIIGMTGYGESAPADKLFPYFGFTVENIVEKARRVLNIKG

SEQ ID NO: 19081 - protein, 503 aa, Ustilago maydis 521
MQALRALQRSGLQKAVAAASSSSSTLSHRSFHSSRRALEFSKFNMPAMSPTMTEGGIAAWKKQPGEAFSAGDVLLEIETDKATMDVEAQDDGVLAKILVGDGAKAVQVNSLIAIMAEEGDDLSGADAFAAKASSEGGEAKPAAKEEPKEEPKEEPKEESKPKDEPKQQESTPSSSSSSSSSSSFGSQSSGDRIFATPVARRLAQDKGIALNKIKGTGPEGRIIKADVENYKPEAAVAAPAASSAAPAKSAGAPAPAPAASEGGDYTDIPVSNMRRTIAARLTESKSSIPHYYVSIDVEMDKVLKLREVFNKAAAEKAGKDVEKAKAAKLSVGDFITKAAGVALKEVPEVNSAWYGDFIRQHNKADISIAVSTPTGLITPIVKDVGGSGLATISAATKSLAAKARAGKLAPQEYQGGSFTISNMGMFGITHFTAIINPPQSCILAIGGTEARLVPDAESEQGFRKAMIMQATISADHRTVDGATAAKWMKAFKDALENPLSFML

SEQ ID NO: 19082 - protein, 195 aa, Thermotoga maritima MSB8
MTVERLENGVIVQRNTNEIEISITLDTVHGKLEGSTGVNFFDHLLNTFCHYSGLGLRVSTCESKDGILHHLIEDFGISLGLAFRELFDYTKVRRFGEATVPMNEALVGCYVDLSGRPFFQKNFEFSVEKIEDMPVEGFEEFMCGFVNHARITVHFFKFFGKNDHHISESAMKSFGLAIAKALESSEKKTTKGVID

SEQ ID NO: 19083 - protein, 450 aa, Oryza sativa (japonica cultivar-group)
MASYDDGTNLVDDEYDDLDDFIVDNDDDVVLGEEQQDEFEEEEEEQEEEEEEEEPPVGQVEILTLREQLKADIRRKNQAQQGATAGRASCSSSVQPLAKDRFGSFFGPSRPSLARRVIEEGCSSIIKEKQNVPSNKSSVSSASKKQPIPSGQQQKPKFVKEEKRKVDALRQNRDYSCLFSDDADTPQATKEQPDNMPVLPMKYDVGDIASTSKLISQTDKVSKDSGLKGPSIQSRVGLVGKEPHPNTKRTIASSAKNGSSLPAMKKIQRVQPSSNGQKMQQTLQSKRPQAMLSQSHGQQSLQSRKPKPSLNGQNFRQKVSAPLAQKHLAPSSRPKPSSAVHNDHGKGKTRRLVKRKSKEDGCDEEEVDYKSIIRGMFNYNPAKFVGRDEDDRDMEANYASIQMEERRSARLARQEDDEELRRIMDEERREKQERKRKKLAQKAVVDASQD

SEQ ID NO: 19084 - protein, 800 aa, Arabidopsis thaliana
MKCFYFSKDKTQDDEAKTRKFGSATMARGGSGSEFNSDTSTATSITSSLHVLSETHSNNLKVFVLDDLKTATKNFSRSLMIGEGGFGGVFRGVIQNPQDSRKKIDIAGHKEWVTEVNVLGVVEHPNLVKLIGYCAEDDERGIQRLLVYEYVQNRSVQDHLSNRFIVTPLPWSTRLKIAQDTARGLAYLHQGMEFQIIFRDFKSSNILLDENWNAKLSDFGLARMGPSDGITHVSTAVVGTIGYAAPEYIQTGHLTAKSDVWSYGIFLYELITGRRPFDRNRPRNEQNILEWIRPHLSDIKKFKMIIDPRLEGNYYLKSALKLAAVANRCLMVKAKARPTMSQVSEMLERIVETSSDGAPSGLPLMKSLTPKDAFEASRRERVKRRFVELLIGENGCPNLPTWSHKLGFPISSTMLSIRRHAKTVASSCTNLTQKRTYVDVYMKWKRDPYFDNIEHILRSSQLKSVVSLKNCIVQEPNRCIPISAISKKTRQFDVSTKIAHFLRKFPSIFEEFVGPEYNLPWFRLTPEATELDRQERVVYQTSADDLRDRLKKLILMSKDNVLPLSIVQGMKWYLGLPDDYLQFPDMNLDSSFRFVDMEDGVKGLAVDYNGGDKVLSVLQKNAMKKRRGEVSLEEIEFPLFPSKGCRLRVKIEDWLMEFQKLPYVSPYDDYSCLDPSSDIAEKRVVGFLHELLCLFVEHSAERKKLLCLKKHFGLPQKVHKAFERHPQIFYLSMKNKTCTAILREPYRDKASVETHPVLGVRKKYIQLMKNSELILKSRRNSFGFRDEGVVDKDLDLDFEG

SEQ ID NO: 19085 - protein, 259 aa, Bordetella pertussis Tohama I
MISLPYLQRFALSGQVALVTGSARGLGLRIAQALAGSGAHVLINGRDAHAVEAAVSDLRQQGLRASAQPFDVSDEQAMEQAFARIDAEHGRLDILVNNVGARNRKPLAETSPAEIRAMMDTNLIAGILLARLAAQRMMRQRYGRLIAITSVAGELARANDAVYPAAKQGLTGMMRALAVEFGGHGITSNAIAPGAFATETNAAIANDPQAGAAMAARNPTGRWGDPEEIAGAAVFLASPAASYVNGHVLVVDGGLSVQF

SEQ ID NO: 19086 - protein, 477 aa, Bordetella pertussis Tohama I
MKQHFIDNASVPGSSGERIPVIDPSTGQEFDSIARGNAADIDLAVQAARRAYEGAWGRLSAAERGRLMLALSLKVLEHRDELTALESRDCGKPLKQARADVIAIARYFEYYGGAADKLHGETIPYQQGYTVLTLREPHGVTGHVVPWNYPLQIFGRSVGAALAAGNACVVKPAEDACLSLLRVAELAAETGFPAGALNIVTGYGHEAGDALTRHPGIDHISFTGSPRVGVLVTQTAAERHVPVTLELGGKSPQIVFADADLDALVPVAVNAIVQNAGQTCSAGSRLLVERGAYERVLERLGAAFAALRAGPAQSDLDCGPLIRKTQQERVRGFLDLARGDGIATVAQGRIVPEAPAEGYYQAPTLLRDVPVDHPLAQEEVFGPVLAAIPFDDEADAVRIANATEYGLAASVWTRDGGRQLRIARKVRSGQVFINNYGAGGGIELPFGGVKASGHGREKGFEALYGFTVLKTISIKHD

SEQ ID NO: 19087 - protein, 467 aa, Oryza sativa (japonica cultivar-group)
MYGGGAAAGGATTTTGSHGGGGGDWWSAAVSSCSAPAPETMQGFGGWSAAVVAVDGGGNTSRSAAGNTASSESPGSLATGSSITFQEPAGGVADPAAIAVHAQTVAGGGGGGWNQQPFLDGSGFHGYMSSSRNDHHTNHHHHQINTPSLMSNSSSNNGVMLQEHQHDQNYQFLSNLGFELLSSPTSPYGGGGGFRSSLLRSLTEPAAAAKPNDSPGFQQYHHHQPAMNLQPPAAAAGREPLQFTNSTAAPFWNPSSRFTVAAEGTALGGAGASPAQPTPASLAAKRALEGVGDSSSIITKKAKADSTPLKKSRTGTPSPLPTTFKACVYIYIIFNLSQMVIDFLPIKFHVRKEKLGDRVTALQQLVSPFGKTDTASVLHETIEYIKFLHDQVGALSAPYLKNRQQVPHLKNSTGVDNDGGGGGGEATAASKRDLTGRGLCLVPISSTFAVASETPVDFWTPFGAAFR

SEQ ID NO: 19088 - protein, 322 aa, Leptospira interrogans serovar Lai str. 56601
MDPIFEKIEKAIDTEIESILYFRKNLDPSIKQAIELILECKGKLIVTGVGKSGDVGKKISSTLSSTGTPSVFLHPADAAHGDAGIISCEDIIIAIGKSGESEELLNLIPTIKNIGAKLVSMTANVDSKLAKESDVVLITPVLKEACPLELAPTSSTTIALILGDAIAMCLMELKNFKRENFALYHPAGRLGKRLSLKIDDVMRKDKDLAKVLPDTKLENILTEITVKRQGATGVIDLNGTLLGIITDFDIRKKLKEGKLDSSISAEQLMNPSPTMFLSGSNAYDVLKQMESRPNPISVAPIVDNSKRLIGIVSIHDLLQKGL

SEQ ID NO: 19089 - protein, 504 aa, Arabidopsis thaliana
MAHYINIYGKRLFDIGLYLKTSVDLILQQQHVLMSQQKFTDISLCHREAPNPKLDLPDDNRLSPLTELEDIGQQSKTLGTAIHRKISEQKRVIESGSVASIVEHKRTNLSAIMATRANIPEQVRGAPLVDGLKIQNKNGAVKNRRALGDIGNLVSVPGVQGGKAQPPINRPITLSFRAQLLANAQLERKPINGDNKVPALGPKSQPLAARNPEAQRAVQKKNLVVKQQTKPVEVIETKRNAQSKAACGIVNKPKILDIDESDKDNHVAAVEYVDDMYSFYKEVEKESQPKMYMHIQTEMNEKMRAILIDWLLEVHIKFELNLETLYLTVNIIDRFLYVKAVPKRELQVNDLVYVTDNAYSSRQILVMKKAILGNLEWYLTIPTQYVFLFCFIKASISDPEVLHVQKKNLQASKTKSFSIQVLSFSSHKSIVKSDQFCKKFNLCQEVTAPASEFHLGNCEAWRETVTKLKDPETKGSLVSRDFSSCKELLIKGFKMKECLAAKKI

SEQ ID NO: 19090 - protein, 106 aa, Xanthomonas oryzae pv. oryzae KACC10331
MLVMERIQAEVEQHPIVLFMKGTPQFPMCEFSSRAVQALVAAGADQLRTINVLEEPEVRANLPRYSNWPTFPQLFIHGELIGGCDITLELFEVGELKRIVSEAYQP

SEQ ID NO: 19091 - protein, 245 aa, Spiroplasma citri
MRKPIIIGNWKMHKTINETIDFLKQVDHVCHDLKLDAGIAIPFVNLAVAKQHAHNLIIAAQNCHYEDFGAFTGEISVEMLENLKITHVIIGHSERREMFNETNETVNLKAKKILATGMVPIICCGETLQQYENNETQQIVETQIEKALQGIDFEDAKTIVIAYEPIWAIGTGKTATAEIAQNVCAIIRTKIASLYDEVVANVIRIQYGGSVKPENIQELLAQPDIDGALVGGASLEPKTFLGLVK

SEQ ID NO: 19092 - protein, 277 aa, Zea mays
  misc_feature (87)..(87): Xaa can be any naturally occurring amino acid
  misc_feature (103)..(103): Xaa can be any naturally occurring amino acid
  misc_feature (158)..(158): Xaa can be any naturally occurring amino acid
  unsure (1)..(277): unsure at all Xaa locations
MTAEMEKPTRLSTNVKAILPLKHFGPATGSDTDKVSKKQELMQKINMVRKQPGQNIVKLICEGRYKMVALLRSIEAKGGRVWMFLRXRGSMSVSVRQGVKQVXDVGMSTAYVHVLGFIDIDLESCNNLRSGHKALTIVDFGVARIEIKTEGMTPETGXTYRWMAPEMIQHRPYDQKVDVYSFGIVLWELITGMLPFANMTAVQAAFAVVNKGVRPAIPQDCLPTLAEIMTRCWDPNPDVRPPFTEVVRMLEHAEVEILSTVRKARFRCCISQPMTTD

SEQ ID NO: 19093 - protein, 415 aa, Kluyveromyces lactis
MKVGELLESSGAGGSRSIIAYTNDKNAGFETEMDSILPSDDLKQGSLHSKNSHGNDVKIVPDEDEVITRRTVVKGHSNPRSQLLFHAVTPEIVGNGSFGVVFRTKVKETGRMLSLRRFYRIRRFKNRELEIMKLISHPNLIDLKYYFLEQSDQELYLNLIVDYMPMSLYQRLKEFISLHQPMDRYEIKIYMFQLFKSLNYLHQVVNVCHRDIKPQNILVDPDTLLLKICDLGSAKQLKPNEPNVSYICSRYYRAPELIFGATNYTTKIDIWSAGCVMAELLLGQPIFPGESKIDQLVEIIKVLGTPTREEICSMNENYSEHKFPQIRPIPLNRIFKKETQETIDLLYHIMKYDPNIRYSALQCMFNSTYFTDIVSNTGSDSNLSLIDSLPLLHFEESELQGLSSNDIYRLTGKLI

SEQ ID NO: 19094 - protein, 585 aa, Emericella nidulans
MARSRQPTRFSSEAPSESSSSTSPERAADDDTDFFTLQANDSQSSIGAGNPRDSHIQNDPETVLPPIAYLPPEILISIFSKLSSPRDLLSCLLVCRIWALNCVGLLWHRPSCNNWDNLKKIAAAVGEEDSFFLYSSLIKRLNLSALTEDVSDGTVVPFSQCNRIERLTLTNCRKLTDIGVSDLVVGSRHLQALDVSELRSLTDHTLFKVAENCNRLQGLNITGCVKVTDDSLIAVSQNCRLLKRLKLNGVSQVTDKAILSFAQNCPSILEIDLQECKLVTNQSVTALMTTLQNLRELRLAHCTEIDDSAFLDLPRHIQMTSLRILDLTACENIRDEAVERIVSSAPRLRNLVLAKCKFITDRAVWAICKLGKNLHYVHLGHCSNINDSAVIQLVKSCNRIRYIDLACCSRLTDRSVQQLATLPKLRRIGLVKCQLITDASILALARPAQDHSVPCSSLERVHLSYCVNLTMVGIHALLNSCPRLTHLSLTGVAAFLREELTVFCREAPPEFTRQQREVFCVFSGEGVNRLRNHLNREAAPQRDANEATMYDDEEELDEDEGQVTGLMHAAAINDDDYINITPPHA

SEQ ID NO: 19095 - protein, 175 aa, Triticum aestivum
  misc_feature (148)..(148): Xaa can be any naturally occurring amino acid
  unsure (1)..(175): unsure at all Xaa locations
MAAPLRRVFPSLGRALLSPTPARMLSAEASDALVEIKPGEIGMVSGIPEEHLRRKVLIYSPARTASQQGSGKVGRWKINFVSTQKWENPLMGWTSTGDPYANVGEAGLTFDSAESAKAFAEKHGWEYVVRKRHTPLLNQSSPNTYAEXNFKWKWPPRRRRKQPKLWICMLSGDFH

SEQ ID NO: 19096 - protein, 449 aa, Bacillus subtilis subsp. subtilis str. 168
MKKRSFKVFTLSLQHVLAMYAGAILVPLLVGRALNVTTEQLSYLLAIDLLTCGVATLLQTLRGTYIGIGLPVMLGSSFVAVTPMIAIGSNYGIHAIYGSIIAAGVFIFLFARFFGKLTVLFPPVVTGTVVTLIGLSLVPTGVKNMAGGEKINGSANPEYGSLENLLLSVGVLVLILVLNRFLKGFARTLSVLIGIAAGTAAAAIMGKVSFSSVTEAPFFQIPKPFYFGAPAFEIGPILTMLIVGIVIIVESTGVFYAIGKICGRPLTDKDLVKGYRAEGIAILIGGLFNAFPYNTFAQNAGLLQLTKVKTRNIVVTAGCILVCLGLIPKIAALASAVPAAVLGGATVVMFGMVIASGVKMLSTADLKNQYHLLTIACSIALGIGASTAPGIFAEFPAPIRILVSDGTITGSLTAIFLNLFFSLRDKKELTAQQTELPVLEHTLALEKEV

SEQ ID NO: 19097 - protein, 430 aa, Bacillus subtilis subsp. subtilis str. 168
MKEQHNALQLMMLGLQHMLAMYAGAILVPLIVGAAIGLNAGQLTYLIAIDLFMCGAATLLQLWRNRYFGIGLPVVLGCTFTAVGPMISIGSTYGVPAIYGAIIAAGLIVVLAAGFFGKLVRFFPPVVTGSVVMIIGISLIPTAMNNLAGGEGSKEFGSLDNVLLGFGVTAFILLLFYFFKGFIRSIAILLGLIAGTAAAYFMGKVDFSEVLEASWLHVPSLFYFGPPTFELPAVVTMLLVAIVSLVESTGVYFALADITNRRLSEKDLEKGYRAEGLAILLGGLFNAFPYTAFSQNVGIVQLSKMKSVNVIAITGIILVAIGLVPKAAALTTVIPTPVLGGAMIVMFGMVISYGIKMLSSVDLDSQGNLLIIASSVSLGLGATTVPALFSSLSGAASVLAGSGIVIGSLTAIALHAFFQTKQPNSADIKT

SEQ ID NO: 19098 - protein, 494 aa, Bacillus subtilis subsp. subtilis str. 168
MFTMDDLNQMDTQTLTDTLGSIFEHSSWIAERSAALRPFSSLSDLHRKMTGIVKAADRETQLDLIKKHPRLGTKKTMSDDSVREQQNAGLGKLEQQEYEEFLMLNEHYYDRFGFPFILAVKGKTKQDIHQALLARLESERETEFQQALIEIYRIARFRLADIITEKGETQMKRTMSYGKGNVFAYRTYLKPLTGVKQIPESSFAGRDNTVVGVDVTCEIGGEAFLPSFTDGDNTLVVATDSMKNFIQRHLASYEGTTTEGFLHYVAHRFLDTYSHMDTITLTGEDIPFEAMPAYEEKELSTSRLVFRRSRNERSRSVLKAERSGNTITITEQYSEIMDLQLVKVSGNSFVGFIRDEYTTLPEDGNRPLFVYLNISWQYENTNDSYASDPARYVAAEQVRDLASTVFHELETPSIQNLIYHIGCRILARFPQLTDVSFQSQNHTWDTVVEEIPGSKGKVYTEPRPPYGFQHFTVTREDAEKEKQKAAEKCRSLKA

SEQ ID NO: 19099 - protein, 880 aa, Cochliobolus carbonum
MSAAIDNEDLEELSISMPSQRRGAAQTSTTKAQDPAPPPPTALGTAVHETKSKDTKASQRLGQYTIVRTLGEGSFGKVKLATHQVSGQKVALKIINRKRLVTRDMAGRIEREIQYLQLLRHPHIIKLYTVITTPTEIIMVLEYAGGELFDYIVNHGKLQEAQARKFFQQIVCAVEYCHRHKIVHRDLKPENLLLDHDSNVKIADFGLSNIMTDGNFLKTSCGSPNYAAPEVISGKLYAGPEVDVWSCGVILYVLLVGRLPFDDEYIPTLFKKIAAGQYSTPSYLSPGATSLIRKMLMVNPVHRITIPELRQDPWFTTDLPAYLEPPAQEFFDSGADPNKAIDPKALAPLADAPRVQALHENVVTKLGKTMGYAKHDVQDALARDEPSAIKDAYLIVRENEMMRENPLLTNQDGVPVWNHQSPPAHDSYMEKFRPQSLNAVSRPQFIPPAPSDHERARQGSNASSQLASIRSPVSTIAILPSSLTEYHKAYMKGHPRPTNKISESEALPPTPEQTEEQRQISARRLKPNFRTMPEAGRTKPEPMTSLPTKKPRATKWQFGIRSRNQPAEAMLAIFKALKAMGADWEVPKIRRAGGRSGSRSRSTSQAPEDRKSKSRNHSQDSISSHSSDEDQGSRKGSPRREPLSVRNNGTSEQEARGRQKKHYNHTNDWGYHVPEDPWVIHARFLKEGMFPPGVAHPSSTHSSRVDLANDSSGARRRSSTNTSTSSAGHGVEGMTPSERAGSVSEDHVNPDEAVYIYMSIQLYSIDRDFFVVDFKCAGYERLVTNLVREIKASIPLSGSHQPPPHHQDGWDDEQGVWRRLDENEPLPEDLAKKLNEGGTEILRERTELVGAGRQEGEKIVTSPFPFLDVASTLILQLSGE

SEQ ID NO: 19100 - protein, 1425 aa, Oryza sativa (japonica cultivar-group)
MSRGLSGPRVWPVVGSLPGLVQHAENMHEWIAANLRRAGGTYQTCIFAVPGVARRGGLVTVTCDPRNLEHVLKSRFDNYPKGPFWHAVFRDLLGDGIFNSDGETWVAQRKTAALEFTTRTLRTAMSRWVSRSIHHRLLPILDDAAAGKAHVDLQDLLLRLTFDNICGLAFGKDPETLAKGLPENAFASAFDRATEATLNRFIFPEYLWRCKKWLGLGMETTLASSVAHVDQYLAAVIKARKLELAGNGKCDTVAMHDDLLSRFMRKGSYSDESLQHVALNFILAGRDTSSVALSWFFWLVSTHPAVERKVVHELCAVLAASRGAHDPALWLAAPFTFEELDSLVYLKAALSETLRLYPSVPEDSKHVVADDYLPDGTFVPAGSSVTYSIYSAGRMKTVWGEDCLEFRPERWLSADGSKFEPHDSYKFVAFNAGPRICLGKDLAYLQMKNIAGSVLLRHRLAVAQGHRVEQKMSLTLFMKNGLRMEMNPKGKRSSNCYFYLQLPETKDTCVISKFQCVISSVKSCPTCFIFNMPPWWGKSSSKEVKKTAKENLIDTFHRLLSPNEQKGRTKSRGNRRHSKDPTAEKGCWSTAQSRSASPSKEVSRCQSFAAARAHAQPLPLPRSRAMVARTASDITESKVVLEKRGKGQQLPLPTTNWVKERPETTEPVAELSTASISSHGSIDSDDPGDLRLQGPVANDTDNVAKVATTGNSSVVHKECSSAITRKGTKEVTMPTNAFLSNQILSTSPRGTVVADSYQSNLQNSRKVVLDSAPNSVMSSPSRSPRILCPDQIPSSAFWAVKPHTDVTFVGSAQCSSPGSGQTSGHNSVGGDMLAQLFWQPSRGSPECSPIPSPRMTSPGPSSRVHSGSVSPLHPRAGGMAPESPTRRLDEGKRKQTHRLPLPPLSICNNSTFLPNNSTPTSPISHSPGRVENPTSPGSRWKKGKLVGRGTFGHVYIGFNSDKGEMCAMKEVTLFSDDPKSKESAKQLCQEILLLNRLQHPNIVRYYGSEMVDDKLYIYLEYVSGGSIHKLLQEYGQFGEPAIRSYTKQILLGLAYLHAKNTVHRDIKGANILVDPNGRVKLADFGMAKHINGQQCAFSFKGSPYWMAPEVIKNSNGCNLAVDIWSLGCTVLEMATSKPPWSQYEGIAAVFKIGNSKELPPIPDHLSEEGRDFIRQCLQRNPSSRPTAVDLLQHSFIRNASPLEKSLSDPLLQLSTTSCKPDLKVVGHARNMSSLGLEGQSIYQRRAAKFSSVHSDIHVRSYISCPVSPCGSPHLRSRSPQHQNGIMSPSPISSPRTTSGASTPLTGGNGAIPFNHARHLAYNNEGFTITSRCLDEPLPNQPPDPVLGRFVRVKQPSLGFQERAVPEADILSPQFGRMGHVSVWNLHDKPLPSEHASQKGFEDRVKLKPPLDLRSGPPHLGCNHGH

SEQ ID NO: 19101 - protein, 287 aa, Debaryomyces hansenii CBS767
MSAIYKALQSKSSKETSEKAKHINRQRLLVISSRGVTYRHRHLISDLVALLPHARKEPKFDSKKNLYQLNEVAELYNCNNIFFFESRKHQDLYLWISKPPNGPTLKFHIQNLHTLDELNFTGNCLKGSRPILSFDKSFEVTDHHKLLKELFTHTFGVPPNARKSKPFVDHVMTFSIVDNKIWIRNYQINETVDSKDASELNPEELSLVEIGPRFVLTLITILEGSFGGPKIYENKEYVSPNFVRAQLKQQAADQAKSRASAALEKKLKRRDQVLKKDPLANDSLFKE

SEQ ID NO: 19102 - protein, 169 aa, Bordetella pertussis Tohama I
MRPMTEIIKPWHSVRRSRLHGNGVFATRKIPAGTRIIEYGGKRISAEEADRRHPTNPDDPFHTFFFSLSSGRVIDGGDEGNDARWINHSCDPNCEAQEGRHGKRVYIVALRDIARGEELFYDYGLVLDGRITRKLKEGYRCLCGTTPCRGTMLALPEKKKTKARSAEKA

SEQ ID NO: 19103 - protein, 139 aa, Oryza sativa (japonica cultivar-group)
MAVMHSSFTWKHWIGLAVTSAAYFLPYKQLANMSEPEYSENGELINAGYDLNAGGMSEYLQDVIYITLFVQLMSIFSDKFWWTYLVIPAYGGYKISGLLRGAFFGGSSEGEEEDEKTRKKREKMEKKASRGKIIKTRTR

SEQ ID NO: 19104 - protein, 327 aa, Burkholderia pseudomallei K96243
MIAKINDDRALALARDVLDIEANAVRALAEQLDGEFVAAVGLLLNCRGRVVVSGIGKSGHIARKIAATLASTGTPAFFVHPAEASHGDLGMVTKDDVFVAISNSGESEELVAILPLIKRLGAKLIAMTGRPASSLATLSDVHLNAGVAKEACPLNLAPTASTTAALALGDALAVAVLDARGFGSDDFARSHPGGALGRRLLTYVRDVMRTGDEVPAVPLDATLSDALFQITAKRMGMTAVIDDANRVAGIFTDGDLRRVLERDGDFRRLPIVDVMTRHPRTIAPDHLAVEAVELMERHRINQMLVVDERGALIGALNMHDLFSKKVI

SEQ ID NO: 19105 - protein, 349 aa, Triticum aestivum
  misc_feature (106)..(106): Xaa can be any naturally occurring amino acid
  misc_feature (254)..(254): Xaa can be any naturally occurring amino acid
  unsure (1)..(349): unsure at all Xaa locations
SKEVSDFAAKYMYHNPLHLDTYKEVSKMEAEILRMTASLVSKNPAYGVITSGGSESLIMSLYAYRKYFNKAKPNIVVPNTIHAAIDKGAMYLNIEVRKARLNERFXVDVAHMKSLIDHNTIALYASYPNFPHGIIDPIADIAPIAKKHKIGFHVDGCLGGFVAAFLKEHEGKFSLDIDGVTSISLDNHKFGLAPKGVAVLLFKEKKLRASMYFIYTEWVGGIYATPSFPGSRSGFASAGAWYALTHVGRKQYLXNSMRVVEATKKAAKELAKIEGVRVLGNPELCVLAFQTDIVDCFSVSSFLTKEKGWKISAIHLPKGLHISVTLANCNNVGQNLAKDVKEAIEKVKL

SEQ ID NO: 19106 - protein, 187 aa, Burkholderia pseudomallei K96243
MMSTSDAPLDPVEFIHSRIRTVPDWPQPGVMFRDITPLLQSAKALRVLVDLFVERYVDAKLDYIAGLDARGFIIAPIVAYELSVGFVPIRKVGKLPYATQRESYALEYGTATVEIHEDACKPGDRVVIVDDLIATGGTMMAGKNLLERLGAVVVEGAAIVDLPDLGGSALLRGAGLPLYTVTEFPGH

SEQ ID NO: 19107 - protein, 792 aa, Nocardioides sp. JS614
MTGIVPAVVEVSGGNLVLVIVVALIALGALAMAAMFRQEVLAAGEGTDNMKNIAQAVQEGANAYLQRQFRTLAIFAVVAFFLLLALPADDAMVRIFRSVFFLVGAGFSATVGYLGMSLAVKANLRVAAAAQTQGRDPAMNIGFRTGATVGMLTVGLGLLGASVVVILFQEDAPHVLEGFGFGAALLAMFMRVGGGIFTKAADVGADLVGKVENNIPEDDPRNAATIADNVGDNVGDCAGMAADLFESYAVTLVAALILGSQAFGDKGLVFPLLIPAIGALTAVVGVYLCKPRAGENGLTTINRAFYISAAIGAVASIILALVYLPGDFADLTNSTVDADASPRVVAALAVLIGIVLAAAILGLTGYFTGTDHRPVKDVGKTSLTGAATVILSGLSVGFESAVYTTLVIGAAVFGAFLVGAGSIPVALFAVALAGCGLLTTVGVIVAMDTFGPVSDNAQGIAEMSGDVDEHGAQILTELDAVGNTTKAITKGIAIATAVLAASALFGSYTNALQDAIDEVTLTEEPGALTSLAFSFNASYPNILVGMLLGAAVVFLFSGLAINAVGRAAGAVVYEVRRQFREIPGIMEGTGRPEYGRVVDIVTRDSLRELATPGLLAILAPIAVGFGLGVGPLAGFLAGAIATGTLMAVFLANSGGAWDNAKKLVEDGNHGGKGSDAHAATVIGDTVGDPFKDTAGPAINPLLKVMNLVSLLIVAAIVKLSIGEDANTPLRIVIALAAFAGIVAAVYVSKRRPVHIEGDDDGTTAPPPPPPPVEAVPPTEPAPTQQFEAPQQH

SEQ ID NO: 19108 - protein, 332 aa, Carboxydothermus hydrogenoformans Z-2901
MAHRVTLIPGDGIGPEIVEAARRVIDASGANIEWEVVEAGEKVMAEYGTPLPEYVLESIKKNKVALKGPMTTPIGTGFRSVNVALRKALDLYANVRPAKSLPGVVTRYENIDLITVRENTEDLYAGVEHMVGDDAAESIKIITRKASQRIVRFAFELARKEGRKKVTAVHKANIMKYTDGLFLAVAREVAAEYPDIEFEDMIVDAMAMKLVQTPEKFDVMVMPNLYGDILSDLCAGLVGGLGVAPGANIGDEYAVFEPVHGSAPKHAGQNRVNPLAEILSGVMMLKHLGEMDAAAKIERALTKVLPNKDMVTYDLGGTAKTSEMADYIIKHL

SEQ ID NO: 19109 - protein, 869 aa, Sulfitobacter sp. EE-36
MGKAITPCHTTAKAYAAQEPKGAAVQKTAMTTLVTQTAPIANDTHGGRAKCLQRLVRLDLPVPRTVALPFDVVLEIAQGQIPDLQAVADEFPQDALLCVRPSSQDPDWGGPGAVMNIGMNDDRYADYCERMGEGPASALYTRFVQSYAVNVARLDPDMFDDVEGDGREALLQSLRAYELETEESFPQDRVTQLTAVLSSMARAWEGTSARLLRQAKGAPADAGLGLIVQQMVFGVGTGICGSGVLQLVDSTTGLPQITGRYLSQSQGRDALQDTADALYLTRDPRGPSLEEHAPEAFEMLKQHAALMRVRLRAEMQVEFVISDGELFILDGVRVSRSSRAAVRIAVALADEGIIPREEALMRVQPRTLTELLHRQVDPRVKRDVIGRGIAASPGAATGRIVFNANDAQASAARGEKCILVRRETSPEDIRGMHAAQAVLTERGGITSHAAVIGRGMGLPCVVGASSMRFDLVKGVITAPDGRMFKAGDEITLDGTSGEVLCGAADMLEPLLDATFQKLMSWAEDAADIGIRANADTPADAQTARNFDAQGIGLCRTEHMFFDPSRLTVMREMIFADTSEGRRAVLERLLPMQRDDFIQLFRIMQGQPVCIRLFDPPLHEFLPSTRTGQRDLAEALDLPLSNVTRRIEAMTEYNPMLGLRGVRLGVTVPEIYEMQARAIFEATIEASRDGDPVVPEIMIPLVSAKREVELIKASVDKIATAVKSERGASFTYRLGVMVETPRAALRAGEISPHCSFLSFGTNDLTQMTYGLSRDDAGRFMSTYVQQGVFPEDPFHMLDRDGVGELLQLGAARGREAQPGITLSICGEHGGNPESIAFCRAAGFDYVSCSPFRVPVARLAAAQLAIADKIG

SEQ ID NO: 19110 - protein, 141 aa, Zea mays
  misc_feature (14)..(14): Xaa can be any naturally occurring amino acid
  misc_feature (63)..(63): Xaa can be any naturally occurring amino acid
  misc_feature (78)..(78): Xaa can be any naturally occurring amino acid
  misc_feature (98)..(98): Xaa can be any naturally occurring amino acid
  misc_feature (101)..(101): Xaa can be any naturally occurring amino acid
  unsure (1)..(141): unsure at all Xaa locations
GNTLNANTHSCNNXSTRVKNNRPTSKTLPAAGTPAELTRPSLSGPYQHIKLGSPPTPGAKTTXLVLYGPACQDPHLLXKHRELATPDDVAALVAHDAXAYXNSIASTYNLQSRPPENWLEQDGSTVKINHHENLAHYNEVL

SEQ ID NO: 19111 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGECKVFYYKMKGDYHRYLAEFSSGDAREKATNSSLEAYKTASEIATTELPPTHPIRLFLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 19112 - protein, 161 aa, Triticum aestivum
MPVPLAPYPTPPVPFTPPAPNAGAQSQLVCSGCRNLLMYPAGATSVCCAVCSTVTAVPAPGTEMAQLVCGGCHTLLMYIRGATSVQCSCCHTVNLAMEANQVAHVNCGSCRMLLMYQYGARSVKCAVCSFVTSVGVSIHFRAVNPSTRQEHSLFFWIFHII

SEQ ID NO: 19113 - protein, 596 aa, Cryptococcus neoformans var. neoformans JEC21
MSQPDLSQYSLSEEVPLPPAQEIRPGDTYQIDSEEYDSDQERDNLSDGEYDKLVEEAENGYTDEEMDQYTRQLKENGIVNFLRSYLTLTEDGEMRSLRKLLLGFGLVPPLSLRSPEIPDIQLLPFAKVALSRILRRRERLRDISSLDDAVSLLAKSKKIIVLSGAGISTSCGIPDFRSSTGLYAQLQEEGKYELDDPQQMFDIRYFREKPEVFYSFAKQIYPSNFVPSPCHRWIKMLEDRGVLLRNYTQNIDTLESLAGVERVLQCHGSFKTASCLRCKQRVPGRTIEPYIMSQQIPYCGTCREICAAEREARRAYREKLKKLKARTKGKGKADEWDDGDDDDDDESADEWGGGEPGIIKPDITFFGQALDSEFDECLFKDREEVDLLVVIGTSLKVAPVSEVLTHIPHSVPQIFINLTPVYHVQPDVSLLGDADSIVTYLSSRLGWPIPPPTVLPTPPSAVGEGKSEDTAPAGQKDEIKVERATHVVIPPEEAQWLTVDEERHFHLLRRKGDPAIQAETTVVPPVVPSSPKPEHSPQPRPQYTDDSAKQPSSPPPVPMHVGEAEEGYVSDEEDEADEPPRKRSKVVDSLLGNASW

SEQ ID NO: 19114 - protein, 610 aa, Zea mays
MILRPSLLAVARPLSTVAVAAAVRRGDLAGAEEAFASTQLKTTTTYNCLLAGYAKASGLVRLADARRLFDSIPHPDTVSYNTLLSCHFACGDIDGARRVFSTMPVKDVTSWNTMVSGLSKNGASEEAAAMFRVMPVRNAVSWNAMVAALACSGDMGAAEDLFRNAPEKTDAILWTAMVSGYMDTGNVQKAMEFFGAMPVRNLVSWNAVVAGYVKNSRADDALRVFKTMVEDAIVQPNASTLSSVLLGCSNLSALGFGRQVHQWCMKLPLSRNVTVGTSLLSMYCKCGDLNDACKVFDEMSTKDIVAWNAMISGYAQHGGGMQAIKLFEKMKDEGVVPDWITLLAVLTACIHTGLCDFGIQCFETMQEAYNIEPQIDHYSCMVDLLCRAGLLERAVNMIHSMPFEPHPSAYGTLLTACRVYKNLEFAEFAARKLIEQDPQNAGAYVQLANIYAVANKWADVSRVRRWMKDNAVVKTPGYSWMEIKGVRHEFRSNDRLHPQLGLIHDKLDRLQMLMKAMGYVPDLDFALHDVEDSLKSQMLMRHSEKLAIAFGLISTSPGMTLRIFKNLRICGDCHNVAKLISKIEDREIILRDTTRFHHFRGGHCSCGDYW

SEQ ID NO: 19115 - protein, 377 aa, Zea mays
  misc_feature (208)..(208): Xaa can be any naturally occurring amino acid
  unsure (1)..(377): unsure at all Xaa locations
MADEDIQPIVCDNGTGMVKAGFAGDDAPRAVFPSIVGRPRHTGVMVGMGQKDAYVGDEAQAKRGILTLKYPIEHGIVNNWDDMEKIWHHTFYNELRVSPEDHPVLLTEAPLNPKANREKMTQIMFETFECPAMYVAIQAVLSLYASGRTTGIVMDSGDGVSHTVPIYEGYTLPHAILRLDLAGRDLTDHLMKILTERGYSLTTSAERXEIVRDIKEKLAYVALDYEQELETARSSSSVEKSYEMPDGQVITIGSERFRCPEVLFQPSLVGMESPGVHEATYNSIMKCDVDIRKDLYGNVVLSGGSTMFPGIADRMSKEITSLAPSSMKVKVIAPPERKYSVWIGGSILASLSTFQQMWISKGEYDETGPGIVHMKCF

SEQ ID NO: 19116 - protein, 506 aa, Legionella pneumophila str. Lens
MDLLQRLNIKSVNPGAFSGHGWHSDNHAHTLESFNPSTGNKLAEIATCTMDDYEQVMQRAEQAAQAWRKVPAPKRGEIIRQIGQALRENKDSLGSLVSLEMGKSKQEGDGEVQEMIDIADFAVGQSRMLYGNSMHSERPNHRMYEQWHPYGIVGVISAFNFPVAVWSWNAFLSAICGNVTIWKPSAKTPLCAVAVQHICNQVLKENNCPEIFGLIIPNSHDVVEAMVDDKRIQLISFTGSTAVGKQVAAKVAARLGKSILELGGNNGIILDESADLNLAIPAIVFGAVGTAGQRCTTTRRLFVHESKYQDVIKRLRHAYEQITIGDPLDTRNLMGPLIDQQAVEQFKKAINRIKAAGGQIVYGGEILKQAGSFVQPTLVCDVKNDWDIVQEETFAPILYVMSYRTLDEAIALHNGVPQGLSSALFTQNLKNAELFLSACGSDCGIANINIGTSGAEIGGAFGGEKETGGGRESGSDSWKAYMRRQTNTINWGDELPLAQGIRFNLS

SEQ ID NO: 19117 - protein, 574 aa, Arabidopsis thaliana
MAPALAVTRDLTAVGSPENAPAKGRASVYSEVQSSRINNTLPLPSVLKGAFKIVEGPASSAAGNPDEIAKLFPGLYGQPSVAVVPDQDAPSSAPKLKIGVVLSGGQAPGGHNVISGLFGKDYLQERAKGSTFYGFKGGPAGIMKCKYVELNAEYIQPYRNQGGFDMICSGRDKIETPDQVEYFFVFKQAEETAKKLDLDGLVVIGGDDSNTNACLLAENFRSKNLKTRVIGCPKTIDGDLKCKEVPTSFGFDTACKIYSEMIGNVMIDARSTGKYYHFVRLMGRAASHITLECALQTHPNITIIGEEVSAQKQTLKNVTDYMVDVICKRAELGYNYGVILIPEGLIDFIPEVQELIAELNEILANEVVDENGLWKKKLTEQSLKLFDLLPEAIQEQLMLERDPHGNVQVAKIETEKMLIQMVETELEKRKQAGAYKGQFMGQSHFFGYEGRCGLPTNFDATYCYALGYGAGVLLNSGKTGLISSVGNLAAPVEEWTVGGTALTALMDVERRHGKFKPVIKKAMVELEGAPFKKFASLREEWALKNRYISPGPIQFTGPGSDSLSHTLLLELGAQ

SEQ ID NO: 19118 - protein, 518 aa, Oryza sativa (japonica cultivar-group)
MQKNPGARTIEGDPGGGALPGRRPGPRPNAPGPAATTGARAARTDKGVSAAAQVVSGRFYVDPPVFTDRLNAQLAPQIRAFGYVRVTNSFNAKKFCDRRRYVYLLPVFALDPSAHPDREAVMASVGSGSELTKCLECSERGRKVPGVMGREGKVPDPALQEEKSVEASREEAAVGSNEDANCDPASTGDRSVDLPIPDNETNTQITEMRSNGAEKCDVQLSGGTLCSEAVPASNSETVCPILNSDSNTNSDSVDVDPSFVAEKKGSIETVVTEDGKKQAMDVVTEDEKKQDVDYEGSSLEEMPLRSAFSYTHEVKERFNRILKKYVGTHNFHNFTTRTKAEDPAAKRFIISFAADRVVNLDGIDFIRCEVVGQSFMLHQIRKMIGLAVAVMRNCAPESIYDVAFRKDVNLNVPTAPEVGLYLDECMFTSYNKKWKDSHEAVSMEPYSEEAEEFKLKYIFPHIAAMEHKEGAVALWLHSLNSRNYPDFRYMDNAGTEASIAAAVESVDEGTVPSDNISE

SEQ ID NO: 19119 - protein, 230 aa, Oryza sativa (japonica cultivar-group)
MAEAELLLERSRAITLNGRDKRGRALVRIVGKYFPGKLSSASLVRSPQFRCFCRRKSDPVSFVAAARALGGRAEAALRGYVRRRVLPEIGEREFVVVYVHSLVDRGDNFPGVAAIRAAYEALPAAAKERLRAVYFVHPGFQARLFFATLGRFLFSSGLYEKLRYMSRLEYLWEHVSKGEMEVPECARRHDEELERRPLMDYGIEATDRRCMFDAASMDTSASLHSLRCIS

SEQ ID NO: 19120 - protein, 319 aa, Zea mays
  misc_feature (104)..(104): Xaa can be any naturally occurring amino acid
  misc_feature (232)..(232): Xaa can be any naturally occurring amino acid
  unsure (1)..(319): unsure at all Xaa locations
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMXAKARIGHFVEAQILEALGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLGRLPXVVQFAAGGVATPADAALMMQLGCDGVFVGSGIFKSGDPARRARAIVQAVTHYSDPTILADVSTGLGEAMVGINLNDPKVERYAARSE

SEQ ID NO: 19121 - protein, 526 aa, Candida albicans SC5314
MSKHSEDPIKGVKVQKRKVVSIASTSSSTSTHQQLMNQATKMKRTKINEMKKQKQDFFKRINYSHLLTVVVLPLLAVLYVVLCKQSIVPENERTLYFTCIYYNITMLAFTSGYHKYFAHNSFKVKAELLKYYFCIFGSSCGLGSVRWWAGLHRAHHHFTDDTERDPYSIKRGFLFSHYAWLLKKPKLTKFYLDFLEQEFPEHAENQKVQNEIVLDKEIETEYNGEDIMRQNYDESLRNLLMWQQRTYLFWFFVTTILIPALITKYVCGDSIVHGILYPGILRMFLCQQSLLSTESICHLKRIQVTIPTQPFNDKNSSTNCNNPLVSFLTYGQSHQNYHHEFPHDYRVDNSYLTYDPTKWFIWILEQLGAVDELSRTPGNLIVQLKLQQQQLIINRTKSQLNWGTPISKLPLISPSDFKKIISSTLNKDRIYIVIQNIIHDITPFMDQHPGGVALLKASHGKDATKAFYGGVYGHSTAAVNLLATMRIGVLDDGDDEEVWRRVAREEREVSNSTDSRPGHHHTAEAA

SEQ ID NO: 19122 - protein, 397 aa, Zea mays
MDAAAAAAAQMERHSSAAAQMERHSSAAAFVEGGVQDGCDDTCSICLETFSDSDPSAVTSCKHEFHLQCILEWCQRSSQCPMCWQAISMKDPTSQELLEAVEEERNDVQENHARTTTVFRHPLLGDFEVPVDADDAEIEERIMQHLAAAAAIRRSHRHARREGRRSSRAAAAHGHGHPQPQTQVLFFPSAGEATPGGSGSPSPHPRQEHAASSVVSPPPLPAVASAEGTDADSTASVGGAVGPDDSVSRSQSSPVNHDEAGPSADAQSFSDTIKSRLQSVSTKYKDSITKSTRGWKERWFAQSSAMSNLGSEMRREVGAGIAAVSRMIEKQLETRPDGSGTAPSPATASSPAHAHPGSDASSQGQGAAVPATPAAALNNATPAAAAALNDASSSSTA

SEQ ID NO: 19123 - protein, 163 aa, Xanthomonas oryzae pv. oryzae KACC10331
MMNKITHYFKSLLLLELLGGLWLTLKYTFKPKYTVLYPMEKFPQSPRFRGLHALRRYPNGEERCIACKLCEAVCPALAITIDSAKREDGTRRTTRYDIDLFKCIFCGFCEESCPVDSIVETHILEYHFEKRGENIINKPQLLAIGDRLETEIAERRAADAAFR

SEQ ID NO: 19124 - protein, 526 aa, Spiroplasma citri
MSQNKKLFYVTTPIYYPSAQLHIGHAYTTTLADILNRYKKMAGYETFFLTGSDEHGEKIEKKAKTAGITPYQFITMIVDNFKLLWNKLGIEYSKFIRTTDKEHEVGVQKIFSKLYNNGDIYLGEYEGLYCVSCEEFLTEAQIDKITNQCLVCGNKPQKVKEETYFFKVSKYSQFLINYYNNHPGFIEPEARKNEMLNNFILPGLTDLSVTRTTFSWGIKTLENDKHIIYVWIDALSNYLTALGYLSNDDALFNKFWNNPDVEILQLLGKEIARFHTIYWPSMLESLGLRQPNKLLSHGWILFKDTKMSKSIGNVVDPLYLIDKYGRDTLRFYLGYEIPTENDGKFSYEMFLESYNAHLVNNIGNLVSRVSNMISKYFNGQLVKQQQLDNVLIESCVQAVQNYQQAMDAYQISEGLSMILELCNKANKYIEENKPWELEKNKNMEQLHETLASLAYTIIVSAFLLQPVLVDNAQKIADYFNVNLTNLTFKTILMQEIIYNKTIEKKENLFNRVNVEQELKQIETELN

SEQ ID NO: 19125 - protein, 1056 aa, Kineococcus radiotolerans SRS30216
MQRRSPWRWDEDAPWQRQWTPSTGPPRACCSSGRHDSPRAGRRSSGRPRPACCGTCPSPSSSCRGACRDRRARAAGPGVQGARPGADRPARLHRHRHLHHRPRLHPHRRPRPHGLGGGGAPARHLPRRVRAHAARRAGLPRPQQRHARRGHDVHLELARLRALDRVDGRLGPAGRDRPRPLQPRRRRRRLLLPHALPAHRPRIHRRPHHERRRQRHDVPGVHGPGLLDLLPRHGGHQGRPVRPRRLPGRRAAVVRDRRVRPHRRRQRPRRPGRRPAVVQPPRGGVLLRLRRRHLPVRVHLLGLGRRPHHERGDLRGPHHPREGGRGDHRRHRRPLPDDRARRPVLLRHRRHRPRPGQRRHPGEHLRGPRRPGHGTRRRPHVAVGARLLRRVAAVDVHLPDPHHARHGPLRGAPAAVREGQPPVPVAGVRHRRGRRHRLRLLRRHARRVRGRAVGHHLRPRHDDLLLLRHHRARLRLVLPRQLGRGRQDVPVPLPRAPGRGRPAAGVLRADRRRLHRPRVRVGFAALRHRAGVPARGGGPGPGGRRDAVPVPGPPRVLPGRDHRPRPHHVRRARRRSHAVKQFQNVIAGASRDAADGATSEVVNPATGQVYATAPVSSAADVDAAYTAASDAFTSWRRTTPADRQKFLLDLADAVEDRAEEFIAAEVENTGKPVGLTRSEELPPAVDQLRFFAGAARVLEGRAAGEYLAGHTSWVRREPIGVVGQVTPWNYPFMMAIWKIGPALAAGNTIVLKPSDTTPASTVLLAQVANEVLPPGVLNVVCGDRGTGRALVEHPTPQLVAITGSIRAGMQVAGSAAKDVKRVHLELGGKAPVVVFDDADVAAAAEAIAGAGYFNAGQDCTAATRVLVAPRLHDDFVAALSEQARATKVGLPDDDDAALGPVNNVNQLAHVSGFVDRLPDHAVLGAGGSRSAGQLASGFYYEPTVVSGLRQDDEAVQEEIFGPVITVQRFTDEDEAVRWANGTKYGLASSVWTKDFGRAMRVSAALDFGCVWINTHIPLVAEMPHGGFKQSGYGKDLSMYGFEDYTRVKHVMANLDS

SEQ ID NO: 19126 - protein, 394 aa, Sulfitobacter sp. EE-36
MSVDWKPRTKAVHSGTRRSQYNEVSEAVFLTQGFVYDSAEQAEARFQSLGDDEFIYARYGNPTVRMFEDRISGLLGYEDCFACTSGMAAVSGALTSLLKAGDHVVAARALFGSCLYVLEDILARFGVEVTLIDGTDNAAWDAAIRPDTTMVFFESISNPTLEVVDMRHVVKAAHAVGALVLADDAMATPVFSYAKECGADIAIISTTKHVDGQGRMLGGAICGSKELIRGPIEAYMKHTGGAMNPFTAWTHLKALETIDLRVRAQADAAYKIADALNGHPKLSAVRYPTHPSHPQHTLATSHAPSAGTVLAVEVKGGKDACFAFLNALEIITISNNFADAKSIATHPATTTHQRLPDDQKATLGISPGLVRLSAGLEDVDDLIADIRQALDTLK

SEQ ID NO: 19127 - protein, 625 aa, Bradyrhizobium japonicum USDA 110
MCGIFGWVLAAAKHQNRDTLIGLTDLMSHRGPDASGYWLHQTSDERYQIGFGHRRLSIIDIGGGAQPMATEDGRFNLVFNGEIYNYLELRKELVALGHHFRTDSDTEVLIEAYRAWQLDAVRRLRGMFAFALWDDAEQRLVLARDAFGKKPLFLAEAQGAVLFGSEIEPLVQFPGFSRALDSDAIGHYLLNRYVPGPSTFFQSVKKLQPGHCAVWQNGMLKSTRYYTPPFATTVPDVKDFNSAIRLFEGAFDEAVRIRMRSDAPYGAYLSGGIDSSAVVATMVKHSTEPVRTFSVGFRETGYSELDHARVIAGQFGTIHNDLIVEPSAFMDHWSTAALRRGAPVSEASDIPIFMLSEMASRSVKMVLTGEGADELMGGYPKYRAERWIGLYQWLIPHLLHERLIHPLVRSLPYGMRRAKIVALAAGERDLANRMRVWFGGLSVGESEAMLGRLLSATPPDLFPYSSQIGSSLRRTLFFDQTSWLPDNLLERGDRMMMAGSIEGRMPFMDTVLAGVVARFPDDFLTGGKGGKRVLRAAMDKILPSEIIRRKKIGFRVPIGEWFRGPYREFLRDMLVSETSAVAQMVRGDRLRQLVTEHLDARQNHERLLWSFVNLEIFVRAFRVAS

SEQ ID NO: 19128 - protein, 435 aa, Xanthomonas oryzae pv. oryzae KACC10331
MSEFRQATDAFASNPAESKQEIRNYTMNFGPQHPAAHGVLRLILEMDGETVVRADPHIGLLHRGTEKLAESKPFNQSVPYMDRLDYVSMMCNEHAYVRAIESLMGIEAPERAQYIRTMFDEITRIKNHLMWVGSNALDLGAMAVMLYAFREREELMDVYEAVSGARMHAAYYRPGGVYRDLPDRMPRYKESRWHKGGALKKLNAAREGSMLDFLEDFTNTFPLRVDEYETLLTDNRIWKQRTVDVGIISPDLARAWGMTGPMLRGSGIEWDLRKKQPYAKYDAVDFDIPVGTNGDCYDRYLVRVAEMRESNRIIKQCVKWLKANPGPVMVTNFKVAPPSREGMKDDMEALIHHFKLFSEGYCVPAGETYSAVEAPKGEFGCYLMSDGANKPFRVHLRAPGFAHLSSMDAVVRGYLLADVVAMIGTYDLVFGEVDR

SEQ ID NO: 19129 - protein, 202 aa, Arabidopsis thaliana
MASSNTTTGVDNTFRKKFDVEEFKERAREREKKESDRSKSRSKGPPVQRAPLKHRDYHVDLESRLGKTQVVTPVAPLSQQAGYFCRVCDCVVKDSANYLDHINGKKHQRALGMSMRVERSSLEQVQERFEVLKKRKAPGTFTEQDLDERIRKQQEEEEELKRQRREKKKEKKKGKVVEEEPEMDPEVAEMMGFGGFGSSKKS

SEQ ID NO: 19130 - protein, 426 aa, Salmonella enterica subsp. enterica serovar Paratyphi A str.
MIVGGGAGGLEMATQLGHKLGRKKKAKITLVDRNHSHLWKPLLHEVATGSLDEGVDALSYLAHARNHGFQFQLGSVMDIDREAKTITIAELRDEKGELLVPERKIAYDTLVMALGSTSNDFNTPGVKEHCIFLDNPHQARRFHQEMLNLFLKYSANLGANGKVNIAIVGGGATGVELSAELHNAVKQLHSYGYKGLTNDALNVTLVEAGERILPALPPRISSAAHNELTKLGVRVLTQTMVTSADEGGLHTKEGEYIQADLMVWAAGIKAPDFMKEIGGLETNRINQLVVEPTLQTTRDPDIYAIGDCASCARPEGGFVPPRAQAAHQMATCAMNNILAQMNGKPLKAYQYKDHGSLVSLSNFSTVGSLMGNLTRGSMMIEGRIARFLYISLYRMHQIALHGYFKTGLMMLVGSINRVIRPRLKLH

SEQ ID NO: 19131 - protein, 296 aa, Arabidopsis thaliana
MENKTQEEASTINVSSLACIDLANSNLHRSAASLKQAWLFFFLFLNVNDYDCGFFYVTNHGISEELKDEAFEQSKKFFALPLDEKMKVLKNEKHQGYSPVLSQISDNQIHGDYKESFFIGIEGSNDTPFCRANIWPNPGDHGEISSRSIAIARVLALALNVDGDYFDTPEMLGNPLTFMRLLHYEGMSDPSKGIYGCGPHSDFGMMTLLGTDSVMGLQDRDVKPRKWEYILSIKGAYIVNIGDLLERWSNGIFKSTLHRVLGNGQDRYSIAFFLQPSHDCIVECLPTCQSENNPPK

SEQ ID NO: 19132 - protein, 475 aa, Triticum aestivum
  misc_feature (197)..(197): Xaa can be any naturally occurring amino acid
  unsure (1)..(475): unsure at all Xaa locations
MAHDGASHGATTAPLLASTEKPPRNMYAFGCATLASMTTILMGYNLALMSGAQLFIREDLGLTDEQVEVLAGSMNVYMLVSILAAGWAADLLGRRGTLVLANGFLMAGALAMSLGGSYAALMAARFITSIGVGFSLVVAPVYNAEISPASARGVLSSLLDIFVNVGILLSYVSNYALAGLPVHLSWRVMYAIGVLPXVLLAAGVLAMPESPRWLAMRGREDDARAVLVRTSDTAAEAELRFEEIKRVVEAPREADSGVWRELIFRPSAMVRRILVFVVGLNFLQQALGVDAILLYSPLMFKKAGMSSNSAILGATVAIGVVKTCFILVVSLFSDRFGRRPLLLASAGGVAASLTGLALTLCIGETSPASTAACVAFTLATVAAFSVGWGSLPSTYTAEITPLRLRAQGSSLGMAVNRLTCGVVSMSFISLAGWITMPGCFFLYASMAATAYVFVFLRLPETKGRTLEEMDVLFSK

SEQ ID NO: 19133 - protein, 314 aa, Methanopyrus kandleri AV19
MFDPKKFVEEAIEELRREIGDRKAIIAVSGGVDSTTAAVLTHRAIGSHLVCVFVDHGFMRKGEPERIRELLEEELGLNLRFVEAAEEFFEALRGVTDPEEKRKIIGEKFIEVFERIAEEEEAEVLVQGTIAPDIIESERGIKSHHNVGGLPEKLNLDVVEPLRDLYKDEVREVARYLGIPDEIVERMPFPGPGLAVRVLGEVTPEKVEIVREANAIVEEEVEKAVEEGKMSKPWQAFAALLDCKATGVKGDERDYGWVIAVRIVESIDAMIADVPEVPWEVLRNIQDRITSEVPEVTRVLFDITPKPPATIEFE

SEQ ID NO: 19134 - protein, 369 aa, Acinetobacter sp. ADP1
MKSRAAVAFGPGQPLQIVEVDVEPPKAGEVLIKVTHSGVCHTDAFTLSGDDPEGVFPAILGHEGAGIVIEVGEGVTSVQPGDHVIPLYTAECGECLFCKSNKTNLCVSVRATQGKGVMPDGTTRFSYNGEPIYHYMGCSTFSEYTVVAEVSLAKINPEANHEQVCLLGCGVTTGIGAVHNTAKVQEGDSVAVFGLGGIGLAVVQGARQAKAGRIIVVDMNPEKFELAKEFGATDFLNPKDYDKPIQQVIVEMTGWGVDHSFECIGNVNVMRSALECAHRGWGQSVIIGVAGAGQEISTRPFQLVTGRKWLGTAFGGVKGRSQLPKMVEDAMKGDIQLEPFVTHTMPLDEINHAFDLMHEGKSIRSVIHF

SEQ ID NO: 19135 - protein, 584 aa, Candida albicans SC5314
MTTTSSSTNESIRPKNNHTTISTTGVSTTLDQTTTTRFRNNYDDNNNNSVISKDSSTFAYVVNRSKSVLKKYGSFVGPGMLISVAYMDPGNYATGITAGASNEYSLLFIVFLSNVIAIFLQSLCIKLGSVTGYDLARCCREYLPKQLNWVLWFLAECAIIATDVAEVIGSAIALNILLKIPLPAGVVITIIDVLFVLMAYRADTSSMKFVKIFEYAVGALVMVVVVCFAVELSQIHASARDIFRGFVPSKQMFDGNGMTIATSIIGSTVMIHSLFLGSGLVQPRLRDFDVKHGYVNLDDILNKNDQPQFPVIESSTTTPSEKKDDAKNNVKVSMYEKEADYFYHYYKPSYQSIKYSLKYSIVELTITLITLALFVNSAILIVSGSTLYGTEEAIDADLYTIHDLLSRSLAPAVGTIFMVALLASGQSAGIVCTIAGQIVSEGHINWTLKPWLRRLVTRSISIIPCLIISVCIGRNGLGIALNISQVVISILLPPLTAPLIYFTCSKKIMKVELNENDEAIGVTGQEEEVEDEESNDQDTNGSRKKYKYMTNNWITSIVAVIIWFFVSTLNVYAIYEMAKNGVSG

SEQ ID NO: 19136 - protein, 306 aa, Oryza sativa
VPPASAVGFGRGGRGDGGGRSGGGGRGFGRGGDSGGRGGRGRGGGRTPRGRGGGRGGGRGGMKGGSKVVVVPHKHNGVFIAKAKEDALCTKNMVPGESVYGEKRISVQNEDGTKVEYRVWNPFRSKLAAAVLGGVDNIWIAPGTRVLYLGAASGTTVSHVSDIVGPTGLVYAVEFSHRSGRDLVNMAKKRTNVIPIIEDARHPARYRMLVGMVDVIFSDVAQPDQARILALNASYFLKNGGHFVISIKANCIDSTMPAEAVFASEVEKLKADQFKPSEQVTLEPFERDHACVVGGYRMPKKQKGTS

SEQ ID NO: 19137 - protein, 172 aa, Oryza sativa (japonica cultivar-group)
MAAAAAEATTDGGGKMIILISADGKRFEVTEAVASQSQLISNMIEDDCTENGVRLPNVDGDILTMVVDYCNMHAGDAAAAGDTMKASSTEEELKKFDAELVQALENPVLFKLILAANFLNIKSLLDMTCQRVADMMSGKTPEQMRETFSIENDFTPEEEAAIRQENAWAFDD

SEQ ID NO: 19138 - protein, 146 aa, Glycine max
  misc_feature (49)..(49): Xaa can be any naturally occurring amino acid
  misc_feature (65)..(65): Xaa can be any naturally occurring amino acid
  misc_feature (76)..(76): Xaa can be any naturally occurring amino acid
  misc_feature (86)..(86): Xaa can be any naturally occurring amino acid
  misc_feature (110)..(110): Xaa can be any naturally occurring amino acid
  unsure (1)..(146): unsure at all Xaa locations
SSRPTTRPGIRVFLVWFPVLIPSLPRWGDRVMHVLASCAWWSIQHLQVXWNHFSADVFEGPPPGXDWFEKQTGGTXDISCCSWMDXVFGGLQFQLEHHLIPMLSRAHLEXISPMEIDSCKMHNVPYRSVTSVEATLWALKTLTTAA

SEQ ID NO: 19139 - protein, 395 aa, Glycine max
MESNSEFDVIIIGAGVMGSSTAYHATKRGLKTLLLEQFDFLHHCGSSHGESRTIRLTYPHHYYYPLVMDSYRLWQEAQAQVGYQIYFKAHHMDMAHHNEPAMRALIDYCRNLQIPFKLLGRQELADKFSGRIDIPEGWVGLSNEHGGVIKPTKAVAMFQTLAYKNGAVLKDNTKVIDIKKEGGTGGVEVFTAGGEKFRGRKCVVTVGAWAKKLVKAVSGVELPIEPLETHVCYWRVKEGQEGKFAIGSGFPTFASFQKDIYVYGTPTLEFPGLIKVGVHGGEPCDPDKRPWGAAVMMEKLKEWVEFTFKGMVESTEPVIKQSCIYSMTPDEDFLIDFLGGDFGKDVVLGAGFSGHGFKMAPVIGRILTDLAVHGETKSHDISYFRIARFRITSMI

SEQ ID NO: 19140 - protein, 266 aa, Xanthomonas oryzae pv. oryzae KACC10331
MGYSVACLQLRNLRLMRRKIVAGNWKLHGSRAFATELVAKLAAHMPLEGIDVVILPPLPYLGDLIEDFEAHHLSFGAQDVSSNEKGAYTGEVSASMLVDVGAGYGLVGHSERRQYHQESSELVARKFAAAIHAGLTPVLCVGESLEQREAGQTEAILRAQLEPVLALVGSAGFAGAVLAYEPIWAIGTGCTATPEQAQAVHAFLRGEVAKADARIADSLPILYGGSVKPDNAGELFAQPDVDGGLVGGASLVAEDFLAIARAAAAC

SEQ ID NO: 19141 - protein, 243 aa, Acidovorax sp. JS42
MPTPPLPTSRHALFLDFDGTLADIAAQPHAVQLPPGVVDCLQALHVRLEGALAIVTGRTMADIDHFLDPLRLPVACEHGAQYRLGNGRSGGLPALPLQPLLAALRPLMAQHPELLLEAKSAGLALHYRQAPQLQALCLQAITQALREVPGAELLHGKFVYEVKPVGPDKGRAITDFMRLAPFAGRAPLFVGDDVTDEAGFAAAQSLGGLGIKVGEGATRAHARLATPAAVRQWLQHAVGEEIT

SEQ ID NO: 19142 - protein, 395 aa, Mycobacterium smegmatis str. MC2 155
MTTSAHSAGIVIVGGGLAATRTAEQLRRSEYAGPITIVSDEDHLPYDRPPLSKEVLRAENDDVTLKPAEFYEENNITLRLGSGAQSVDTAAQTVRLADGSELPYDELVIATGLVPKRIGSFPDLQGIRVLRTYDESMALREDARKASRAVVIGAGFIGCEVAASLRKLGVDVVLVEPQPTPLASVLGEKIGALVTRLHRAEGVDVRCGVGVTEVRGTQNVETVVLADGTELEADLVIVGIGSRPSVDWLKGSGIEVDNGVVCDEVGRTSAPHVWAIGDVASWRDHVGGQVRVEHWSNVADQARAMVPALLGQEASAVVSVPYFWSDQYDVKIQCLGEPESDDTVHIVEDDGRKFLAYYERDGVLVGVVGGGMPGKVMKTRGKIAAGAPIAEVLGG

SEQ ID NO: 19143 - protein, 128 aa, Triticum aestivum
  misc_feature (75)..(75): Xaa can be any naturally occurring amino acid
  misc_feature (78)..(78): Xaa can be any naturally occurring amino acid
  misc_feature (84)..(84): Xaa can be any naturally occurring amino acid
  misc_feature (90)..(90): Xaa can be any naturally occurring amino acid
  misc_feature (96)..(96): Xaa can be any naturally occurring amino acid
  misc_feature (100)..(100): Xaa can be any naturally occurring amino acid
  misc_feature (102)..(103): Xaa can be any naturally occurring amino acid
  misc_feature (109)..(109): Xaa can be any naturally occurring amino acid
  misc_feature (114)..(114): Xaa can be any naturally occurring amino acid
  unsure (1)..(128): unsure at all Xaa locations
MAPTVMASSATSVAPFQGLKSTAGLPVSRRSNGASLGSVSNGGRIRCMQVWAHRGHQEFETLSYLPPLSTEASLXKAXYLFASXWVACFXFNKGGXTSVXQXXSPGYYXGRYWXMWKLLSSGCTDASD

SEQ ID NO: 19144 - protein, 422 aa, Chlamydia muridarum Nigg
MPHLFSKACQYFPGGVNSPVRACRSVDITPPVVTRASGDFFTDSQGKTYIDFCGSWGSLIHGHSHPYICEAIQQGLQRGCSYGLTSEQEISFAEEIFSYLEISNDHKIRFMSTGSEATMTAVRLARGVTERPIIIKFSGCYHGHSDVFLQEIHFQQTILDTVDLTQPLTLSLPFNNLSLFLDVMNQIGHRVAGVIFEPICANMGVVLPLPGFIEGIIQTCRKTGSLSIMDEVVTGFRVSKGGAAALHPLKPDILVFGKILGGGLPASAVCAPAAIMDYLAPVGKVFQAGTLSGNPLAMSAGKASIALCREKNFYTQLSAIEDDFLSPIEQMIQQSGIPVTLVRYGNLFSFFFSENRPNNLKEVQLCNTDIFRTFYQQAFLKGIYLSPSPFEASFLSTAHSMENLNYAQQVLIESLEQACSLV

SEQ ID NO: 19145 - protein, 412 aa, Rhodococcus aetherivorans
MTSDIVVIGGGVAGVSAVQSLRSEGYDGRLFLIGKERELPYDRTSLSKAVLAGDLADPPPLSPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTAAEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 19146 - protein, 239 aa, Chlamydia muridarum Nigg
MSKQVAHSFSSEDFSFIKQKLAREAVALVEPGMRVGLGSGSTAREFILALGERVRNERLAITAVASSRISHLLAQALGIPFLDPALSQELDLVVDGADEVDANLRMIKGGGGALFREKILLQSGKRNIILVDERKLVSVLGTFPLPIEISPFGCSSVEKVLNQQGYIGDWRKTSHGERFITDNGNYIYDVSSPDSYPHPEEDLIRLLQIRGIIDVGFVIAKAEVWVGYADGTVVRKEIT

SEQ ID NO: 19147 - protein, 684 aa, Mycobacterium bovis AF2122/97
MTTTSDQNAAAPPRFDGLRALFINATLKRSPELSHTDGLIERSSGIMREHGVQVDTLRAVDHDIATGVWPDMTEHGWATDEWPALYRRVLDAHILVLCGPIWLGDNSSVMKRVIERLYACSSLLNEDGQYAYYGRAGGCLITGNEDGVKHCAMNVLYSLQHLGYTIPPQADAGWIGEAGPGPSYLDPGSGGPENDFTNRNTTFMTFNLMHIAQMLRAPAASRPTAINAPSGTPAAGRTSPTPTTDSQRRSRVARWLVAGEFRLLSHLCSRGSKVGELAQDTRTSLKTSWYLLGPAFVAAIAYVDPGNVAANVSSGAQFGYLLLWVIVAANVMAALVQYLSAKLGLVTGRSLPEAIGKRMGRPARLAYWAQAEIVAMATDVAEVIGGAIALRIMFNLPLPIGGIITGVVSLLLLTIQDRRGQRLFERVITALLLVIAIGFTASFFVVTPPPNAVLGGLAPRFQGTESVLLAAAIMGATVMPHAVYLHSGLARDRHGHPDPGPQRRRLLRVTRWDVGLAMLIAGGVNAAMLLVAALNMRGRGDTASIEGAYHAVHDTLGATIAVLFAVGLLASGLASSSVGAYAGAMIMQGLLHWSVPMLVRRLITLGPALAILTLGFDPTRTLVLSQVVLSFGIPFAVLPLVKLTGSPAVMGGDTNHRATTWVGWVVAVMVSLLNVMLIYLTVTG

SEQ ID NO: 19148 - protein, 417 aa, Cochliobolus heterostrophus
MPLLGMPAHAFQVFNQEFIVDERYNVTKELGQGAYGIVCAATNNQTGEGVAIKKVTNVFSKKILAKRALREIKLLQHFRGHRNITCLYDMDIPRPDNFNECYLYEELMECDLAAIIRSGQPLTDAHFQSFIYQILCGLKYIHSANVLHRDLKPGNLLVNADCELKICDFGLARGFSMDPEENAGYMTEYVATRWYRAPEIMLSFQSYTKAIDVWSVGCILAELLGGKPFFKGRDYVDQLNQILHYLGTPNEETLSRIGSPRAQDYVRNLPYMQKMSFQSLFKNANPDALDLLDRMLAFDPSSRISVEEALEHRYLQIWHDASDEPSCPTTFDFQFEVVEEIPEMKKMILDEVSRFRQMVRVQPGAGAGAAQAPQVPIPNNYDRTGYEEPRPQEAFNQGGWNGSDLERDLQGLDGRMR

SEQ ID NO: 19149 - protein, 570 aa, Oryza sativa (japonica cultivar-group)
MAASSRHGPFINWSDGLFLFLSSSSSRNRFLRVFLPFPDPSTMMAGLEVATTAVTGGDASLVVVVGVLFLMVAVVVMTRLGDGGAAPSPPAMPVLGHLHLIKKPLHRSLAEVAARVGAAPVVSLRLGARRALLVSTHAAAEECFTACDAAVAGRPRLLAGDVLGYGHTTVVWASHGDHWRALRRLLGVELFSNARLAALAADRRAEVASLVDAVLRDAAAGGGGGGTVTLRPRLFELVLNVMLRAVTARRHAGDETRRFQEIVEETFAASGSPTVGDFFPALRWVDRLRGVVATLQSLQKRRDAFVAGLVDDHRRTRRAAAAAADKDQKKNGIIDALLTLQETDPDHYTDNVVKGIVLVLLTAGTDTSALTTEWAMAQLVAHPEAMTKVRAEIDANVGAARLVEEADMASLPYLQCVVKETLRLRPVGPVIPAHEAMEDCKVGGYHVRRGTMILVNAWAIHRDGDVWGSPEEFRPERFMDDGAGAGAVTAVTAPMLPFGLGRRRCPGEGLAVRLVGLTVAALVQCFDWEIGEGGAVDMAEGGGLTMPMATPLAAVCRPREFVKTVVSDCF

SEQ ID NO: 19150 - protein, 531 aa, Oryza sativa (japonica cultivar-group)
MQSFIHLVHGDLTSLRLRLSSPPPPPHMASLPSPILPSSTTQWRRWPAHPEPAGPPRRRPPPPPQEAAAPLPRRAGGALRRRRGAPPAPVRREAGGARLLPGRRRRVLHGARRRARGPPGARVAAAAHRRLPHHRHGGAQRAVAPPPPPRHRPRPLRPPPRRHLPARDAEARAMAARLYSSSSSSSAASAVVVGVKPAAYGFVASVIMSMVAGERMAEEDVLRFKAITEAGLAAAGAANRQDFLPFLRLLDFGRARRRLAGIAKERHDFGQRIVDEYRRRHRRRLAVAADDFSSSPPRRTVIGDLLRQQESSPESYADEVIRTVCLSLLQAGTDTSASTIEWAMALLLNNPDVLRKATDEINSVVGMSRLLQEPDLANLPYLRCIITETLRLYPLAPHLVPHEASRDCMVAGHVIARGTMVLVDVYSMQRDPRVWEDPDKFIPERFKGFKVDGSGWMMPFGMGRRKCPGEGLALRTVGMALGVMIQCFQWERVGKKKVDMSEGSGLTMPMAVPLMAMCLPRVEMESVLKSL

SEQ ID NO: 19151 - protein, 277 aa, Vibrio sp. Ex25
MTLQIDRYAVFGNPIGHSKSPFIHTLFARQTNQSLTYTAECAPVGGFIEAAKAFFADGGKGCNVTLPFKEDAYQFASRLTERAQLAGAVNTLKKLDDGEIIGDNTDGAGLVQDLLQHQVILEGARILIIGAGGAARGVIKPLLDQKPTSLTITNRTFSKAEELAELFSAYGPVTAKEMNTIAEEYDVVINSTSASLSGELPAISSSVFAANSTSYDMVYGKGDTTFNQWAKQHGAAHAYDGLGMLVGQAAESFMLWRGLRPGAKQILRELRKNLEGQ

SEQ ID NO: 19152 - protein, 555 aa, Bacteroides fragilis NCTC 9343
MGLFIKKPFEALLAEANVSGSKSLKRVLGPWSLVALGVGVIIGAGLFSITGTVAAGYTGPAITLSFAIAALGCCFAGLCYAEFASMIPVAGSAYTYSYATMGELIAWIIGWDLVLEYTVAATTVSISWSRYLVVFLEGLDIHLPQALTACPWDGGIVNIPAFLIVVLMSIFLIRGTEGSSIFNGIVVFLKVSVIAIFVVLGWKYINADNYTPYIPANTGTLGEYGLSGVLRGAAIVFFAFLGFDAVSTAAQETKNPKRNMPIGILVSLLVCTVLYMLFAHVMTGVAHYTEFSGQQGIAPVAIAIEHMGHADATGIIHPDYPWLNRAIVLAILFGYCSVIMVTLLGQSRVFLSMSHDGLLPPFFSHINEKFRTPARSNLLFMLIVGLLAAFVPARLAGEMTSIGTLMAFTLVCAAVLVVRKTMPNIPRSFKTPFVPLVPILGILTCLCMMLFLPADTWIRLVLWMLIGLDIYVGYGMKHSKLEHGVKNRRGQSALNMIGIALSLLCVITGLWHQQTVGWNESKALLIISFVFAFTHCAYYMMRIWKGTTKQTNDNG

SEQ ID NO: 19153 - protein, 465 aa, Zea mays
PRVRPRPLPALVTYRPKWEGGEYEGDDESRFEALLLAMELGAEYVDVELKVADKFMKLISGRKPDNCKLIVSSHNYETTPSSEELANLVAQIQATGADIVKIATTATEIVDVAKMFQILVHCQEKQVPIIGLVMNDRGFISRVLCPKYGGFLTFGSLKKGKESAPAQPTAADLINLYNIRQIGPDTKVFGIIGKPVGHSKSPILHNEAFRSVGFNAVYVPFLVDDLAKFLDTYSSPDFAGFSCTIPHKEAAVRCCDEVDPIARDIGAVNTIVRRPDGKLVGYNTDYVGAISAIEDGIKASESEPTDPDKSPLAGRLFVVIGAGGAGKALAYGAKEKGARVVIANRTFARAQELANLIGGPALTLADLENYHPEEGMILANTTAIGMHPNVNETPLSKQALRSYAVVFDAVYTPKETRLLREAAECGATVVSGLEMFIRQAMGQFEHFTGMPAPDSLMRDIVLTKT

SEQ ID NO: 19154 - protein, 168 aa, Triticum aestivum
  misc_feature (74)..(74): Xaa can be any naturally occurring amino acid
  misc_feature (101)..(101): Xaa can be any naturally occurring amino acid
  unsure (1)..(168): unsure at all Xaa locations
MRRTTSLREVAPPSVLAVVLEDEDEDEQAKAVVQAEEGGAGGGQDWLAALGGGSGAPGTDWLAAYRARAAPARXRGLRRNSADYSKVETAAFLRHCGLCRXASSGPGRDTFMYKGEAAFCSLECRQQHITHEEWKDKCTPRSMSEAAAPATSRGRSGKTDTGGTVAAA

SEQ ID NO: 19155 - protein, 238 aa, Mycobacterium smegmatis str. MC2 155
MSTSNGSANGTNGVGLPRGDEPEIIAVRRGMFGNRDTGDTSGYGRLVRPVALPGSTPRPYGGYFDAVMDRLAEVLGEERYAMSIERVVVYRDQLTIEVSRVQLPAVASVLRDDPDLRFELCLGVSGVHYPEDTGRELHAVYPLMSITHNRRIQLEVAAPDADPHIPSLYAVYPTTDWHERETYDFFGIIFDGHPSLTRIEMPDDWEGHPQRKDYPLGGIPVEYHGAQIPPPDQRRSYS

SEQ ID NO: 19156 - protein, 365 aa, Carboxydothermus hydrogenoformans Z-2901
MLKTQEISINVGPQHPSTHGVFRIILKLDGETIVDAEPVVGYLHRGIEKLAEDRTYTQVIPYTDRMDYLGAMSYNLGYVQAIEKLMGIEVPERAEFIRVIATELSRIASHHVFLASMSLDMGSYTGWMYPFRDRELVLELLEMLTGSRMTFSFMRIGGVADDLPEGFIEKAKEYLPKILDGVDEEEGLLAGNEIFLARTKGLAPVSVEKALAWGWGGVNLRASGYKFDLRKNRPYSVYDRFEFDIPTGANGDCWDRFYLRLAEIRQSVKIIEQALEMIPEGPIMAKVPKVIKPPVGEVYHEVEAPKGILGYYVVSDGSTKPYRMHVRRPSFINIGMLKELLIGTKLADFITIFASIDVVLGDVDC

SEQ ID NO: 19157 - protein, 293 aa, Arabidopsis thaliana
MNVERDQHISPPCLLTKKIPIVDLSDPSDELVAHAVVKASEEWGIFQLVNHGIPAELMRRLQEVGRQFFELPASEKESVTRPADSQDIEGFFSKDPKKLKAWDDHLIHNIWPPSSINYRYWPNNPSDYSGDGFREVTKEYTRNVTNLTEKIVGGDKAQYVMRINYYPPSDSAIGAPAHTDFCGLALLVSNEVPGLQVFKDDHWFDVEYINSAVIVLIGDQIMRMSNGKYKNVLHRSIMDAKKTRMSWPILVEPKRGLVVGPLPELTGDENPPKFESLTFEDYVYRKIIKVLRD

SEQ ID NO: 19158 - protein, 762 aa, Medicago truncatula
MINKSRDDVYISSQLKQPMLPSRGEPPLVDIPENIESNAEMYQKFKAWLENFSKQGQISIKGQKKQKPSTTRISIQEAESAQIEHKKQDHMKQSHVQQAKLVEGSMMNGLNNKVSAQIKKDLVNHGPPKKQKNTLKRKWNKVSAEHKTDLVNHRPSKKQKITPKLDDSMMNGLSNKVYAQIKKELVDHGPSKKQKNTLKLDGSMMNGLRNKVSAEHKMDLVNHRPSKKQKITPKLDQSMFDGLSNNFSAQVQKDLGDDGPSKKQKSTPKIPSMSLDEYFKRSREQLEAEESENEELDREQEVEGEINYENGDGDNSMEGEASKKKKKGSTLCLKIHARSLVDRQEITLNEEGEAIGPSQKIVSEFSNFLGSVARMSDLCPLTYTNWKAIPKKKTIWAYVNKRYIVPEKGQKDVFAIINDAWRRYKWLIKKNHFTKYRNLRERLKNRPDSIPEAHFKKLMTYWSYEAIREISHQNAKNIDKQKWRHRTGPISFAVIRERLRATKDDREPPTQAEVFIETRQSKRGKQLDQVTSDAITTLQDLITNSGHSSVEAFQTVFGKEKPGRLRCYGRVTTSSLLKRNKVEAMEKKHAAEVKSLTDKVQEMETIHRKDMAAMEEKLQVLLRVMLNQSNTGIDMGDLGVFLSTRNDDNNVRHSSTSNHESVMKLTVKTLKGSHFKIRVHPSDSIMAVKTNIEDIQGKDNYPCRQQLLIHNGKVLKDETSLADNEVSEDDFLVVMLNKVNNRSMGSECVVDNYEEEEIRRRG

SEQ ID NO: 19159 - protein, 157 aa, Triticum aestivum
  misc_feature (38)..(38): Xaa can be any naturally occurring amino acid
  misc_feature (40)..(43): Xaa can be any naturally occurring amino acid
  unsure (1)..(157): unsure at all Xaa locations
LITVVDETTMAARPMLVVALLCAAAAAATAQQATNVRXTXXXXRPAQNNWDLGAPAVSAYCATWDASKPLSWRSKYGWTAFCGPAGAHGQAACGKCLRVTNPATGAQVTARIVDQCANGGLDLDWDTVFTKIDTNGIGYQQGHLNVNYQFVDCRDNN

SEQ ID NO: 19160 - protein, 1124 aa, Arabidopsis thaliana
MNSPASDETAPRRNRRKVSRKNYDENAMDELIEKQLGGKAKKKYRTKQDLEKETETEALIALSVGFPIDELLEEEIRAGVVRELGGKEQNDYIVVRNHIVARWRGNVGIWLLKDQIRETVSSDFEHLISAAYDFLLFNGYINFGVSPLFAPYIPEEGTEGSVIVVGAGLAGLAAARQLLSFGFKVLVLEGRSRPGGRVYTQKMGGKDRFAAVELGGSVITGLHANPLGVLARQLSIPLHKVRDNCPLYNSEGVLVDKVADSNVEFGFNKLLDKVTEVREMMEGAAKKISLGEVLETLRVLYGVAKDSEERKLFDWHLANLEYANAGCLSNLSAAYWDQDDPYEMGGDHCFLAGGNWRLINALAEGLPIIYGKSVDTIKYGDGGVEVISGSQIFQADMILCTVPLGVLKKRSIKFEPELPRRKQAAIDRLGFGLLNKVAMLFPSVFWGDELDTFGCLNESSINRGEFFLFYAYHTVSGGPALVALVAGEAAQRFECTEPSVLLHRVLKKLRGIYGPKGVVVPDPIQTVCTRWGSDPLSYGSYSHVRVGSSGVDYDILAESVSNRLFFAGEATTRQHPATMHGAYLSGLREASKILHVANYLRSNLKKPVQRYSGVNINVLEDMFKRPDIAIGKLSFVFNPLTDDPKSFGLVRVCFDNFEEDPTNRLQLYTILSREQANKIKELDENSNESKLSCLMNTLGLKLMGANSVLDTGEQPFLRTSTPKLLKLERMTTMGDLPGDLVEEILSRVPLTSLRAIRSTCQKWNSLSKSQICGRKATAAENKFLGFMMKDSRVCSMKFDLQGIRNDDGELVEPSIKQVSKLDQIEVSQVFHCDGLVLCIIKDNTGLLVWNPYLGQTRWIHPRNNYQIEDRYALGYDNNRNHKILRIFDLYPSSNRVFGYEVYDFSSNSWKVLDVIPEWDIQSHFRGASLKGNAYFPAQKKETVGGIKTINIEDVLLCFDFTRERFGPPLPLPFHSYNADFFVSLACVREEQLAVLYQRWGAFETIEICVTNKIDPNTVSWSKFLITSTGFPVDTFSGSFFIDEEKKVAVVFDLDRYKPTETCRYQIVYIIGQDEYFKSVNMGVAPNIAKNSYQAYCVPLVCSSSYVPSLVQLQINKPGKRKESN

SEQ ID NO: 19161 - protein, 527 aa, Oryza sativa (japonica cultivar-group)
MTFSGMDIALKASTHSSTSQQHWLHSTRYRCQYGLGSTHLNGRKRSPMVLSVRAVSGKSDLDFSDPSWKEKYQEDWNRRFSLPHITDIYDLKPRLTTFSLKKNRTDGGSLSADKWNGYVNKDDRALLKVIKYASPTSAGAECVDPDCSWVEHWIHRAGPRKEIYYEPAEVKAAIVTCGGLCPGLNDVIRQIVFTLEIYGVKNIVGIQFGYRGFFEKGLKEMPLSRKVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMQASLSSGQIDVCLIPEVSFTLDGEHGVMRHLEHLLEKKGFCVVCVAEGAGQDLLQKSNATDASGNVILSDFGVHMQQKIKSHFKDIGVPADVKYIDPTYMVRACRANASDAILCTVLGQNAVHGAFAGFSGITSGICNTHYAFLPITEVITKPKRVNPNSRMWHRCLTSTGQPDFH

SEQ ID NO: 19162 - protein, 364 aa, Candida tropicalis
MTANPSLVLNKVDDISFEEYEAPKLESPRDVIVEVKKTGICGSDIHYYAHGSIGPFILRKPMVLGHESAGVVSAVGSEVTNLKVGDRVAIEPGVPSRFSDETKSGHYHLCPHMSFAATPPVNPDEPNPQGTLCKYYRVPCDFLFKLPDHVSLELGAMVEPLTVGVHGCKLADLKFGEDVVVFGAGPVGLLTAAVARTIGAKRVMVVDIFDNKLKMAKDMGAATHIFNSKTGGDYQDLIKSFDGVQPSVVLECSGAQPCIYMGVKILKAGGRFVQIGNAGGDVNFPIADFSTRELALYGSFRYGYGDYQTSIDILDRNYVNGKDKAPINFELLITHRFKFKDAIKAYDLVRAGNGAVKCLIDGPE

SEQ ID NO: 19163 - protein, 549 aa, Scutellaria baicalensis
METVENHGDVIFQSKLPDIYIPKHLPLHSYCFENISEHRTKPCLINGATNEVHTYEEVELISRKVAAGLSHLGLHHGDTIMILLPNSPEFVFAFLGASYIGAVSTMANPFFTPAEVIKQAKASNAKLIITQACYVKKVWDYAVENGVKVMCVDSPPPEAAGECLEFSQLTSADEGDMPEVEINSDDVVALPYSSGTTGLPKALMLTHKGLVTSVAQQVDGENPNLYIHSDDVILCVLPLFHIYSLNSVLLCGLRVGAAILIMQKFDIVPFLELIQRYKVTIGPFVPPIVLAIVKSPVVGNYDLSSIRTVMSGAAPLGKELEEAVRIKFPNAKLGQGYGMTEAGPVLAMCLAFAKEGFEIKSGACGTVVRNAEMKIVDIETAASLGRNQPGEICIRGDQIMKGYLNDPESTARTIAKEGWLHTGDIGFIDDDDELFIVDRLKEIIKYKGFQVAPAEIEALLLNHPSISDAAVVSMKDEEAGEVPVAFVVKSNGSTITEDDIKQFISKQVIFYKRIHRVFFIDAIPKNPSGKILRKDLRAILPTKAATLSN

SEQ ID NO: 19164 - protein, 549 aa, Scutellaria baicalensis
METVENHGDVIFQSKLPDIYIPKHLPLHSYCFENISEHRTKPCLINGATNEVHTYEEVELISRKVAAGLSHLGLHHGDTIMILLPNSPEFVFAFLGASYIGAVSTMANPFFTPAEVIKQAKASNAKLIITQACYVKKVWDYAVENGVKVMCVDSPPPEAAGECLEFSQLTSADEGDMPEVEINSDDVVALPYSSGTTGLPKAVMLTHKGLVTSVAQQVDGENPNLYIHSDDVILCVLPLFHIYSLNSVLLCGLRVGAAILIMQKFDIVPFLELIQRYKVTIGPFVPPIVLAIVKSPVVGNYDLSSIRTVMSRAAPLGKELEEAVRIKFPNAKLGQGYGMTEAGPVLAMCLAFAKEGFEIKSGACGTVVRNAEMKIVDIETAASLGRNQPGEICIRGDQIMKGYLNDPESTARTIDKEGWLHTGDIGFIDDDDELFIVDRLKEIIKYKGFQVAPAEIEALLLNHPSISDAAVVSMKDEEAGEVPVAFVVKSNGSTITEDDIKQFISKQVIFYKRIHRVFFIDAIPKNPSGKILRKDLRAILPTKAATLSN

SEQ ID NO: 19165 - protein, 215 aa, Xanthomonas oryzae pv. oryzae KACC10331
MSEAKRLAAEKAIDYVEDGMIVGVGTGSTVAYFIDALGHIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDVVLTDNGNVVLDVHNLQITDPVALERSLNQIPGVVCVGLFARRPADVVIVGGEPPRVL

SEQ ID NO: 19166 - protein, 491 aa, Oryza sativa (indica cultivar-group)
MSLPRPASAAGTPAVVAASPSLPLGSKWKWEKKMSGTEYLDNLEFPWICLAPIIGIWEQVLACPAIMSSMESSCLPATTESIAKAQEAKDASESISILYRVLQDPSSSAEALRTKELAITNLTNYLTKENRAEELRNLLTQLRPFFSLIPKAKTAKIVRGIIDAVAKIIGTSELQISLCKEMVEWTHAEKRTFLRQRVEARLAALLLENQEYTDALTLLTDLIKEVRRLDDKLLLVDIDLLESKLHFSLRNLPKAKASLTAARTAANAIYVPPAQQGTIDMQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDTLLEQNLCRLIEPYARVEIAHIAEMIELPVDHVEKKLSQMILDKKFAGNLDQGAGCLIIFEDPKTEAIFPATLETISNVGKVVDSLYMRSAKIMA

SEQ ID NO: 19167 - protein, 359 aa, Bradyrhizobium japonicum USDA 110
MKDTYTIAVVHGDGIGPEVARAAVAVLQAGVQAGTLRFVDYPAGADHFLKTGDSFPAASFEGCRTADAILHGAAGIPGVVHPDGTEAGLDFTLTLRFKLDLFANVRPIKLYKGVPSPLGRPGPIDYVIVRENSEGLYAARGAGALLREEVAVDTLVQTRKGVERIVRFAFELARTRNGSPKDGRRRVTCCDKANVLRTYAFFRAVFDEVAKEYPDIEAEHVLVDAMTVHLVNKPTHFDVIVTENMFGDIISDLGAATVGGMGMAPSEEVGDGIGFFQASHGSAPDIAGKGLANPYGTILASILMLRRLDQRHRDSRLKLGADRIEAAVCAGLEDPALRTRDIGGVAPTNQVVDALLKRL

SEQ ID NO: 19168 - protein, 932 aa, Acinetobacter sp. ADP1
MNTIPAVQLQSTTDNQLEYSVQTTNTTCPYCGVGCGVSATVEKTVSGQRISVTGDQEHPSNFGRLCIKGSRLADTLGLETRLLQPMIGRGDLRKVTTWDDVTEQIATRFQQCIDTYGAESIAFYVSGQLLTEDYYVVNKFVKGYLGTANIDTNSRLCMSSAVAAHKRSFGEDLVPASYKDFEHTDMVVLVGSNTAWCHPVLYQRIMQAKTERDLTVVVIDPRFTATCEQADLHLPILPGQDVTLFNGLLQYLYQQGYTDHSFVTAYTENLDSALLASDAEADIKVVSEKTGIALEKLQQFYQMFAQTDKVMSLFSMGVNQSSQGVNKANAIINCHLLTGKIGQLGAAPFSMTGQPNAMGGREVGGLANMLAAHMELDQPLHQEIVQSFWHSPRIASKAGLKAVDLFQAVETGKIKAVWIMATNPLVSLPDADQVKRALNKCEFVVVSDICQDTDTTAFADVLLPALGWGEKDGTVTNSERRISRQRAFLDTPEHTKADWWAVCQVAKKMGFSGFEFEHAHQIFQEHAELSSYQNAAMSHRDEAKAFRYFNLSGLTQISQSDYDQLKPIQWPVLKSIDELNDTDSERLFVQGQYSHSSKKAKFIATDAIAPVHATTHQYPLILNTGRIRDQWHTMTRTGLSSNLTTHRAEPYCEIHPQDALKYGVREHGLVEVTSNWGKCVLRVHLSEGIRRGQVFAPIHWNDQFASDARIGKVVNPVVDSISGEPEFKHTPVMLNPFYVHWQGVLYIREGMEQLIQTCLKNVVWWTKVKMTKVNRFEIAGRNKLDEVQYALKDFLPFDDASFEWMNLSDTSMQMSHSIILKDGILIASLYIAPAEMLPDRDWVATLFKRERLSALHRKALLAGMPMSMSSHDGPLVCSCFKVGKNKIIETIKTQNITHEKQVTACLKAGGNCGSCLPEIRGLIKACQQEIDA

SEQ ID NO: 19169 - protein, 493 aa, Bradyrhizobium japonicum USDA 110
MTKAEIRFPLDGRARKMFVDGAWVEARSGKVFETRNPATGEVIGRVPRGEAADISVAVAAARRAFVGPWSRFKPFERQALLLRIADLFEKHWEEISQSDTADMGMPIARTRANKLRVIGMLRYYAGMATALHGQTVDNSLPGDIVSFTRKEPIGVVGAIIPWNAPTAASVWKIGPALATGCTIVLKPSEEAPLTPLLIADLMNEAGVPPGVVNVVTGTGVEAGAPLAEHPDVDKIVFTGSTATGQAIIRASAGNLKRVSLELGGKSPVIVCADADLDKAVPIAAMAAFANSGQICIAGSRLFVERKIHDELVERLGKFASALKIGDGADPTTEIGPLVSQRQLDKVEGFLQSGREEGAKVVAGGRRVREGNLAKGNFVEPTVFAGVSDDMQIARDEIFGPVISALPFDTLDEAVERANATPYGLAAGVFTRDVSKAHVISRSLRAGSVWVNTYHALDPAMPFGGYKMSGYGREGGTEHLDEYLHTKGVWIKLD

SEQ ID NO: 19170 - protein, 545 aa, Acinetobacter sp. ADP1
MSNLKQLNQIAENEWIDVCALSDITPNTGVTALIDDQQIALFRVGHEQRIYALSNQDPFSGANVMSRGIMGDLQGERVIASPIYKQHFSLATGRCLEDKEQKLLVFPCKVQSGRVWVSPVPQKTYITNNGLAQDKLKLVLVGNGLAGMRCLEDLLDMNPERYEITVIGEEPWGNYNRIMLSPVLSGEKTIEDIMLHPHQWYQDKAIRFVAGDPAIKIDRNRKQVHTQNGECVEYDRLILATGSKPFIPPIQGADLKGVISFRDIYDVNTMVDYASQKKHAVVIGGGLLGLEAAYGLKQRGMNVTVLHLMDRIMDRQLDAQASVMLRHSIEQKGIEIITEANTEALLGNDQGHVTHLRLKDGRVLDADLVVFAVGIRPNIRLAQSAGLRCNRGVLVNDTMQTFDPSIYAVGECIEHRGQTFGLVEPLWGQAFICASHLAEHGSLTFKAPTVPTQLKVSGVDVFSAGQIDIDVRQSEDGYEDIIMNDEKRQIYKRIIIQHDRVIGAVLFGDTEDGTWYAELIADQTPISSIRSKLLFGRDFALRKAG

SEQ ID NO: 19171 - protein, 1088 aa, Blastopirellula marina DSM 3645
MPRRDDIKKILLIGSGPIIIGQACEFDYSGTQACKALREEGYEVVLVNSNPATIMTDPDMADRTYIEPLSWEIIEKIIAKERPDALLPTLGGQTALNLAMELEKHGVLEKYGVEMIGANAAVIAKAEEREQFKAAMEKIGLEVCRGGTVHTIQEARAVLDEIGLPAVVRPSFTMGGSGSAIAYNREEFDSLVRNGLDQSPVNEVLIEESVIGWKEYEMEVMRDVADNVVIICTIENFDPVGVHTGDSITVAPAQTLSDKEYQRMRDASLAVIREIGVETGGSNIQFANDPHSDRMIVIEMNPRVSRSSALASKATGFPIAKIAAKLAVGYLLHELPNDITRETLACFEPTIDYVVTKIPRFAFEKFPEADATLTTQMKSVGETMAIGRTFKESFQKALRGLEVGRFGFGSDGKDLWGTEEQPSDDEIRAKLSTPNADRPWYLRYAIKSGMTLEKIYQLTFIDPWFIDQLQQLVEKEEELAAIGSLSAITAAQMKEAKQFGYSDRQLATLLGSSELEVRKQRKKLGVITTFKSVDTCAAEFEAYTPYFYSTYEDEDETPAKNPDKKRVMILGGGPNRIGQGIEFDYCCCHASFALRELGIESIMVNSNPETVSTDYDTSDILFFEPLTTEDVLNICDKVQPDGVIVQFGGQTPLNLARALATAGVPIIGTSVDTIEAAEDREKFQKLLNQLGLKQPANAIARTMTQARTESAKVGYPSLVRPSFVLGGRAMEICYDDKQFERYVAEAFLVAQGQPVLIDRFLEDATEVDVDCISDGENVVVAGIMEHIEEAGVHSGDSACSIPPYSLPGPVVNEIREATVAMARKLKVIGLMNVQFAVKQEDGKMNVYVLEVNPRASRTVPFVAKATGMQVAKIAAKVMTGMTLPELGVTKEPIPAHVSIKESVFPFRKFSGVDIVLGPEMRSTGEVMGISERFSIAFAKSQLAAGILLPQPEDGKIFLSVSPRHKEHIVEIAKRLDSLGFQLVCTEGTAKRLREEGLKVEQIKKLAEGHPNLLDLLIDGAVSLVMNTPSGKGARTDEGRIRAAAVQHGVPCITTIQAAEAAAKAMEALRNGEMNVLSLQDRFQKMGEQ

SEQ ID NO: 19172 - protein, 327 aa, Thermosynechococcus elongatus BP-1
MAETLMFNALRAAIDEEMERDPTVFVLGEDVGHYGGSYKVTKDLYKKYGELRLLDTPIAENSFTGMAIGAAMTGLRPIVEGMNMGFLLLAFNQIANNAGMLRYTSGGNFKIPIVIRGPGGVGRQLGAEHSQRLEAYFQAVPGLKIVACSTPYNAKGLLKSAIRDPNPVLFFEHVLLYNLKEDLPEEEYLLPLDKAEVVRTGEDVTILTYSRMRHHVLQAVKTLEKEGYDPEVIDLISLKPLDFETIGASIRKTHRVVIVEECMKTGGIGAELSASIMERYFDELDAPVIRLSSKDVPTPYNGTLENLTIVQPPQIVAAVQKLVQGQV

SEQ ID NO: 19173 - protein, 436 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTSLFSR

SEQ ID NO: 19174 - protein, 306 aa, Acidovorax sp. JS42
MGADPLPAQPAPVPVSDPHPARASDKEDKRTFLQRLVEFINPGPDSTAELIATLAEAEDNDVINADARVMLERVLRMAEMTAGDVLVPAPRMDMLDIDAPVDELMHQVLHTAHSRFPVYQGERDNIIGILLAKDLLKLWRSPGLNVRTLVRPALFVPESKGLHDLGREFRNTRNHMAIAIDEFGRIAGLVTFEDVIEQIVGEIEDEFDIPEDEGDIFGLADRTFRVSGDTPVERVAEAFGVALQGSDPDESFDTIGGLIAHELGRMPRKGESVVLGGLQFVVMHTKGGSVRWFKVAPAAATPESER

SEQ ID NO: 19175 - protein, 616 aa, Thermus aquaticus
MEKVFYVTTPIYYVNAEPHLGHAYTTVVADFLARWHRLDGYRTFFLTGTDEHGETVYRAAQAAGEDPKAFVDRVSGRFKRAWDLLGIAYDDFIRTTEERHKKVVQLVLKKVYEAGDIYYGEYEGLYCVSCERFYTEKELVEGLCPIHGRPVERRKEGNYFFRMEKYRPWLQEYIQENPDLIRPEGYRNEVLAMLAEPIGDLSISRPKSRVPWGIPLPWDENHVTYVWFDALLNYVSALDYPEGEAYRTFWPHAWHLIGKDILKPHAVFWPTMLKAAGIPMYRHLNVGGFLLGPDGRKMSKTLGNVVDPFALLEKYGRDALRYYLLREIPYGQDTPVSEEALRTRYEADLADDLGNLVQRTRAMLFRFAEGRIPEPVAGEELAEGTGLAGRLRPLVRELKFHVALEEAMAYVKALNRYINEKKPWELFKKEPEEARAVLYRVVEGLRIASILLTPAMPDKMAELRRALGLKEEVRLEEAERWGLAEPRPIPEEAPVLFPKKEAKVEAKPKEEAWIGIEDFAKVELRVAEVLAAEKHPNADRLLVLRLSLGNEERTVVSGIAKWYRPEELVGKKVVLVANLKPAKLRGIESQGMILAAQEGEALALVTVEGEVPPGRW

SEQ ID NO: 19176 - protein, 337 aa, Cryptococcus neoformans var. neoformans JEC21
MSSTEPTIIPSSNTMPPPNGVPGATGTSTPILGSRGGPSGGGAGGSFGVKSGLAQMLKGGVIMDVMNAEQAKIAEEAGASAVMALERIPANIRRDGGVARMSDPGMIKEIMEAVSIPVMAKVRIGHIVEAQILQAVGVDYIDESEVLTPADDQHHIGKHAFKVPFVCGCKNLGEALRRISEGAAMIRTKGEAGTGDVVEAVRHQRAVMSDIRKAASMTDEELYAFAKELSAPYHLLKETARLKRLPVVSFAAGGVATPADAALMMQLGCDGVFVGSGIFLSGDPAKRARAIVQAVTHYNNPQVLAEISTNLGEAMVGISTAHEGEKIQGGRLAGRGN

SEQ ID NO: 19177 - protein, 353 aa, Aspergillus oryzae
MYSKFWPKGGLPGILHHYTETLVTFEYTTSTVRKPHSLLFVGGLGDGLATTSYMADLAHALQPTEWSLFTLNLTSSYQSWGLGHLDRDTNEIAQCLNYIKEYKTEKFGNGKIVLMGHSTGSQCVVHYLSRPNPHTTTPSFDPTLEHIKRMVLDGAIMQAPVSDREAIKWVLKWGIGGKSPSEVREIYDKVVALAREGVAKDKDSGFDTLLPINLTGTMGYPPNTPISCRRLLSLVSPDSPDSPGEDDMFSSDLSEEQLAKTFGKIKQGGLLKHKLMVLFSGADQSVPDWVDKEQLLEKWRKVTDRDGEAPIWDQEHSAVIPNASHALSNDDQAEPRKFLVEKVMGYLRGAEKA

SEQ ID NO: 19178 - protein, 855 aa, Acinetobacter sp. ADP1
MHDLRRNPMKLVMIGHGMVGHKFIESLLEKADDELEVTIIAEEPRIAYDRVHLTEYFSGKTAKDLSLARADFADAYGIDLRLNTKAIAIDPILKTVTTSAGDVIGYDKLVLATGSYAFVPPISGNDRNNCFVYRTLEDLDAIRAASKNAKSGVVIGGGLLGLEAAKALRDLNLETHVVEFAPRLMAVQIDDLGGKVLRRKIEDLGVKVHTQKATQCIEDGSTHHHIMKFADGSVLETDIVLFSAGIRPRDELAKISGLATGERGGIVINDYCQTSQPDVYAIGECALWNNKIYGLVAPGYDMARIAAKHILEEETHCFTGADMSTKLKLMGVDVASIGDAHAMTPNALSYFYADEDALIYKKIVVNAEKTQLLGAVLVGDAKEYSDLLQMMLNGMALPEQPESLIMPGFSEAGAAKSGGSGVDLLPDSATICSCNNVSKADICQAIEDGSTSLGALKKCTKAATACGGCAPLVTQVLKSELQRQGVTVNNHLCEHFAYSRQELYHLVRVNEIKTFDDLIEQHGHGLGCDICKPTVANILASCWNDFVLKPSHAGLQDSNDYYLGNIQKDGSYSVVPRMAGGEVTPDGLIAVGQIAKKYNLYTKITGGQRVDMFGAQLHELPLIWEELIAAGFESGHAYGKSLRTVKSCVGSTWCRYGVDDSVGLAIFLENRYKGLRSPHKLKMAVSGCTRECAEAQGKDVGVIATEKGWNLYVCGNGGMKPRHAELLASDLDTNTLIRYIDRFFMFYIQTADRLQRTSVWRDNMEGGLDYLKAVIVEDSLGLAHELERRMSHVVNTYQDEWRTAVEDPDVRKRFQTFINQKEQRDPHIQFTEERGQIRPLKASERDESRIPLVEA

SEQ ID NO: 19179 - protein, 251 aa, Brassica napus
RPTRPELEDWETEFTKNRVKFKDLYSATEGFKEKDVLGSGGFGSVYKGVMPNTKKEIAVKRVSNESKQGLKEFVSEIVTIGRMSHRNLVPLLGYCRREKELLLVYDYMPNGSLDKYLHNSPEVTLDWKQRIKVIKGVASALFYLHEDWEQVVIHRDIKSSNVLLDAEYNGRLGDFGLARLCGHGTDPQTSHVAGTWGYLAPDHMRTGKTTTATDVFSFGVLLLEVACGRRPIEVHKKSGETVLLVDWVFGF

SEQ ID NO: 19180 - protein, 155 aa, Glycine max
MTVLSPSLSRPKLQSSFLCCPLKYSKPTNRNIQPKPTSYPRISPLDLDQNTVVAISVGVVSVAVGIGIPVFYETQIDNAAKRENTQPCFPCNGSGAQKCRFCLGNGNVTVELGGGEEEVSRCINCDGVGSLTCTTCQGSGIQPRYLDRREFKDDD

SEQ ID NO: 19181 - protein, 680 aa, Blastopirellula marina DSM 3645
MSVSTTSIEQLTINAIRTLSMDAVQAANSGHPGTPMALAPVAYTLWSNHLNYDPNYPRWAGRDRFVLSCGHASMLIYSLLHLAGVKNKNGGDELSVKIDDIKRFRQLHSPCAGHPESYEVTGIETTTGPLGQGVANSVGMAMAAEYERTRYNRPGHEVFGYDVYAICSDGDLMEGVACEAASIAGHLKLSNLCWIYDDNHITIEGDTELAFSEDVATRFEGLGWHVVKVADANNLGLLNAAYDSFKATEDKPTLIIVRSIIAWGAPTMANTHGAHGAPLGEAEIAATKEAYGWSYDKFAVPTETTEHFAETMGARGASARTDWEAKFAVYEKAFPAEANEWKQIMSGDLPTEWDAELPKFDANPKGVASRASGGQVLNAIAKSVPSLLGGSADLEPSTKTGLKFPGAGSFLADDHSGRNMHFGIREHAMAAIANGLCLSGYRPFISTFFVFSDYLRPSMRLSAIMGLPVLYIFTHDSIGVGEDGPTHQPVEHLTAIRAIPNVAVFRPGDANEVSQAYKAVMELTDRPSIIVLTRQNLPTLDRDKYACASGTTRGGYVLADCGGTPEVILMATGSELSMAVEAYETLKADGIKARVVSMPCAELFENQDAAYQESVLPSSVVARVAVEAGVRQSWDKYLGFRGRFVGMKGFGASAPADELFPYFGITAENVVKEAKASIAG

SEQ ID NO: 19182 - protein, 123 aa, Candida albicans SC5314
MSVVGSLIFCNYCGNLLDSHSSSSEIKCTVCSAAYPKSKFANLKVVTKSSDDAFPSKLKSARSVVKTSLKKDELDEGATIKEKCPKCGNEEMQYHTLQLRSADEGATVFYTCTNCGYRFRTNN

SEQ ID NO: 19183 - protein, 199 aa, Prochlorococcus marinus str. NATL1A
MKKKPTLEFAKIVSGVFSNKEQALNNPKKFAHIQIHIRPLFFKTYNCFAFYSEQRYQHDIWNPYRQSINKLSQEEEIFIFSNYKIEDKERFTGGALDISLLDKISKYKLYKKPGCSMYFKETNPGNFLGTIESGCKCFIEYGSDKTYVKSKVTVNKNILISEDSGYAIETDKKVWGSEFGPLIFKKIINFDCFINEYWK

SEQ ID NO: 19184 - protein, 270 aa, Nicotiana benthamiana
EKLTKGPYKKCMEQRFKELVASKGLEGVQAEVTDMDWESTFFLRHLPVSNISEVPDLDDQYREVMRDFAKRLENLAEELLDLLCENLGLEKGYLKKVFYGSKGPNFGTKVSNYPPCPKPDLIKGLRAHTDAGGIILLFQDDKVSGLQLLKDGQWIDVPPTRHSIVVNLGDQLEVITNGKYKSVMHRVIAQKDGTRMSLASFYNPGSDAVIYPAPALVEKEAVESKQVYPKFVFDDYMKLYAGLKFQAKEPRFEAMKSIESDVKMDAIATA

SEQ ID NO: 19185 - protein, 412 aa, Yarrowia lipolytica CLIB122
MSTKALILVGGGTRGTRFRPLSLDTPKVLFPVGGKPILSHAVDAVASLKDVKEVLLVGFYEDSVFSQFIADTNKQYPNLSIKYLREYKAMGTAGGLYHFRDVILKGNPSRFFVIHADVCCSFPLKEIEEFYEEKKAKYVILGTTVPAAVANNFGAIVTDPETQRVIHYVEKPESHISNLINAGVYLFDQTIFDTIAAAKKVREEKAQDPSFVGEGDEDHLRLEQDILVQLPATDAFYAYETKDFWRQIKTAGSAVPANALYLQQAFQADPKQPGLQAPSANIVPPVYIDPSAKIDSTAKLGPNVSIGPRAVIAAGARIKDSIVLEGVEVKHDAAVFHSILGRGCKIGSWARIEGSAVAPNDHSETLVKDGAKIQSVTILSSDVNVSEEVHVQNTIVLPHKDIKNDVVNEVIM

SEQ ID NO: 19186 - protein, 338 aa, Bradyrhizobium japonicum USDA 110
MPRMTMIEAIRSGLDVSMARNDDVVVYGEDVGFFGGVFRCTQGLQQKYGVSRCFDAPISECGIVGTAIGMAAYGLRPCVELQFADYMYPAYDQIVSEAARLRYRSAGDFTCPLVIRMPTGGGIFGGQTHSQSPEALFTHVAGLKTVVPSNPHDAKGLLIAAIEDPDPVIFLEPKRLYNGPFDGHHDRPVTAWAKHELSEVPEGHYTTPLGKAVTRRAGEAVTVLTYGTMVHVALAAVEETGVDAEVIDLRTLLPLDLETIIASVARTGRCIVLHEATLTSGFGAELTALVQEHCFYHLEAPVMRVTGWDTPYPHAQEWDYFPGPIRLGQALRDIMETR

SEQ ID NO: 19187 - protein, 135 aa, Xanthomonas campestris pv. campestris str. ATCC 33913
MSKLNKTILADFEAAQIQRQLPEFNQGDTVVVNVKVKEGNRERVQAYEGVVIGTKNAGLNSAFTVRKISHGFGVERVFQTHSAIIDSVEVKRRGKVRAGKLYYLRGLEGKAARIKEDLAAAAQAKAARQAAAKAE

SEQ ID NO: 19188 - protein, 465 aa, Bradyrhizobium japonicum USDA 110
MTEITCQLLVVGAGPGGYVCAIRAGQLGLDTVLVERGKLGGSCLNVGCIPSKAMIHVAEEFEKLVEAADGKTPFGLTAAQPALDFKQAIAWKDGIVHRLNNGVAALLRKAKVKIVQGHGRFRDGKTIVVETETGPKTIKAETVVIATGSAPVELPTLPFGGRVISSTGALSLAEVPKSLVVVGGGYIGLELGTAFAKLGSKVAVVEAQDNILPLYDVELTAPIARRLTALGVEVLTGARALGLTAQGDGLRVETPDGQERSLTADKILVTVGRTPVTEALGLEQLVLDMDGRFIRIGQHCETSMRGIYAIGDVTGEPMLAHRAMAQGEMVAEIAAGMPRAWDKCCIPAICFTDPEIVSAGLSPDEARRAGINIKVGQFPFAANGRAMTRHGEPGFVRVVARADNQRVLGIQALGQGVSELSAAFGLAIEMGAVLQDIAGTIHAHPTLGEAIQEAAFKALGHAIHV

SEQ ID NO: 19189 - protein, 169 aa, Triticum aestivum
MAALQPSFSSLMAMNNSCNTMKFPKTALLPGFGGISRPQDVQDRNASLTCSRPKAVSVTDQSVAEPAKPRQTKHTVDPAAPEFLPLPAFEDCFPRSTKECSEVVHEETGHALKVPFRRVHLTGDSGHFDTYDTSGPLTTDIAPGYDHITSAIGAANIGALGTALLCYVT

SEQ ID NO: 19190 - protein, 195 aa, Glycine max
  misc_feature (93)..(93): Xaa can be any naturally occurring amino acid
  unsure (1)..(195): unsure at all Xaa locations
MASEQELKLPLSLWVDKERNRVVVAEANGDLIDILFGFLTLPMGTITRLVSKKQGHDEAQKIGCIKNLYHSVENFRDEVFWNHICKRMLLFPXNSCEALCQKQKLKVDDTEPTKYFMCSNKCQKDGYLFLSTFAETSCYCGKLMDKERMLNEDSNEGTRGDGVFVKWKIMYLIFDDLKVLPSSPGNTVQQLVQLG

SEQ ID NO: 19191 - protein, 428 aa, Solibacter usitatus Ellin6076
MQPSLEKIHRVVIVGGGFGGLYAAKSLARAPVTLTVIDRRNFHLFQPLLYQVATGALSPGEIASPLRVVLQGNRNTEVLLGEVMDLDVAGRRVILRDGEARYDDLVIATGATHHYFGNDQWAALAPGLKTVEDATEIRSRILVAFERAEREHDPVERRAWLNFVIVGGGPTGVELAGALGEIANDTLRHDFRHIDPRESHIVLVEGEPRVLPSFPPDLSAKAENQLIQLGVLTRTAARVTAIDAGGVTVKTGEKEERIETHTVLWAAGVRASRLGKVLAERAGAQLDRAGRVIVEPDLSVPGHPEIFVIGDLASYTPDGGKPLPGVAPVAMQEGRYVARLIRARVSGGAKPGPFHYFNKGNLATVGRNKAVAEFGKLHIAGFLAWFTWVFVHLMYLVEFENRVLVLMEWVHNYITRNRGARLITGGKP

SEQ ID NO: 19192 - protein, 377 aa, Brassica napus
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDFEQELETAKSSSSVEKNYELPDGQVITIGAERFRCPEVLFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 19193 - protein, 532 aa, Cryptococcus neoformans var. neoformans JEC21
MSTRPPTSPDAVDANKKQKTVQVNKKVCLIVHDGWGLSTEEKGNAIFHGDTTHMDAIRDKHNFVELEAHGLAVGLKEGLMGNSEVGHLNIGAGRIVWQDIVKIDQSIKKDEFKDQPAIVDAMKHAKETSGRLHLLGLISDGGVHSHIQHLFALLRVAKSYGIANVYIHFFGDGRDTAPKSATKYIKQLQDYIKEVGVGEISTVIGRYYAMDRDKRWDRIKIAVDGLVKGEGEKTDQEGLIKTVEDGYEKDVTDEFIKPIISGSEDSRIKKGDSLYLFNYRSDRMRELAQVLGLPDKPMEVDVPEDLHITTMSRYNIEFPFPVAFPPQAMTNVLAEWLAKQGVKQCHIAETEKYAHVTFFFNGGVEKQFENEKREMIPSPKVATYDKQPEMSVQGVADKVAETVKSDKYEFVMCNFAPPDMVGHTGDYDAAVKAITATDAAVKTVYDACEEAGYVLCVTADHGNAEQMLDPETGNPHTAHTTNHVPFIVTGDKGSLEVSEEPGALADVAPTILDILGLPKPEEMSGRSLLSKK

SEQ ID NO: 19194 - protein, 340 aa, Chlamydia muridarum Nigg
MHPLTYNIASEETTEAQVSFVIENFGNDFCINLLKKMLLIREFEIRGEEAYLEGLVGGFYHSYIGQESVATAALACTGTDHWFFSSYRCHGVAILLDIPLRQLAAELLGKETGCALGRGGSMHMCGDRLPGGFGIVGGQIPLAAGAAFSMKYQKLPSISLCFIGDGAVAQGVFHETLNFASLHTLPLMLIIENNGWGMGTALHRAIAKQPIAESQASSYGLSSITLNGFDLFNSLIGFKEAYQHMQKTGAPVVVEALCSRFRGHSISDPNLYRSKEEMQCLLKRDPILFAKEWLIRANVLSEDDFKDLRQTSKEAVLEAFSQARLDPEPAVATLEEGIYA

SEQ ID NO: 19195 - protein, 328 aa, Chlamydia muridarum Nigg
MPNFVTLEIREAIRQAIDEEMTRDPNVCILGEEVAEYNGAYKVTKNLLDKWGPTRVIDTPISEAAFSGIGIGAALTGLRPIIEFMSWNFSLVAADQIISHAAKMHYMTGGKFSVPIVFRGANGAAAQVSCQHSHCVEALYANIPGLIIIAPSTPADAKGLLKAAIRDNNPVLFLENELDYNLKGEVPTEEYLVPIGKAHIVQEGLDLTIISHSRMVTIVELAAKIAKQRWGFSIEILDLRTIKPLDIAAILTSVKKTGNCLVVEEGHYFCGISAEIIATITEHIFDHLDHPPLRVCQKETPMPYSKTLETATLPNVNRILDAIEKIMR

SEQ ID NO: 19196 - protein, 428 aa, Chlamydia muridarum Nigg
MVSLLKMPKLSPTMETGTLVKWHKQAGDEVHFGDVLLEISTDKAVLEHTASEDGWLLQILVKEGTKIPIGTPIAVFSTEQNAEYDLKQLLPLEEASGANEPTEILPQTSPQNDSHYSGPSMAIVGFRPEPPLTTPLSVKYSGDKVAASPLAKKLAKEQNLDLSGVAGSGPGGRIVKKDLEKAPPLRIAGFGYPEAPDVNPGSYVEESLSPIRESISKRLQAAKTFIPHFYVRQRIYASPLLALLKELQVQNIKLSINDCIVRACALALKEFPEINSGFNSVDNTIIRFSTIDISIAVAIPDGVITPIIRCADRKNVGTISAEIKGLAARARQFSLKEEEYKGGSFCISNLGMTGISDFTAILNPPQAAILAVGSVEEQPVVLNGELAVGSTCMLTLSVDHRVIDGYPAAMFMKRLQKLLEAPSVLLLN

SEQ ID NO: 19197 - protein, 333 aa, Pseudomonas aeruginosa UCBPP-PA14
MNERNGEAKRLALLEAVNLALHRAMAEDEAVVVLGEDVGVNGGVFRATLGLRERFGFKRVLDTPLAENMIAGLSIGMAAQGLKPVMEIQFMGFIYAAMEQLVSHASRLRNRTRGRLACPLVLRTPMGAGIRAPEHHSEATEAMFAHIPGVRVLVPSSPARAYGLLLAAIDDPDPVIFLEPTRLYRMNPQPLADDARRLPLDSCFTLREGGDLTLVSWGASVHETLQAAERLAQRGIEAEVIDVACLKPLDLDTLEASVRKTGRCVIVHEAPKSGGLGGEIAASLYERVLFDLRAPIQRVAAADIPPPLYRLEPLYMPAVEDILAACDTVLGYA

SEQ ID NO: 19198 - protein, 279 aa, Mycoplasma genitalium G37
MKYLYATQHLTLNAIKHAKGGHVGMAIGASPILFSLFTKHFHFDPDQPKWINRDRFVLSAGHGSMALYSIFHFAGLISKQEILQHKHGQINTSSHPEYAPNNFIDASTGPLGQGFGMAVGMVLAQKLLANEFKELSDKLFDHYTYVVVGDGDLQEGVSYEVSQIAGLYKLNKLIVLHDSNRVQMDSEVKKVANENLKVRFENVGWNYIHTDDQLENIDQAIIKAKQSDKPTFIEVRTTIAKNTHLEDQYGGHWFIPNEVDFQLFEKRTNTNFNFFNLSR

SEQ ID NO: 19199 - protein, 287 aa, Mycoplasma genitalium G37
MYCLNADVSRSCFIKIGDDNLHENPCSRNIQIGIREFAMATIMNGMALHGGIKVMGGTFLAFADYSKPAIRLGALMNLPVFYVYTHDSYQVGGDGPTHQPYDQLPMLRAIENVCVFRPCDEKETCAGFNYGLLSQDQTTVLVLTRQPLKSIDNTDSLKTLKGGYILLDRKQPDLIIAASGSEVQLAIEFEKVLTKQNVKVRILSVPNITLLLKQDEKYLKSLFDANSSLITIEASSSYEWFCFKKYVKNHAHLGAFSFGESDDGDKVYQQKGFNLERLMKIFTSLRN

SEQ ID NO: 19200 - protein, 179 aa, Methanopyrus kandleri AV19
MIAVLVDDGFEELELGAVVSVLSRGGLDWDLVGVEERAEGMGGMEVGVDSTVWDVEGDDYEGVVVLGGSAPTTLIGYRHCLDLVRSVESDGGMVVGLSSGALVLAEAGVLRGRKATTYPGFEAELKVNGAEPVPKGVVRDGNVVTSRGPAFAIDACLEVVRELCGDHMANSVARQLILK

SEQ ID NO: 19201 - protein, 431 aa, Thiobacillus denitrificans ATCC 25259
MKKTVTLTFSDGSPAIELPIEEGTYGKPVIDIRALGAHGYFTHDPGFTATSSCTSSITYIDGDEGLLYYRGYPIDQLAYQSDFMEVSYLLLHGELPTAEQKAGFEQSIRHHTLLHDQIENVFRGFRRSAHPMAVMIGVTGAMSAFYHAGLDNFNPEHREIVAHRLIAKIPTVAAWAYKFNEGQPFVYPQNRLSYAENFMYMMFSSPCEEYVPNPVLARALDRIFILHADHEQNASTSTVRLAGSSGANPYACIASGMASLWGPLHGGANEAVLRMLEEIDDASKIPDFIKRAKDKSDPFRLMGFGHRVYKNMDPRAAIIRRTCYEVLDELGLRDDPQFKIALELERIALEDEYFIERKLYPNVDFYSGIIFRAMGIPTSMFTALFAMARTAGWVAQWHEMLSDPAHKIGRPRQLYAGPARRDFVPLDQRRA

SEQ ID NO: 19202 - protein, 449 aa, Bacillus cereus G9241
MFFTQFFKPAPHAERLPADRIDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFADDWKSIFYFPGILSILVGIYVLITMKDTPQSCGLPSIEEHTGEYPPDEKVKDRERELSVKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSAKQKQA

SEQ ID NO: 19203 - protein, 89 aa, Prochlorococcus marinus str. NATL1A
MNSEPINQESSTRICNHMNKDHEDAVNAYAKYYGKIKTFKSAKMISLSPEAVQIKIDEETLEIKFDHILQDCSDAHKTLVRMIKAIPKL

SEQ ID NO: 19204 - protein, 317 aa, Prochlorococcus marinus str. MIT 9313
MKQTILDVDLLAFEQGTRFQQAAVVDGLMRSLGTGFVVTTSDLPSALLDEAYGMLNRFFALEATTKRQFNVPEAFGQTGYTDTLVETAAGEKLPDWKEMLNWAFPLPDNHPLRQRFPTLYPEQLLPEVAVPGITRVLQTFHQTIAELQCRVLRIIATGLGCHNDFFTDLVQDAPTLTRAIRYPPMSEAPAAGHMWAAAHGDINLITALPRATAPGLQVYIDGSWVDAIAPEGQVIVNSGLMLERISNGLIPTGWHRVLAPSQANLERLSVVQFCHPKPSTLLTPLSNCVNESHPQRFAGVMAADALEEVLYKIKLMA

SEQ ID NO: 19205 - protein, 395 aa, Acinetobacter sp. ADP1
MNFKRMTDLDLSEKRVLIREDLNVPVKNGQITSDARLRAALPTIQAALAQGAAVMVCSHLGRPVEGEPKPEQSLAPVAAYLSDALGQEVKLLTDYLEGVEIAPGQVVLLENVRFNLGEKKNNAELAQKYAALCDVFVMDAFGTAHRAEASTEGAARYAKVAAAGPLLATELDALGRALQTPEKPMVAIVAGSKVSTKLDVLTSLSDICGQLIVGGGIANTFLAAAGFNVGKSLCENDLIDTAKAIAAKVSVPLPTDVVVADATEIDFADFLGSLAKAQAIVKKVEDIADNDMILDVGPDTAKAFAEILKTAKTILWNGPVGVFEVDQFGEGTKTLSLAIAESKGFSIAGGGDTLAAIDKYKVADKIGYISTGGGAFLEFVEGKTLPAVAVLLERA

SEQ ID NO: 19206 - protein, 193 aa, Triticum aestivum
  misc_feature (117)..(117): Xaa can be any naturally occurring amino acid
  unsure (1)..(193): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLRFKQVGSSSREHNASLGYYDGRYWDMWXLPISGAPTHTSVNEVEESRRIPDAYSASSDRHIASACVSSCLNHGLKIRKANSYHTGIINAFSLHPKCLVPLLLMS

SEQ ID NO: 19207 - protein, 175 aa, Triticum aestivum
MAPTVMASSATSVAPFQGLKSTAGLPVSRRSNGASLGSVSNGGRIRCMQVWPIEGIKKCETLSYLPPLSTEALLKQVDYLIRSKWVPCLEFSKVGFIFREHKASPGYYDGRYWTMCKLPMFGCTDATQVINEVEDVKKEYPDAYVRIIGFDNMRQVQCVSFIGFKPPGCEESGKA

SEQ ID NO: 19208 - protein, 346 aa, Prochlorococcus marinus str. MIT 9313
MTGTNPVHSNEPEVICLGEALVDRLGPLGGDPAVDQPVEDCLGGAPANVACGLARLGSKVAFLGRLGDDAIGARFRELFNTRGVNLAGLQIDQRRPSRIVLVRRDLDGERVFQGFAGDRGDGFADPALSLDELAASWPLLVGKASWLLIGSIPLATPASAQALLWCVEQAQTAGLEIALDVNWRPTFWDPGHSPDSGPDEKALQAIAPLLERASLLKLAREEAVWFFDTDDPAVIARSLPQQPDVVVTDGARPVRWWIGGCVGELAALSPPSVVDTTGAGDAFTAGLLHQFLMDASSQRDLIKAREMVRFAAACGALVCGGAGGIDPQPSQMQVEEFLGSFEGEVN

SEQ ID NO: 19209 - protein, 298 aa, Bacillus cereus G9241
MPNIAVVGSISMDLVAVSKKRPKAGETVIGEAFHTIPGGKGANQAVAAARLGANVAMIGAVGNDNYGTVVRKNLENERVFIDYVVPVTDAVTGIAHIVLAEEDNSIVVVQGANALVNEPVVDRSKDLLTKADMVVLQLEIPLETVKYVLAICEEHKIPVMLNPAPAQVLSEDILEKATYITPNEHECRIVLDDFTSPIEELLAKYPNKLLMTEGSNGVRFHNGTEIVHVPSIAVDVVDTTGAGDTFNGALAVALSEGETLQKAIRFANIAGGLSVTKLGAQGGMPTRDKVREVQVIVG

SEQ ID NO: 19210 - protein, 372 aa, Salmonella enterica subsp. enterica serovar Paratyphi A str.
MKYGLIIIGSGSVGAAAGYYATRAGLKVLMTDAHMPPHQQGSHHGDTRLIRHAYGEGEKYVPLVLRAQTLWDELSTHNEEPIFVRSGVVNLGPADSAFLANVARSTQQWQLNVERLDATALMTRWPEIRVPDNYIGLFEADSGFLRSELAITTWLRLAREAGCAQLFNSPVSHIHHDDNGVTIETSEGCYHASKALISAGTWVKTLVPELPVQPVRKVFAWFKADGRYSTKNRFPAFTGEMPNGDHYYGFPAENDELKIGKHNGGQRIQAPEERKPFAAVASDGAEAFPFLRNVLPGIGGCLHGAACTYDNSPDEDFIIDTLPGHENTLVITGLSGHGFKFAPVLGEIAADFALGKTPSFDLTPFRLSRFSQ

SEQ ID NO: 19211 - protein, 475 aa, Vibrio parahaemolyticus
MSKEIKAQVVVLGSGPAGYSAAFRCADLGLETVLVERYSTLGGVCLNVGCIPSKALLHVSKVIEEAKAMADHGVVFGEPQTDINKIRIWKEKVVNQLTGGLSGMAKMRNVTVVNGYGKFTGPNSILVEGEGESTVVNFDNAIVAAGSRPIKLPFIPHEDSRIWDSTDALELKEVPEKLLIMGGGIIGLEMGTVYHSLGSKVEVVEMFDQVIPAADKDIVKVYTKRIKDKFKLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGIKYEVATFPWAASGRAIASDCSDGMTKLIFDKETHRVIGGAIVGTNGGELLGEIGLAIEMGCDAEDIALTIHAHPTLHESVGLAAEVFEGSITDLPNKKAVKKK

SEQ ID NO: 19212 - protein, 246 aa, Deinococcus radiodurans R1
MDLSQARAALKAARRVAVLTGAGISAESGIPTFRDAQTGHWARFRPEDLASPDAYRRDPDLVWEWYAGRYRDVLAAQPNRGHELLAELERRKGPGFFLATQNVDGLHARAGSGSAGGELVELHGNLLQARDELTGEVFPLAAPDELTLPPLSPNGQRMRPHIVWFGEYLPVDALDAAQRAFAGAEVALVIGTSSVVYPAAGLAAETLRRGGAVIEINPEATDLTPDATFSLRESASRGLELLLEDD

SEQ ID NO: 19213 - protein, 128 aa, Triticum aestivum
MGSLMAGWSSHALDDDLKARFMRNRSLTKEEVEAFWRQHKKPAPEDNVDGGETVVASSPRGRSTLFHVRSSPPALTSTSSVDGDGEAAASPSASRDWWTRSSWAFLNEPPPQQRREGAGVGQGAAAAV

SEQ ID NO: 19214 - protein, 313 aa, Triticum aestivum
MDSSKSPQPLKKSRTSLSGTDGHQFENDELPSETASDKTPGLKFETVDKAQDEFGEDSSPLQQSAASNVSYRGSPCIGAFTIQCARCFKWRLIPTKEKYEEIREHIIQEPFDCERAREWKPDVTCDDQEDISQDGSRLWAIDKPNIAQPPAGWERQIRIRGEGGTKFADVYYTSPTARKLRSLVEVDRYLQENPEYGAQGVTLAQFSFQIPRPLRQNYVKKRPKNASPSDEATTKPLQPVEVNPISWAAPLASEAKASEPASHADEKPVGSADVELVRKRKAEPGESDANNHVSDGPETKLEDAQNGDATTTA

SEQ ID NO: 19215 - protein, 442 aa, Streptomyces clavuligerus
MPGSGLEALDRATLIHPTLSGNTAERIVLTSGSGSRVRDTDGREYLDASAVLGVTQVGHGRAELARVAAEQMARLEYFHTWGTISNDRAVELAARLVGLSPEPLTRVYFTSGGAEGNEIALRMARLYHHRRGESARTWILSRRSAYHGVGYGSGGVTGFPAYHQGFGPSLPDVDFLTPPQPYRRELFAGSDVTDFCLAELRETIDRIGPERIAAMIGEPIMGAVGAAAPPADYWPRVAELLHSYGILLISDEVITGYGRTGHWFAADHFGVVPDIMVTAKGITSGYVPHGAVLTTEAVADEVVGDQGFPAGFTYSGHATACAVALANLDIIERENLLDNASTVGAYLGKRLAELSDLPIVGDVRQTGLMLGVELVADRGTREPLPGAAVAEALRERAGILLRANGNALIVNPPLIFTQEDADELVAGLRSVLARTRPDGRVL

SEQ ID NO: 19216 - protein, 639 aa, Oryza sativa (japonica cultivar-group)
MAALQPSFSSAMAMKSLKLPKTAVLPGFGGIARPQDVQDRSANFTCSRPRAASVTDQSTAEPAKPRQNKHTVDPSAPEFLPLPSFEECFPRSTKESREIVHEESGHVLKIPFRRIHLTGDEKHFDTYDTSGPQNISPRIGLPKIRKEWIDRREKLGGPRYTQMYYAKQGIITEEMLYCATRENLSPEFVRSEVARGRAIIPSNKRHLELEPMIVGRNFLVKVNANIGNSAVVSSIEEEVHKLQWATMWGADTVMDLSTGRHIHETREWILRNSSVPIGTVPIYQALEKVNGIAENLSWEVFRDTLIEQAEQGVDYFTIHAGVLLRYIPLTAKRMTGIVSRGGSIHAKWCLTYHKENFAYEHWDEILDICNQYDVALSIGDGLRPGSIYDANDSAQFAELLTQGELTRRAWAKDVQVMNEGPGHIPMHKIPENMEKQLEWCNEAPFYTLGPLTTDIAPGYDHITSAIGAANIGALGTALLCYVTPKEHLGLPNRDDVKTGVISYKISAHAADLAKGHPYAQAWDDTLSKARFEFRWLDQFALSLDPVTAMSFHDETLPSEGAKVAHFCSMCGPKFCSMKITEDIRKYADEHGYGTVEEAVIQGMNAMSAEFSAARKTISGEQHGEAGGEIYVPESYTARK

SEQ ID NO: 19217 - protein, 286 aa, Oryza sativa (japonica cultivar-group)
MSCGSDGGCRDGGGSEEFRRPRPSKVAAGDLVEPARCSDAAASPASWIDKKLLVDPKNLFIGSKIGEGAHGKVYKGKYGEQIVAIKVLNNGTTPEEKATLEARFIREVNMMCKVKHDNLVKFIGACKEPLMVIVSELLPGMSLKNYLNSLRPSQLDIHTAIGYALDIAHAMECLHANGIIHRDLKPDNLLLTANRKKLKLTDFGLAREETVTEMMTAETGTYRWMAPELYSTVTLQRGEKKHYTNKVDVYSFGIVLWELLTNKMPFEGMSNLQAAYAAAFKVSVKQ

SEQ ID NO: 19218 - protein, 171 aa, Glycine max
  misc_feature (37)..(37): Xaa can be any naturally occurring amino acid
  misc_feature (107)..(107): Xaa can be any naturally occurring amino acid
  misc_feature (115)..(115): Xaa can be any naturally occurring amino acid
  misc_feature (124)..(124): Xaa can be any naturally occurring amino acid
  misc_feature (142)..(142): Xaa can be any naturally occurring amino acid
  misc_feature (151)..(151): Xaa can be any naturally occurring amino acid
  misc_feature (163)..(163): Xaa can be any naturally occurring amino acid
  unsure (1)..(171): unsure at all Xaa locations
TVVSHLAQVLRGITFDKVRYSSLCDLQDKLHQNISRXRRTLVAIGTHDLDKLEGPFTYEALPPSSITFTPLKQERNFRADELMEFYKSDLKLKKFLHIIEDSPGFPXIYDSKKTXLSLPPIINXAHSAITLETKNVFIECTXTDLTKAKIXLNTMVTAFSEYXETNLSLTS

SEQ ID NO: 19219 - protein, 260 aa, Thermococcus kodakarensis KOD1
MEIYKAKFGNPERGWVVLVHGLGEHSGRYGKLISMLNEAGFAVYTFDWPGHGKSPGKRGHTSVEEAMEIIDSIIKELGEKPFLFGHSLGGLTVIRYAETRPDKIRGVVASSPALAKSPKTPGFMVALAKVLGRIAPGLTLSNGIDPNLLSRNPDAVKRYIEDPLVHDRISTKLGMSIFKNMELAHREADRIEVPILLLVGTGDVITPPEGSRKLFEELKVKDKEIREFEGAYHEIFEDPEWGEEFHKTIVEWLIKHSEKA

SEQ ID NO: 19220 - protein, 316 aa, Bradyrhizobium japonicum USDA 110
MSTSANIGDLANVSSGAKPVHVICLGLSALDQVWRVDRPFSGGSEKIKAVAYGTLGGGMAANASVAVAKLGASVAFWGRAGNDAAGHEMKSAFTAEGVDVENFRLFADGRSSVSGIIVDSSGERQIVNFRGLFPEAANWLPLDAVARASAVLADPRWVEGAATLFCEARSRGIPTVLDGDMADAEVFERLLPLTDHAIFSEPALTAFAGSADDKSLAALARFGCRVIAVTRGEGGVSWYEDSELHRQAAFSVDVVDTTGAGDVFHGAYTLAIAAGLDVRAAMMFSAATAAMKCRHAGGRNGIPTINECLVFMRTKP

SEQ ID NO: 19221 - protein, 214 aa, Thermosynechococcus elongatus BP-1
MPATALSLPLDEIRYDERGLVPAIVQDYLDGTVLMLAWMNRESLQKTLETGRTWFWSRSRQELWPKGETSGHVQWVKSIRYDCDSDALLLTVEQVGHIACHTGERSCFHRHGAKGESIEPPPADTLSQVYNIVCQRRDFPQLQSYTSSLFTAGDNKILKKLGEETAEVVMACKDDDPEAIASEVADLFYHTLVALAYHRVSLRQVYEQLQLRRR

SEQ ID NO: 19222 - protein, 861 aa, Solanum tuberosum
MIGQITSGLFGGHDDSKKVKGTVVMMNKNVLDFTDLASSLTGKIFDVLGQKVSFQLISSVQGDPTNGLQGKHSNPAYLENSLFTLTPLTAGSETAFGVTFDWNEEFGVPGAFIIKNMHITEFFLKSLTLEDVPNHGKVHFVCNSWVYPSLNYKSDRIFFANQPYLPSDTPELLRKYRENELLTLRGDGTGKREAWDRIYDYDIYNDLGNPDQGKENVRTTLGGSAEYPYPRRGRTGRPPTRTDPKSESRIPLILSTDIYVPRDERFGHLKMSDFLTYALKSIVQFILPELHALFDGTPNEFDSFEDVLRLYEGGIKLPQGPLFKALTAAIPLEMIRELLRTDGEGILRFPTPLVIKDSKTAWRTDEEFAREMLAGTNPVIISRLQEFPPKSKLDPEAYGNQNSTITAEHIEDKLDGLTVDEAMNNNKLFILNHHDLLIPYLRRINTTITKTYASRTLLFLQDNGSLKPLAIELSLPHPDGDQFGVTSKVYTPSDQGVESSIWQLAKAYVAVNDSGVHQLISHWLNTHAVIEPFVIATNRQLSVLHPIHKLLYPHFRDTMNINALARQILINAAGVFESTVFQSKFALEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMETPQELIDSCTTIIWIASALHAAVNFGQYPYAGYLPNRATVSRRFMPEPGTPEYEELKKNPDKAFLKTITAQLQTLLGVSLVEILSRHTTDEIYLGQRESPEWTKDKEPLAAFDRFGKKLTDIEKQIIQRNGDNILTNRSGPVNAPYTLLFPTSEGGLTGKGIPNSVSI

SEQ ID NO: 19223 - protein, 860 aa, Solanum tuberosum
MLGQIVGGLIGGHHDSKKVKGTVVMMKKNALDFTDLAGSLTDKIFEALGQKVSFQLISSVQSDPANGLQGKHSNPAYLENFLFTLTPLAAGETAFGVTFDWNEEFGVPGAFIIKNTHINEFFLKSLTLEDVPNHGKVHFVCNSWVYPSFRYKSDRIFFANQPYLPSETPELLRKYRENELLTLRGDGTGKREAWDRIYDYDVYNDLGNPDQGKENVRTTLGGSADYPYPRRGRTGRPPTRTDPKSESRIPLILSLDIYVPRDERFGHLKMSDFLTYALKSIVQFILPELHALFDGTPNEFDSFEDVLRLYEGGIRLPQGPLFKALTDAIPLEMIRELLRTDGEGILRFPTPLVIKDSKTAWRTDEEFAREMLAGVNPIIISRLQEFPPKSKLDPEAYGNQNSTITAEHIEDKLDGLTVDEAMNNNKLFILNHHDVLIPYLRRINTTTTKTYASRTLLFLQDNGSLKPLAIELSLPHPDGDQFGVTSKVYTPSDQGVESSIWQLAKAYVAVNDSGVHQLISHWLNTHAVIEPFVIATNRQLSVLHPIHKLLYPHFRDTMNINAMARQILINAGGVLESTVFPSKFAMEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMETPQELIDSCTTIIWIASALHAAVNFGQYPYAGYLPNRPTVSRRFMPEPGTPEYEELKKNPDKAFLKTITAQLQTLLGVSLIEILSRHTTDEIYLGQRESPEWTKDKEPLAAFDKFGKKLTDIEKQIIQRNGDNILINRSGPVNAPYTLLFPTSEGGLTGKGIPNSVSI

SEQ ID NO: 19224 - protein, 862 aa, Solanum tuberosum
MLLEKIVEAISGRSEDNGKKVKGTIVLMKKNVLDFNDVNASLLDGVLEFLGKRVSLQLISVVHADPGNSLQGKRSNPAYLEKWLTTGTSLVAGESAFDVTFDWDEDIGVPGAFIINNFHFNEFYLKSLTLEDVPNHGNVHFVCNSWVYPAKKYKSERIFFANQAYLPGETPEPLRNYREKELVNLRGNGNGKLEEWDRVYDYALYNDLGDPEKGKQYARTILGGSAEYPYPRRGRTGRKPTKADPKSESRIPLLMSLDIYVPRDERFGHIKLSDFLTYALKSIVQFLIPEFQALFDSTPDEFDSFEDVLKLYEGGIKLPQGPFLKALTDSIPLEILKEIIRTDGEGKFKFPTPQVIQEDKSSWRTDEEFAREMLAGVNPVIISRLQEFPPKSQLDSEVYGNQNSTITKEHIENTLDGLTIDDAIKTNRLYILNHHDILMPYVRRINTTNTKLYASRTLLFLQDDGTMKPVAIELSLPHPDGDELGAVSKVYTPADQGVEGSIWQLAKAYVAVNDSGVHQLISHWLNTHAAIEPFVIATNRQLSVLHPIHKLLHPHFRDTMNINALARQILINAGGVLEMTVFPAKYAMEMSAVVYKSWVFPEQALPADLIKRGVAVEDSSSPHGVRLLIQDYPYAVDGLEIWSAIKSWVTEYCNFYYKSDELVLKDNELQAWWKELREEGHGDKKDEPWWPKMQTRQELKDSCTIIIWIASALHAAVNFGQYPYAGYLPNRPTLSRRFMPEPGTPEYEELKTNPDKAYLKTITPQLQTLLGISLIEILSRHASDEIYLGQRDSSEWTKDQEPIAAFERFGKKLSEIEDQIIQMNGDKKWKNRSGPVNVPYTLLFPTSEQGLTGKGIPNSVSI

SEQ ID NO: 19225 - protein, 502 aa, Ralstonia solanacearum GMI1000
MAQLLTVSEYAAMAGKLALPTQAFIDGAFVPAVSGKTFQTTNPATGNVLAEIAACDTRDVDIAVAKAKAAFEDGRWHRRSPAQRKATLLRLADLLEQHAHELAVMESLDSGKPIRECQATDVPETIHTIRWHAELIDKIYDSTAPVGSNALSLVVREPIGVVGLVLPWNFPLLMLAWKIGPSLAAGCSIIVKPAKETSLTALRVAELAHEAGVPAGVFNVLPGGGKEVGEPLGRHMDVSMVSFTGSTDTGRLFLKYAADSNLKRIVLECGGKNPAVVMNDVDDLDAVAQHVVNGAFWNMGENCSASSRLIVHADVKDALLARIGVHMREWKMGNPLDPEHRVGSLVSESHFRKVRSYLEHAGAEQLRVAFGGGTEGGIFVEPTVVDGVGQGSLLFREEIFGPILSVTTFTRMEDAIALANDSVYGLAASVYTDSLNNAIRLSREIRAGVVTVNCFGEGDVTTPFGGYKESGFGGRDKSIWAHDQYTEIKTIWIDVPDCTAAK

SEQ ID NO: 19226 - protein, 70 aa, Brassica napus
  misc_feature (26)..(26): Xaa can be any naturally occurring amino acid
  misc_feature (36)..(36): Xaa can be any naturally occurring amino acid
  unsure (1)..(70): unsure at all Xaa locations
FGWGSRQCVGERDALNHLVLFIAMFXSTLLDYKRLXSDGCDEIVYCLTISPKDGCTVFLSRRVAAYPYLT

SEQ ID NO: 19227 - protein, 571 aa, Oryza sativa (japonica cultivar-group)
MPLHVRIREKTSIASLLSSRRNWSGGGVDGGKKSGKREGAKTKGTRTTGRNKSEKREEHKEARGNAGQRRRWSDTNGQSDAKKNASQAVRRKRKGDHDSWNGDHSDTPYSKSKLTRNGPSTMTRGKASARKGDRFRSETLDEDDLHSRKRGNSMVSSVSRGGRSNSMVSGITREGKSQSVFSRNAEASSKGKKFDTPTRVSRQKEAATDANLDDHGAESKKSDDSGQIADEKPRPRRTRVLDKTGKKIRVANKDPVSDIEETLPPKKRKRMKLDPYDTSNKRLEDSTAKQDVCSPEKIPEKSPPEETETSINAKFRAIQPSSSIISYVEDNLLGRRRLNEIKNAGYNVKLSAPLDNVPFSTSPERERIEENVFRNKLEFFAAAKISSSFPPPTLPEIAFAGVSNVGKSSLLNALTRQWGVVRTSDKPGLTQTINFFRLASKLCLVDLPGYGFAYAKDEVKDSWQELVKEYVSTRVGLERVCLLVHTKRGMKPLDYELVDLMERSKTPYQIVLTKTDLVFPIDVARRAVEIQESLKKNKSVVRPVMMVSSKTGAGVRNLRGVLGKIARFIKP

SEQ ID NO: 19228 - protein, 923 aa, Mycobacterium bovis AF2122/97
MSFVVTAPPVLASAASDLGGIASMISEANAMAAVRTTALAPAAADEVSAAIAALFSSYARDYQTLSVQVTAFHVQFAQTLTNAGQLYAVVDVGNGVLLKTEQQVLGVINAPTQTLVGRPLIGDGTHGAPGTGQNGGAGGILWGNGGNGGSGAPGQPGGRGGDAGLFGHGGHGGVGGPGIAGAAGTAGLPGGNGANGGSGGIGGAGGAGGNGGLLFGNGGAGGQGGSGGLGGSGGTGGAGMAAGPAGGTGGIGGIGGIGGAGGVGGHGSALFGHGGINGDGGTGGMGGQGGAGGNGWAAEGITVGIGEQGGQGGDGGAGGAGGIGGSAGGIGGSQGAGGHGGDGGQGGAGGSGGVGGGGAGAGGDGGAGGIGGTGGNGSIGGAAGNGGNGGRGGAGGMATAGSDGGNGGGGGNGGVGVGSAGGAGGTGGDGGAAGAGGAPGHGYFQQPAPQGLPIGTGGTGGEGGAGGAGGDGGQGDIGFDGGRGGDGGPGGGGGAGGDGSGTFNAQANNGGDGGAGGVGGAGGTGGTGGVGADGGRGGDSGRGGDGGNAGHGGAAQFSGRGAYGGEGGSGGAGGNAGGAGTGGTAGSGGAGGFGGNGADGGNGGNGGNGGFGGINGTFGTNGAGGTGGLGTLLGGHNGNIGLNGATGGIGSTTLTNATVPLQLVNTTEPVVFISLNGGQMVPVLLDTGSTGLVMDSQFLTQNFGPVIGTGTAGYAGGLTYNYNTYSTTVDFGNGLLTLPTSVNVVTSSSPGTLGNFLSRSGAVGVLGIGPNNGFPGTSSIVTAMPGLLNNGVLIDESAGILQFGPNTLTGGITISGAPISTVAVQIDNGPLQQAPVMFDSGGINGTIPSALASLPSGGFVPAGTTISVYTSDGQTLLYSYTTTATNTPFVTSGGVMNTGHVPFAQQPIYVSYSPTAIGTTTFN

SEQ ID NO: 19229 - protein, 215 aa, Methanopyrus kandleri AV19
MIIATLTGRTIEDMVELAIEAVEQGADALEVRLDYLENLDMSTALRAVRECTRYERVVATLRREEEGGLYKGDEDRRLEILERVSSEADYVDLELDVAEEEIISPSCETIVSYHNFENTPPKEELIGIRDRCAELGDVAKVVTMARGHEDALRILEVVRTAEAPTIGFAMGEEAKYTRVVSVLIGGFATYAAVRKKAAPGQLTVEETRKLLELLG

SEQ ID NO: 19230 - protein, 660 aa, Thermosynechococcus elongatus BP-1
MCGLTGFWQPCGCPTDEVSATIQRMADTLVHRGPDDVGVWVDTEVGIALGHRRLAILDLSPAGHQPMVSATGRYVIAFNGEIYNHLELREELSKVGAGGTAPVWRGHSDTETLLAAFAALGIEKTLKRVVGMFAIALWDRETRTLTLARDRMGEKPLYYGWVRDALVFGSELKALRAYPGFDNAIERRSLALFMRYDYIPAPWSIYENIWKLPPGCFVQFRAASHGGEPLAVGSRGNIKPYWSVRDVAERGLANPFTGREADAVEELERLLRQSIAGQMMADVPLGAFLSGGIDSSTVVALMQAQSSRAVKTFTIGFHEQDYNEAKHAKAVACHLRTNHTELYVTPQEAMAVIPKLPSLYDEPFADSSQIPTFLLAQLARQQVTVSLSGDGGDELFGGYTRYFLTHSLWQRLAWIPLPMRKLAEQGVLAISPQTWNRVFALLAPVLPERLRFRLPGDKLHKAAALFVTRRPEDIYLRFVSHWHDPTSLVIGTEEPRTALTEPATVLEGADFEARMMYLDSITYLPDDILVKVDRAAMGVSLETRVPLLDHRIVEFAWQLPHYFKIRRGQSKWLLRQVLYRYVPKELIERPKMGFGIPLDQWLRGPLREWAEDLLSEERLKREAFLNPELVRQKWQEHLLGRRNWAYHLWNVLMWEAWLAA

SEQ ID NO: 19231 - protein, 483 aa, Prochlorococcus marinus str. NATL1A
MPARFSQQNQRVRPNSNEDKVVARAKEHFEKTLIQISGDIAGSVAALEHPTKNDALNYGEIFLRDNVPVMIYLLTQKRYDIVKKFLTVSLDLQSTTYQTRGVFPTSFVEEKGKLIADYGQRSIGRITSADASLWWPVLCWLYVRKSGDQSFGTSQQVQRGVQLLLDLVLHPTFEGNPVLFVPDCSFMIDRPMDVWGAPLEVEVLLHASLKSCIQLMELSRKHQKSRLLDQRLVLTRQWVHDLRQFLLKHYWVTSKTMQVLRRRPTEQYGEDQHQNEFNVQPQVVPSWLQDWLENRGGYLIGNIRTGRPDFRFYSLGNSLACMFGVLTAPQQRALFRLVLHNREHLMAQMPMRICHPPMDVEEWQNKTGSDPKNWPWSYHNGGHWPSLLWFFGASILLHEKRYPKADVLLMGQMRALIEECYWSQLNQLPRQKWAEYFDGPTGTWVGQQSRTYQTWTIVGFLLMHHLLRAEPDDVLMLDLEEEF

SEQ ID NO: 19232 - protein, 344 aa, Deinococcus radiodurans R1
MTATQEKQAQGKQAGTEQPAVRTLNLIQAITEALADELERDPNVVLFGEDVGARGGVFMATAGLQERFGKKRVFDTPLAEGSIVGAAVGMAVRGMRPIAEIQFADYIGPGFDQILSQAAKIRYRSGGQFSAPLVIRTPSGGGVKGGHHHSQSPEAYYCHMAGIKVVMPSTPYDAKGLLKAAVRSDDPVMFFEPKRLYRAAKGEVPEHDYVVELGKAAIRREGDDLSLIGYGGVMPDLERAADALAAEGISVEVIDLRSLVPWDRPLVLQSVEKTGRAVLVSEAPRMANFMGEVAYTIQNEAFDSLSAPVQQVAGFDTPYPYIQDKIYLPGANRIVAACVKALNY

SEQ ID NO: 19233 - protein, 184 aa, Thermosynechococcus elongatus BP-1
MFALALWDRLARLLFLARDRIGEQPLYWGWAGRDLVFGSELKALRRYPDFPREIYREALGLYVRYAYVPAPWSIHPGVFKLEPSCILELSGPVTAAPPTAPLRPGGSFEGLSIRRYWSLAHLVAQGAQERFTDEGEVIAAVEAALETAVSRQLIPDVQLGAFLSGGIDSSLVVALMRKVTDVPV

SEQ ID NO: 19234 - protein, 189 aa, Glycine max
LYISLHDLYLAANLVFIAAVAGVHMSHKTAGLLSTIFDIGGVLGGITAGFISDLIEARAITSILFLFLSIPALALYRIFGSLSMLINIILMFLSGFLVNGPYSLITTAVAADLGTQSMNDRNSRALATVTAIIDGTGSVGAALGPLLAGYISTRGWNSVFFMLILSIFFAGLFLIRIARTEIREKLSGK

SEQ ID NO: 19235 - protein, 468 aa, Ralstonia solanacearum GMI1000
MASTLAAPPADLTNERVAYARLFALGLQHVLVMYAGTVAVPLIVGSALHLPKEQLAFLINADLFAAGVATLIQSLGVWKFGIRMPVMMGVTFASVGPMIAIGGDPGIGLLGIYGAVIAAGLFGIVIAPLMGRVLGLFPPVVTGTVITLIGVSLMGVGINWAAGGQPTLQAMVDGVLRTVPNPAYGDPGGLAIALSVLVIILLLTKYGRGLIGNIAVLLGVACGTLIAMAAGKVSFAGVADADWMAVITPLHFGMPTFHAGAVASMCVVMLITLVESTGMFLALAEITGKTLTHDDLTRGLRADGLGSVIGGLFNTFPYTSFSQNVGLVTVTGVRSRFVAAAGGVILIALGLFPKMAHVVASVPAFVLGGAGIVMFGMVAATGVRILGSIDFNRHRHNLFIVAIAIGFGMIPTLAPAFFQYLPRWLEPVTHSGIVLGTLVAVILNLYYNGMQPAEHAMRAAAATTHSAE

SEQ ID NO: 19236 - protein, 226 aa, Agrobacterium tumefaciens str. C58
MKIKAAEAALSHVQDGMRLGIGTGSTAEEFVRLLAEKVAAGLKVEGVPTSERTARLCVELGVPLKSLDELPELDLTIDGADEVDHVLRLVKGGGGALLREKIVAAASGRMIVIADQSKVVETLGAFPLPIEINPFGQVATRIAIEKLAARSGLSGELTMRSSGDGAFMTDGGHLILDASFGRIPDAEALARELNTIPGVVEHGLFINLASLAIIAGPEGARMMQAV

SEQ ID NO: 19237 - protein, 373 aa, Populus tremula x Populus tremuloides
MPSRSLADAFRSHPVHLHQKHLDFSSLQEIPDSHKWTQLDDIEQQHPSVESFITESVPVIDLLDPNVLQNIGNACKTWGVLQVTNHGIPISLLESVEGVSRSLFSLPVQQKLKAARSPDGVSGYGVARISSFFSKLMWSEGFTIVGSPLEHFRQLWPQDYTKFCDVIEEHEKEMQKLARRLTWLMLGSLGITKKDLNWAGPKGESKEGGAALQLNSYPACPDPDLAMGLAAHTDSTLLTILYQNNTSGLQVLKEGIGWVTVPPIPGGLVVNVGDLLHILSNGLYPSVLHRAVVNRTKHRLSIAYLYGPPSSVQISPIQKLVGPNHPPLYRPITWNEYLVAKAKHFNKALSSVRICAPLNGLVDVNDHNSVKVG

SEQ ID NO: 19238 - protein, 459 aa, Prochlorococcus marinus str. MIT 9313
MRASWVAARKGQANVSQLHFARQGVVTQEMDYVAKRENLPESLVMEEVARGRMIIPANINHENLEPMAIGIASSCKVNANIGASPNASDVAEELKKLELAVKYGADTVMDLSTGGVNLDEVRTAIINASPVPIGTVPVYQALESVHGSIEQLDEDDFLHIIEKHCQQGVDYQTIHAGLLIEHLPLVKGRLTGIVSRGGGILAQWMLYHHRQNPLFTRFDDICEIFKRYDCSFSLGDSLRPGCQHDASDAAQLAELKTLGELTKRAWAHDVQVMVEGPGHVPMDQIEFNVRKQMEECNEAPFYVLGPLVTDIAPGYDHITSAIGAAMAGWYGTAMLCYVTPKEHLGLPNPEDVREGLIAYKIAAHAADIARHRPGARDRDDELSRARYNFDWNKQFELSLDPERAKQYHDETLPADIYKQAEFCSMCGPKHCPMQTKITDEDLEGLEKSLKSKGKAKLSA

SEQ ID NO: 19239 - protein, 221 aa, Thermococcus kodakarensis KOD1
MESRFEPEITPVDILLQLVQMGKVDPWNIDIVDLTEKYIERLREMKELDLRISARAILAASILVRMKSEALLYSDEEQDKGDEEKERIRVDVEPLAPPLRRAERYYTFEDLIEALMDALEEAERRKPRKRKREEVEEEIFVVDDFRVDIEKHVNRLYEIVRKLYSETREPIRFWDLVFDPQPKIIARTFLYLLFLSNMGKVDLLQEEPFGEILVVPLEENS

SEQ ID NO: 19240 - protein, 133 aa, Aeropyrum pernix K1
MVMLDTLANAMAAIKNAEMRGKGEAIIMPSSKLIANVLRILEKEGYIGGFEYIDDGRWGKFRVKLLGRINDIGVVKPRTPVSYRELAKMPEHLRKYLASRDVGLLILSTPQGVMTHREALKRKIGGIVIAYVY

SEQ ID NO: 19241 - protein, 149 aa, Blastopirellula marina DSM 3645
MGKKLYVGNLPYGYGSSELENLFGQYGQVASASVINDRETGRSRGFGFVEMASDGDALAATEALNGFDVDGRKLVVNEARERERSGGGGGGGGYGGGGGGGRSGGGGYGGGGGGRSGGGGYGGGGGGGGGGGRGGDRGGRGGDRGGDRW

SEQ ID NO: 19242 - protein, 141 aa, Brassica napus
MASSLSFVSSSHLTLRTPSLTLRKLSPPRTSVSFSVKAQSVALSQDDLKKLAAEKAVEAIKPGMVLGLGTGSTAAFAVDQIGKLLSSGELHDIVGIPTSKRTEEQARSLGIPLVALDTHPRIDLAIDGADEVDPNLDLVKG

SEQ ID NO: 19243 - protein, 369 aa, Oceanobacter sp. RED65
MKKLFILSSLIIVAVYLLAWPVEIEPVAWKAPDNPGYTGSFTKNQALSQIHRLELNGEIGPEDVAIDASGMPVFGVLGGDIMRLNSNGEYESLVNTGGRPLGIEYDTQGNLWIADAYIGLLKLTPEGNLETVLTHVGDSPIRYADDLDITASGKVYLSDASTKFHAKHYGTYAASLLDINEHGGHGRVIEYDTNTKQAMVILDGLNFANGVAVSHDEEWVLVNETAKYRVLKIGIAEHNRQHQQVVIDNLPSFPDNINPGSNSLYWVGLVSPRSAPLDALSEYPYLRKVVQRLPAFMRPKAKHYGHLIAINDQGKVVHDLQDPLGMYGHVTGAAEAGEVLYVSSLHETALGKTVNLNQSKQTLIEPQTP

SEQ ID NO: 19244 - protein, 398 aa, Thiobacillus denitrificans ATCC 25259
MNPRLDQLHPYPFQKLRELLAGTEPNPELAAINLSIGEPKHPTPGFIRDALVGGLDGLANYPITQGSDALRAAIAGWAARRYGVTLDPASEVLPVNGSREALFAFAQAAVDSTRHGRRTVVSPNPFYQIYEGATLLAGARPFFLNTLPENGFTMDWSRVPEDLWDSISLVYVCSPGNPTGKVMTLDEWRTLFALADRHGFVIAADECYSEIYFDEAHPPLGALTASHQLGRGCRNLVVFNSLSKRSNVPGLRSGMVAGDAEVLKKFLLYRTYHGSAMSPAVQAASIAAWNDEAHVLDNRRQYAAKFAAVIPLLRDVLSFDAPDAAFYLWARVPGGDDAAFARGLYAQQHVTVLPGSFLARDAAGANPGKGFVRIALVDTLDACVEAAERIAAFVTEAA

SEQ ID NO: 19245 - protein, 647 aa, Desulfitobacterium hafniense DCB-2
MKYYITTPIFYPNASPHIGTAYTTVAADAFARYHRLKGHDVYFLTGTDENAQKIVRTAESQGMEPLAYVDGVVERFKALWEELDISYDDFIRTTEERHHEVVKKIFTKLYEQGDIYKSEYEGWYCTPCETFWTENKLMDGKCPNPDCGRDVELLKEESYFFKLSKYQDALLRHIKDHPDFIQPASRRNEMIKFIEGGLEDLCVSRTTFQWGIQVPFNPKHVVYVWLDALINYISALGYPDGELYQRYWPAEVHLMGKDIVRFHAVIWPIILMALDVPLPKVVYGHGWYLSKEGGKISKSRGNVQDSFELIRRYGSDAIRYFLLREMQVGTDGAYSEDSLVERLNSDLANDLGNFVSRSLAMIVKYRGGVIPKAAEPTELEAELRALGQEVVAKVEERLEAHDPAGALENLWRLVSRMNKYVDETAPWTLAKQEGQQARLDTVLHTFAEAIRILGILCAPFMPKLTGKMFRQCGISDELLAWEAAKEWAVLGEGIQVQRGEALFPRIDLAQFSVEEEKASVNEIKETPTVEENKVEFEPIKEEISIDDFAKIDLRVAKVLHAEKVEKTDKLLKLEIEVAGKPRTIVSGIAQHYAPEDLVGKHVVIVANLKPAKLRGITSEGMILAASHEGVLEVLVLDKELPAGARVK

SEQ ID NO: 19246 - protein, 757 aa, Idiomarina loihiensis L2TR
MMLVTLQRIVQGVNKAPDFNMALTTMVSQVREALETDSCSVFLADNDQRQFVMAASDGLRAEDGKPVRVDFGEGIISLAAQREEPLNIADASMHPANKKLSDTNENIYKGLLAAPIIHRRKVLGIVVVHQSVARSFSREEEAFIVTLAAQLAAVIAHADAKGLLVSEHSPWIHSLRGLPGSPGVAVGEAYVSRPEARIDEVTPRRSDKPIHEIRKFRQAVARTRADLKELSRRMAGQVPDDTLAIFDVYQGMLDAASMGDAVENMIKEGWRAQTALKYVVEQFVAQFEALEDSYLQERATDVRDIGQRVLLHLQNRQRKRKPLPDNFILIADEVTASMLAELPREQIAGIISLNGSSNSHAAIMARSMNIPAVLGVDDIELHFFSDRLLAVDGYTGEIYVDPPAQVLTQFHQLAEEEQELRDIVTEHSHLPAETQDGQRISLHLNLGLDVTHDYLKTLNIDGVGLYRSEIPFMMRDQLPTEDEQTEMYQEVLDQFPDQPVVMRTLDVGGDKPLPYFPLKEDNPFLGWRGIRLTLDHPEIFLIQIRAMLRASIGKSNLRILLPMITSTSEVDEASRLIKQAYFEVAEEQGCEVGVNLFQPQLGVMIEVPAAIYQLPAMASKVDFFSVGSNDLTQYLLAVDRNNRRVASLYDAYHPAVLASLDEIARRCEEIGKPVSVCGELAGDPGGALLLVAMGYRQLSMNSYNVDRVRWILRNVRSSTLNVMLAKALQARNPDQIRKMIAEKMESIGLGGFVRAGK

SEQ ID NO: 19247 - protein, 121 aa, Chlamydophila caviae GPIC
MGNLIKELQDEQLRKEALTDFRVGDTIRVATKIVDGGKERTQVFQGTVMARRGGGAGETVALHRVAYGEGMEKSFLLHSPKIVGIEVVKRGKVSRARLYYLKGKTGKAAKVKEYIGPRAPK

SEQ ID NO: 19248 - protein, 329 aa, Chlamydophila pneumoniae AR39
MPMSNQFDQLKKLSTIVCDSGDPELVKASGSQDATTNPSLILKVAQEPKFQELLNEAVVWGIRQNGDDLQTLSFILDKIQVNFALEIIKNIPGRISLEIDARLSFNVEAMVQRAVFLSQLFEAMGGDKKRLLVKIPGTWEGIRAVEFLEAKGIACNVTLIFNLVQAIAAAKAKATLISPFVGRIYDWWIAAYGDEGYSIDADPGVASVSNIYAYYKKFGIPTQIMAASFRTKEQVLALAGCDLLTISPKLLDELKKSQHPVKKELDPAEAKKLDVQPIELTESFFRFLMNEDAMATEKLAEGIRIFAGDTQILETAITEFIKQIAAEGA

SEQ ID NO: 19249 - protein, 338 aa, Ralstonia solanacearum GMI1000
MKRINLTRYLIEEQREHNTIPAELRLLLEVVARACKAISHSVNKGALAGVLGSAGTGNVQGETQQKLDVIANEVLLEANEYGGNLAAMASEEMESFYEIPHRYPKGEYLLLFDPLDGSSNIDVNVSIGTIFSVLHMPKPGQTVTEADFMQPGVRQVAAGYAVYGPQTTLVLTVGNGVHMFTLDREVGSFILTNRDVKIPADTKEFAINMSNMRHWAPPVRRYIDECLAGTEGPRGKDFNMRWIASMVADVHRILTRGGIFMYPWDKREPGKAGKLRLMYEANPMAFLVEQAGGAATNGHQRILEIQPEKLHQRVAVILGSKNEVDRVTQYHREAQQTA

SEQ ID NO: 19250 - protein, 1320 aa, Salmonella enterica subsp. enterica serovar Paratyphi A str.
MGTTTMGVKLDDATRERIKMAASRIDRTPHWLIKQAIFSYLDKLENSDTLPELPALFAGAANESEEPVAPQDEPHQPFLEFAEQILPQSVSRAAITAAWRRPETDAVSMLMEQARLSPPVAEQAHKLAYQLAEKLRNQKSASGRAGMVQGLLQEFSLSSQEGVALMCLAEALLRIPDKATRDALIRDKISNGNWQSHIGRSPSLFVNAATWGLLFTGRLVSTHNEANLSRSLNRIIGKSGEPLIRKGVDMAMRLMGEQFVTGETIAQALANARKLEEKGFRYSYDMLGEAALTAADAQAYMVSYQQAIHAIGKASNGRGIYEGPGISIKLSALHPRYSRAQYDRVMEELYPRLKSLTLLARQYDIGLNIDAEEADRLEISLDLLEKLCFEPELAGWNGIGFVIQAYQKRCPLVIDYLVDLASRSRRRLMIRLVKGAYWDSEIKRAQMEGLEGYPVYTRKVYTDVSYLACAKKLLAVPNLIYPQFATHNAHTLAAIYHLAGQNYYPGQYEFQCLHGMGEPLYEQVTGKVADGKLNRPCRIYAPVGTHETLLAYLVRRLLENGANTSFVNRIADATLPLDELVADPVEAVEKLAQQEGQAGIPHPKIPLPRDLYGEGRINSAGLDLANEHRLASLSSALLSNAMQKWQAKPVLEQPVADGEMTPVINPAEPKDIVGWGREATESEVEQALQNAVNQAPVWFATPPQERAAILQRAAVLMEDQMQQLIGLLVREAGKTFSNAIAEVREAVDFLHYYASQVRDDFDNETHRPLGPVVCISPWNFPLAIFTGQIAAALAAGNSVLAKPAEQTSLIASQGIAILLEAGVPPGVVQLLPGRGETVGAQLTADARVRGVMFTGSTEVATLLQRNIATRLDAQGRPIPLIAETGGMNAMIVDSSALTEQVVVDVLASVFDSAGQRCSALRVLCLQDDIAEHTLKMLRGAMAECRMGNPGRLTTDIGPVIDSEAKANIERHIQTMRAKGRPVFQAARENSDDAQEWQTGTFVMPTLIELENFAELEKEVFGPVLHVVRYNRNQLAELIEQINASGYGLTLGVHTRIDETIAQVTGSAHVGNLYVNRNMVGAVVGVQPFGGEGLSGTGPKAGGPLYLYRLLAHRPPNALNTTLTRQDARYPVDAQLKTKLLAPLTALTQWAADRPALQTLCRQFADLAQAGTQRLLPGPTGERNTWTLLPRERVLCLADDEQDALTQLAAVLAVGSQALWSDDAFHRDLAKRLPAAVAARVQFAKAETLMAQPFDAVIFHGDSDKLRTVCEAVAAREGAIVSVQGFARGESNILLERLYIERSLSVNTAAAGGNASLMTIG

SEQ ID NO: 19251 - protein, 394 aa, Oryza sativa (japonica cultivar-group)
MADELDELLGFLSSPQPNVRGAAAGIVRGLTGDADGLRALSARADRALPALLRLLASAGGELGTGGAAADSLVNLSQDGALSARLVSLGAVVAAMDVVAKPGGFHRVNTDILNPDYTLKFCCFQKVGDEKMQGLYVAKLVRSFCRSSSESEEEDIFEHVASILVNISKVEAGRRILMEPKRGLLKQIIRQSDSTNQLRKKGVVSTIRNCCFEADTQIQNLLSLAEYIWPALLLPVAGKKIYSEEDRSKMPPELANALSHEREAVENSEIRQQALEAIYMIVLQDEGRRAFWSVNGPRILQVGYEDEEDPKVMEAYELIGSLVFPWLKAIKSSPYNYVRTWRNMHKQSNLPTFHRKIRKLVNVHMSPLTGGFASGQRNIQPPVGKTTGFWINVPF

SEQ ID NO: 19252 - protein, 632 aa, Cryptococcus neoformans var. neoformans B-3501A
MPTITVDKAELYRRLEKEYSHEEFDELCFEFGIELDEDTTIQVEEARKRGLPTPPPQLKIEIPANRYDLLCIEGLARALRIFLQKDIPPSYKLDIPEKLQEVYVEASTAPLRPYFASAVLRLARPMNQLEYESFIDLQDKLHQNLCRMRKFVAIGTHDLDTIEGPFRYMCKDPKQIKFAPLNRDTEHTAEELMTIYEADRHLAKHLHLIRDAPAYPIIYDSKDRVLSMPPIINSQRSKIVPGKTTNIFIDTTATDKTKLDIVINMVCAMFAEYCRVPFYIEPVRVHMPDGTSHITPPLEPRATTASSSYINAATGLALSRQEICTLLTRMSLSATPSPSNEDLLDVLVPCTRPDILHECDIMEDAAIAYGFNKLPREMPTTNTVAKAFPVNKLGDIIRKECAMAGWVEALPLILCSHDENFAWLNRPDPGHYAVHLANPKSLEYQVVRTSLLPGMLKTARENKALPLPMKIFEVSDVAIQDSTEERQARNYRRLCAVYMDRKAGFEVAHGLLDRVMQILGVPLLERKENEGNYGYYIASADDLTYLPGRAAHVFYRPKPTVQPSEPTPSAPPSNPIQSFTSDLKAALHAEKGSSWERDIDIGSLGILHPSVLDNFELIRPCSALEIDVEPLL

SEQ ID NO: 19253 - protein, 325 aa, Mycobacterium bovis AF2122/97
MIPAVSLGDPQFTANVHDGIARITELINSELSQADEVMRDTVAHLVDAGGTPFRPLFTVLAAQLGSDPDGWEVTVAGAAIELMHLGTLCHDRVVDESDMSRKTPSDNTRWTNNFAILAGDYRFATASQLASRLDPEAFAVVAEAFAELITGQMRATRGPASHIDTIEHYLRVVHEKTGSLIAASGQLGAALSGAAEEQIRRVARLGRMIGAAFEISRDIIAISGDSATLSGADLGQAVHTLPMLYALREQTPDTSRLRELLAGPIHDDHVAEALTLLRCSPGIGKAKNVVAAYAAQAREELPYLPDRQPRRALATLIDHAVSACD

SEQ ID NO: 19254 - protein, 344 aa, Aspergillus oryzae
MPATRGLPILDFSAFYGENPKAKAQLVEQVRESCLHNGFFQITGHRIPLELQHRAMNCSKRFFRLPLEEKLKIDKKKNTFNRGYELLQSQMNEAGASPDLKEGLYIGREIPTDHPYFLEGLLNSGPNQWPDTIPDREEFQKSTMEYYHAVFDLAKDIMAVLALTLNHDEAYFDPLTDGAVATLRYLHYPPPPKQMGERLRGIGAHTDFSCITLLLQDEVSGLQVLDVPTNEWIDVQPIPGAYVVNLGNLFSRMTNDTYKSNLHRVINDSGNDRYSIPFFLTGNPKYVCKCLPGFQKDGEPGKYLPATVQEVVSSSYKETFARAERYKAEIQTKIQNNVTKEVAA

SEQ ID NO: 19255 - protein, 372 aa, Aspergillus oryzae
MAVNFTQIPTIDLAHAQSPVTKASFLSDLRDAIVKVGFFYVKNHGVPNNVERNFVEQSVKFFDLPLEDRLEVEMLHSKHFLGYVREQNEKTAQRTDFRETFNLGMDLAAPGEEEPAYRNMSGPNLWPNETAIPGFRAAMEDYVKHIQTLGDDFKVLVAEALDLEPTAFLRFFDEQPQDRLKLAKYPVPSSIADSEPSGSFQGIGPHKDSSFLTFLLQGTPHRGLEVQNKSGEWIPAPPIPGTLVVNIGRMFEALTGGVVTATTHRVSLEEKNFVDRDGRPLGPRFSFPMFQLLALDLRRDQMTLDMPPHIVKLAKEIKVMSDAEKFFEEMFRDCAGSGLFMARVIKHEDVARKWYPDVLDNVLKAQKAELGH

SEQ ID NO: 19256 - protein, 568 aa, Arabidopsis thaliana
MNLSADQAPVTAVDELAPPSQPHRLSTSCDLHPEERFSGFCPSCLCDRLSVLDHNAAPPPSSSSRKPPSISAVSLKALFKPSSSGTNNSNGNGRVRPGFFPELRRTKSFSAKNNEGFSGGFEPQRRSCDVRLRDDERNLPINEAASVDKIEEEARESSVSEIVLEVTEEAEIEEDEENGEKDPGEIVEEKSSEIGEEEEELKPMKDYMDLYSQTKKPSVKDFAGSFFSAASVFSKKLQKWKQKQKVKKPRNGVGGGRPQSEIGVGRRSSDTDPRFSLDAGRFSVDIGRISMDDSRYSLDEPRASWDGHLIGRTTAARVPLPPSMLSVVENAPLNRSDMQIPSSPSIKPISGDSDPIIIIPGGSNQTRDYYTGPPSSRRRKSLDRSNSIRKIVTELEDVKSVSNSTTTIDSNSMETAENKGNQNGDKKSRRWGKWSILGFIYRKGKDDEEEDRYSRSNSAGMVERSLSESWPEMRNGEGGGPKMRRSNSNVSWRSSGGGSARNKSSRYSSKDGENGMLRFYLTPMRRSWKTSGGSGGGGGGGGGGGWEKTAAKANSHGHSIARRVMRLY

SEQ ID NO: 19257 - protein, 363 aa, Synechococcus sp. RS9917
MSQNIAVNSDPTTATASLAGPHAERLSSLVTAQRAEVDRDTGLALYRDMTLGRRFEDKCAEMYYRGKMFGFVHLYNGQEAVSTGVIGAMKRQHDWFCSTYRDHVHALSAGVPAREVMSELFGKATGCSKGRGGSMHLFSRQHHLLGGFAFIGEGIPVALGSAFTSRYKRDALGDASSNAVTAAFFGDGTCNNGQFFECLNMAQLWKLPILFVVENNKWAIGMAHDRATSDPEIWRKAAAFGMAGEEVDGMDVLAVRAATQRALERARAGEGPTLLECLTYRFRGHSLADPDELRAEAEKQFWAQRDPLKALERDLVTAGLVTSDDLRAIEKDIDAEVQDCVDFALAAPEPDGAELTRYIWAED

SEQ ID NO: 19258 - protein, 590 aa, Saccharomyces bayanus
MTTPKQDSEVEEKHMYTEPAGTFFHDVEASQTHHRRGSLSLKDEKSKELYPLRSFPNGVNGQDTFSMEEDIQDEDEGEVQNAEVKRELKQRHIGMIALGGTIGTGLFIGLSTPLTNAGPVGALISYLFMGSLAYSVTQSLGEMATFIPVTSSFTVFSQRFLSPAFGAANGYMYWFSWAVTFALELSVVGQVIQFWTYAVPLAAWISIFWVIITAMNMFPVKYYGEFEFWVASIKVIAIIGFLIYCFCMVCGAGVTGPVGFRYWRNPGAWGPGIISKNKNEARFLGWVSSLINAAFTFQGTELVGITAGEAANPRKTVPRAIKKVVFRILTFYIGSLLFIGLLVPYNDPKLTSATSYVSTSPFIIAIENSGTKVLPHIFNAVILTTIISAANSNIYVGSRVLFGLSKSKLAPKFFSKTTKGGVPYIAVFATSIFGALAYMETSTGGGKVFAWLLNITGVAGFFAWLFISVSHIRFMQALKYRGISRDELPFKAKLMPGLAYYATFFMVVIILIQGFTSFTPTFNGVNFLAAYISVFLFLAIWILFELIFRCRFVWKIEDVDIDSDRRDIEAIVWEEPEPKTLWDKFWNVVG

SEQ ID NO: 19259 - protein, 517 aa, Synechococcus sp. RS9917
MTWPRPDVAHWLVRCERMAALEQDWLASGLPVPSLMEKVGLAMAAWLLERPTWLNAGVLVLVGPGHNGGDGLVVARELAQAGVAVRLWLPLPIRASLTQQHLDHARWLGIPVLETAPDPADPALWIEALFGLGQSRPLPQALASLLRRRQQQRPHQLVSLDLPAGLDGDHGHALDGEAAVARATLTVALIKEGLVQDAALEHVGELHRMDVGWPDRLMPDPSTPLLLGVRPEDLQDLAWPQPPCSAMKYQRGRVLVIAGSDRYRGATLLALRGALASGVGSLQAVVPEAVAQTLWQVLPEVVLAGAAGPAAEAGRLWPEAVAALDLSRFDAVLLGPGLGPGSLDWDRAAAPLLVFPGVLVLDADGLNQLAASSGGWRWLTQRQGPTWLTPHAAEFRRLFPTLALSSPVAAAREAATCSGAVLVLKGAHSVIAAPDGSARQLLHTDPHVARTGLGDVLAGFAAGWAAQRPAMTWGAEALAAAVALHAEAGRRCRASSTAGDVAQALARLCRRQQRQAG

SEQ ID NO: 19260 - protein, 838 aa, Arabidopsis thaliana
MGIGWSLHNRDGTQILHGSGAIHPTQSPTEAEAEALRLAVLDLRRLGYSHVTFCGDLKLIYDTLQRCALRGNNASWKYLHIATYLADVLKISKLCSFNFIHISRDANDIADRLAKQARCNGLDYVICWTSSSLVLNVKQRNYVTDIYNDVNNISSINAFQDLAGSLDELKTTSFIVVLTFWVCFLIKTPIKFRIEGTTPSFSGSVFALLHDSVSGTFISMDAKMFDTICSRDAISWLPDEVLGKILSLIPTKQAVSTSLLAKKWRTIFRLVDHLELDDSFSLQAVKDQTPGLRKHVRFVFTEDFKIFVDRTLALQCDYPIKNFSLKCHVSKYDERQKACVGRWISNVVGRGVFELDLRMKDPGIHFLPPHLVASKTLVKLTLGTQLCLGQLPSYVSLPSLKSLFIDTIVFYDIEDLCCVLLAGCPVLEELSVHHHDFIATPHTISSPTLKRLSVDYHCPDDVDSASHMSFDLPKLVYLEYSHCALGEYWQINLESLVEAKLDLGLERKVLRMDVTDLIIGIRNVQSLHLSPDSVHVIYSYCRHGLPVFKNLVNLSFGSKNKRGWRLLANLLKQSTKLETLIVKDLNGYTGDVSMPLNKVTSLHILGYRGTADEVKQLKSFIGEFECLELVQVDVAEAAEDNGKILQSKRDLMMLLGVSLPSKCQFKSVLDELNVRVSGILVIGVLDGTQLLLIILLHILGKGNKPLAALTTLNHMKEVGIDPSVLHYTTLIDGYVVSGELDKAKEMFREMTVKGQLPNVFTYNSMIRGLCMAGEFREACWLLKEMESRGCNPNFVVYSTLVGYLRKAGKLSEARKVIKEMVKKGHYVHLVSKMMKYRR

SEQ ID NO: 19261 - protein, 329 aa, Shewanella sp. MR-7
MQVSPRGTASAKLTDFLELANQNIALAKQQNIQYSPQLLRENLNKLAALMSAKPEVSYIADKAWQVKDAQHGDREIGCRVYSPAPNTALPVVLHFHGGGHMCGSVELYDPICRHLASIAQCVVISVEYRLAPEHPYPAGLEDCEYALRHYQSVLTEVQYQQGVSIMGDSAGGALCTSLSQRSLSDSTLNIAKQILVYPSVDYTMASASYQSNGAGFLLETPRVQWYFEQYFQEVAKDAERVKQASPLHGEFNAKLPSTLIFTVGCDPLRDEGIAYANALTAAGVQVQHHQFEDMIHAYMLLQDLVSQECLATYRMIAAFLAEPVTSVTR

SEQ ID NO: 19262 - protein, 171 aa, Arabidopsis thaliana
MEFSRDAGMMMENKRNVCSLGESSIKRHKSDLSFSSKERKDKVGERISALQQIVSPYGKTDTASVLLDAMHYIEFLHEQVKVCSSIPSMIHSSLSEFPCSFVQVLSAPYLQTVPDATQEELEQYSLRNRGLCLVPMENTVGVAQSNGADIWAPVKTPLSPAFSVTSQSPFR

SEQ ID NO: 19263 - protein, 289 aa, Clostridium acetobutylicum ATCC 824
MNNKVIKKEVEEYLSRYFEGKDNYNKRVYESMNYSLNAGGKRVRPLLLLASYAIYNKDYKEVIDIAAAIEMIHTYSLIHDDLPCMDNDDLRRGRPTNHKIFGYSIALLAGDGLLNEAMNIMFKYCIGKGEEALKACLMISKAASSDGMIGGQVVDILSEGKKINEDELRYMHKKKTGELIKAAVVSGAILGGAPLHDVELLSQYGDKLGLAFQIEDDILDIIGDTKIMGKTSKSDLENDKCTYVTLYGIDKCKSICRELTDECLDIIGKIQGNTELLKEITELLLKRNR

SEQ ID NO: 19264 - protein, 145 aa, Triticum aestivum
  misc_feature (124)..(124): Xaa can be any naturally occurring amino acid
  unsure (1)..(145): unsure at all Xaa locations
APYASLPRGQVYHSSFSDDDGITKACGCPLLPLKTHIKGPAPASDSDKADIVDEAITFFRANVFFKNFHVKSLADKLLIYLTSYINIALKRLESCRTLAVGTKAIINLGLENVPVPGEPGFPFXTFTLPESEEEAELLRNYLKQI

SEQ ID NO: 19265 - protein, 746 aa, Aspergillus nidulans FGSC A4
MQLSSYKETAVGEAVDKDNNAPAENLEGQIQVHDDVEYVKGHPVIRTGADISRFIVSDRDDGDPALTFRSIVLGTVFTALSSVITILYVFKPYQVQVSAVFLQLLVFIFGKAWAIFTPRPERVKWRWLQSVLRFMSFGQDFGIKEHVVAALIASSGNNGLSGVEVRAVERLFYGLHISASTAVLSTFSIALCGFVLAGVLRPLIVYPAEMVYWSTLPQVVLYQNLHFNPRNNKRRLIKFGWALGIAAVWELFPAYMMTWLGGFSVVCLASLRAPMHTRKIITTIFGGASSNEGMGLLNFSLDWQYIQSTYLSLPLKQQVNSWIGYAIFYVVMAGTYYGNAWDAKSFPFMSTSLFHSNGTTFSPDSVINSQGTIDYVKLEQVGLPSLTSSTVWGYLTQNLAIGALISHVLIFYWKDMETAWKQARSRTQPDPHYQGMLKYKEVPMWWYYASFVLAFFAGLIVTIKGETTLPAWGYIISLILGSFIAPFSCVLYGLYGTGVSTNQLSKMVAGALHPGRPLAGLYFASWSHQVILLSVNLANWLKIGQYTKVPHRIMFATQVYGTLLGAALNYVVMITIVTSQREILLDPIGNNVWSGSLVQSLNSQAITWSLAKEIYGTHGRYLIVPLGLIIGLVFPAIHWGLSKIFPRIRNWPLNTTIILAHAGQVYYGTTAWVGSAIVVGIFSQFWLRRRLPRVYNEYNYLIGAALDGGSQLVIFILSFAVLGASGTERPFPTWWGNPDGNPDHCL

SEQ ID NO: 19266 - protein, 459 aa, Oryza sativa
MLKLETEPIQLGHQQAVDQSSESKVGQYPTSMLQQQTSCDQQSLCIQVDTKLQEMPPNEHLLDQVPPRSQKKLCMDDRLSDLPDTILHHIMSLLSAQEVARTCILSKRWKELSASAPCLDICVDKFGMDRVRFSEFVAHLLLSRAPNSLHTFRLHSFAIDHASSWINRAIELKAQVLEFTEYIRWESFYLDPQLMAFASQYLKCLKLTNVTLDSNAFEPLNHACPALENLQLSQCFLEVPEICSASLKKLDIMECSLLMNLQIQTPRLVSLRFSRYPVITAAVTLCDLPNAENIDLSCSGRQVTFGREIQKFPMYGKLTSISLGEWCLSDKFSRLFCLLRHSPELKELTLKLEVERQDHNGEDEIRLMVGRSFSAENLKKICISTMQELSRKIARRQSWGMLSRFNKKDTAVSTITMPQEVKPEAMAYLVACTPIRSRSSLCKSHLEARLGGNTEIGLG

SEQ ID NO: 19267 - protein, 488 aa, Artemisia annua
MALSLTTSIALATILLFVYKFATRSKSTKKSLPEPWRLPIIGHMHHLIGTTPHRGVRDLARKYGSLMHLQLGEVPTIVVSSPKWAKEILTTYDITFANRPETLTGEIVLYHNTDVVLAPYGEYWRQLRKICTLELLSVKKVKSFQSLREEECWNLVQEIKASGSGRPVNLSENVFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKTELLLVPSF

SEQ ID NO: 19268 - protein, 376 aa, Pectobacterium carotovorum subsp. carotovorum
MPNDLYAIYNRYTSRTLFFKYCATATLTHRLTRRLSLFTLKKCLARPQGRLFSLVNSIYFGGETLEEVQSTATFLARSGIACVLDYAVEGENDETQFDKAMENTLRLIEMSQQTDSLPFVVIKPSSLGSVAVYARQSERLALDEASASAWSRIVTRFSRLFDYARSHGVHVMVDAEQTAIQPAVDRLVLDMMREFNRDSAVITLTLQFYLKDQLRFLDECYQRACQDNFLFGVKVVRGAYLEEEKRVNGGVRCFATKQETDRSYNAAVDYIALRLDRIAPFFATHNEESLALIMSSESLRAGRTWVGQLYGLGDHITYSLLQTGFRVCKYLPYGPLDKSLPYLLRRIEENAVASATFKKENKLLQKELLRRLVGGM

SEQ ID NO: 19269 - protein, 555 aa, Aeropyrum pernix K1
MALPEKTPWRPGYSLTIHKIYQYALYMWSDLEIVSRTTKGLERYTFSDAARRIESLANALRALGVSGLDRVATMDWNTHWHYETYFAAPMMGAVLHPLNVRLAPNEIAYIMNHAEDKVLIVHSDFLKLAEAILPHAPSVEHVVIVDAESHPDRIAGRRLHNYEDLIKEHGGRFEWPELDENRPAAMGYTSGTTGLPKGVYHSHRMIVVHALSGALALATRGRRRVTGDDTLLHIVPMFHVLAWGLPYMATLTGMKQVFPGRLDPKVLLDLIVGEKVTVTAGVPTILYMLLSHPESGKYDLSGLLFVNGGQALPKGLADAARKRGIEVIVGYGMTETAPILTLANVPQKYMDRSEELSLTTGWPVPLVELMVADPETLEPVPKDGKTMGEIVVRTPWVTPEYYKDPEKTEKAWRGGWFHTGDIAVWTPEGYIQIVDRDKDIIKSGGEWISSLRLESLISQHPGVAQVAVIGARHPKWGERPVAIIVPKPGWQDKLTTEEVREWLAKNFVEKGEIPKWWLPDKIVLVDDLPKTSVGKINKRSLREKFANILEQEPQQ

SEQ ID NO: 19270 - protein, 397 aa, Bordetella parapertussis 12822
MLVHIPTIAMIRSKLPDVGTTIFTVMSRLAIEHKAINLGQGFPDFDPDPELCALVGKAMAAGHNQYPYMPGVAPLREAIAAKVKTLYGHAYDPETEITVTSGATEALMATVLAAVGPGDEVVVIEPCYDSYLPAIRLAGGTAVPVPLRAPTRDDPYYRIDWQRVRDAIGARTRLLMLNFPHNPTGAVLDESDLDALESIVRETGVLLLSDEVYEHIVFDGKPHASLSRRPLLAEHAFVIASFGKTYHTTGWKVGYCCAPRQLSAELRKVHQFMVFTVSSPMQFALAEYMANPKPYLDLPAFYQAKRDRLAAGLANTRFRPLPSPGTFFMLADYSEITKHAEADFARHLTIDHGVTVIPVSAFYQNPAAPESNHHLVRFCFAKQDATLDAAIERLAHV

SEQ ID NO: 19271 - protein, 371 aa, Kluyveromyces lactis NRRL Y-1140
MGKRIVFNISSEFQLQSLLGEGAYGVVCSAKHKPSGEIVAIKKIEPFEKPLFSIRTLREIKILKHFQHENIISIFDVQKPSSFEQFNEVYIIQELMQTDLHRVIVTQELSEDHVQYFVYQTLRALKVLHGSNVIHRDLKPSNLLLNSNCDLKICDFGLARIVSERATDGDAHVDADDTDDNSPSSAANDGDPAISGMTEYVATRWYRAPEVMLTAAQYSKSMDVWSCGCILAELLGKQPLFPGKDYRDQLILIFQTLGTPTEQELVELVENRRAREYIRSLPKHPKINWRRRFPNASAAALDLLDRMLQFDPRLRITATEALSHPYLVSYHDPDDEPEGTPIPSSFFQFDQWKSRLNTKDLKRLLWNEIVS

SEQ ID NO: 19272 - protein, 1053 aa, Saccharomyces bayanus
  misc_feature (609)..(609): Xaa can be any naturally occurring amino acid
  unsure (1)..(1053): unsure at all Xaa locations
PTVFNAPYKLIKNATRIFQNSNEGSTFQILKPMEGCLNPGELLVVLGRPGSGCTTLLKSISSNTHGFDLGKDTEISYSGYSGDDIKKHYRGEVVYNAEADIHLPHLTVFQTLLTVARLKTPQNRIKGVDRESYANHLAEVAMATYGLSHTRNTKVGSDLVRGVSGGERKRVSIAEVSICGSKFQCWDNATRGLDSATALEFIRALKIQANISNTSATVAIYQCSQDAYDLFNKVCVLDDGYQIYYGPGDKAKKYFEDMGYVCPSRQTTADFLTSVTSVSERILNEDMLKKGISIPQTPKDMNDYWVKSQNYKELMEEIDQKINNNDEAAREAIKEAHIAKQSNRARPTSPYTVNYMMQVKYLLARNMWRIRNNIGFTLFMILGNSGMALILGSMFYKIMKNGDTSTFFFRGSAMFFAILFNAFSSLLEIFSLYEARSITEKHRTYSLYHPSADAFASVLSEVPTKLTIAVCFNIIFYFLVDFRRNGGVFFFYLLINIVAVFSMSHLFRCVGSLTKTLSEAMVPASMLLLSLSMYTGFAIPKKKILGWSKWIWYINPLAYLFESLLINEFHDRKFPCAQYIPRGTAYANSTGTETICSVVGAIPGQDYVXGDDFIKESYQYYHSHKWRGFGIGMAYVIFFFFVYLFLCEYNEGAKQKGEILVFPRSVVKKMKKQGALKEKNGNDPENVGERSDFSSDKKMLQESSEEESDTYGDVGLSKSEAIFHWRNLCYEVQIKTETRRILNNVDGWVKPGTLTALMGASGAGKTTLLDCLADRVTMGVITGDIFVNGIPRDESFPRSIGYCQQQDLHLKTATVRESLRFSAYLRQPAEVSIEEKNVYVEEVIKILEMEKYADAVVGIAGEGLNVEQRKRLTIGVELTAKPKLLVFLDEPTSGLDSQTAWSICQLMKKLANHGQAILCTIHQPSAILMQEFDRLLFMQRGGKTVYFGDLGDGCKTMIDYFENHSSHKCPPSANPAEWMLEVVGAAPGTHADQDYHEVWRNSDEYRAVQSELDWMEKELPKKGPITAEADQHEFAQSIVYQTKLVSIRLFQQY

SEQ ID NO: 19273 - protein, 456 aa, Prochlorococcus marinus str. NATL1A
MATHDIFMPALSSTMTEGKIVEWLKKPGDKVERGESVLVVESDKADMDVESFQDGFLASIVMPAGSSAPVGETIGLIVETEDEIAAAQANSPSPSPQSGSQEKDSSSPQVQEKQASVDSPKATVVTKASPAPLVSESSVNQDQFLNDGRIVASPRAKKLASQMGVDLATVRGSGPHGRIQAEDVQSAKGQPISVPWIAESNAPAKIVSDVPRVEKKSVDAGKPPAPGKSFGSRGETIAFNTLQQAVNRNMEESLNTPCFRVGYSILTDELDDLYKQVKPDGVTMTALLAKAVGLTLARHPQVNAAFSSEGIAYPSQINVAVAVAMEDGGLITPVLQNADKTSLTDLSLQWADLVKRARNKQLEPQEYSSGTFTLSNLGMFGVDRFDAILPPGTGAILAVGASLSKVVASKDGSISIKKQMQVNLTADHRVIYGADGALFLKDLAYLIEKNPYSLSS

SEQ ID NO: 19274 - protein, 1088 aa, Gibberella zeae PH-1
MTATIQKRIVVVGLGMVGIAFIEKLLKYDAKSKEYTITVVGEEPYLAYNRVGLTTFFEHRKVEELYMNPSEWYLESEASLNYHINTKATHIDTDNKLIECANGESYPYDILVLATGSEAILPRTLKGWDSNGVFVYRTIDDLNKLIKFSGDKQGTNGVVVGGGLLGLEAAKAMLDLECYNKIDLIERSPWVLSRQVDETAGKMVADQVQQLGVNINLGKGVSSLKTDENNNLTGVVFDDDSEVDCSTLCFAIGVKPRDDLARAANLEVGQRGGIVVNDDLRTSMPDIYAIGECASWRGMAYGLIGPGVAMAEVVAFNLTQAKLHSPQTFKTPDMSTKLKLLGVNVASFGDCFADRDGPITLPRKYAKNLVNGDAKSPKSVQALTYRDPFSNVYKKYIFTKDGKYLLGGMMIGDVCDYVKLLPMVKSQKELDVSPSELILGAKKGEEDSDDLDDDAQVCSCHNVTKGDIVKVIKDGTCKDIASIKKCTKAGTGCGGCVPLVTTIFNKTMASMGQEVTNYLCSHFSYSRADLFNIVMVKRLKSMNEVMREVGNDKNAVGCELCKPAVASIMASLWNRHVMDKTTHGLQDTNDRFLGNIQRDGTYSVVPRVSGGEITPDKLVVIGEVAQKYNLYTKITGGQRIDLFGAQKQDLLDIWGQLVAGGMESGHAYAKSLRTVKSCVGSTWCRFGLSDSVGLAVRLEERYKSIRAPHKIKGGVSGCVRECAEAQSKDFGLIATEKGWNIFVGGNGGANPRHAELLAKDVPPTDVVTILDRYLMFYMRTADKLQRTARWIENLPGGIKYLQEVILEDKLGINASLEAQMEELVDSFFDEWAEAIKTPAIANKFKQFANTSDTTRNMELEDDRGQKRPAFWPNDAAAKDDFQGLKDKWSMTAWEPIIESSYFDGADELPNGISATIKRGDTQLAIWRIKGVYYATQQMCPHKRAFILSDGLIGQEGHKTEQNGDKAGAAPWVSCPHHKRNFDLENGACKTDESMSIATFPTEARPDGMLYLKLPPVDELDSALGTKKWMVKKGEAGEAPLAKLDSKIKFVGIRGKKPYVKPTGQSKMTTKPMDLMMASNGCGGGAPEW

SEQ ID NO: 19275 - protein, 484 aa, Kluyveromyces lactis NRRL Y-1140
MSIRNTINRIIIRRNMSDSIRHYDYLVIGGGSGGVASSRRAASYGAKTLLIEAKAMGGTCVNKGCVPKKVMWYASDLATRIGHAHSYNLFEDLPLTKENLTFNWPEFKKKRDAYIHRLNGIYERNLTKEGVDYVYGWASFTVDGKVQVKKADNCTETYTADHILVATGGKPIYPAKIPGYDYGVSSDEFFELEDQPKKVVVVGAGYIGVEIAGVFNGLGSDSHLVIRGETVLRKFDDCIQETVTDTYIKEGVNIHKSSNVTKVEKDESTGKLNIQLDTGKNIDNVDSLIWTIGRRSLLGLGLENIGVKLDAKEQIVVDEYQNSSVKNVYSLGDVVGKVELTPVAIAAGRKLSNRLFGPEKFKNQKQDYENVPSVVFSHPEAGSIGLSEREAIEKFGKDNVKVYNSKFNAMYYAMMEEKDKTPTRYKLVCTGEEEKVVGLHIIGDSSAEILQGFGVAIKMGATKADFDSCVAIHPTSAEELVTLT

SEQ ID NO: 19276 - protein, 399 aa, Synechococcus sp. RS9917
MATYGRFPLTLVRGKGCWVRDERGRRYLDAVAGIATCTLGHSDPALRRALADQLRKLQHVSNLYRIQEQEDLAHWLVDHSCADSVFFCNSGAEANEAAIKLARKHGHTVRGIEAPVILTAKASFHGRTLAAVSATGQPKYHQGFEPMVAGFDTFPYNDLDGFETTLKRWEAEGPRVAAVLIEPLQGEGGVNPGDRAFFQAVRQHCSQRGILLILDEVQTGMGRTGQLWGYEHLGIEPDAFTLAKGLGGGHAIGALLVQSHADHFAPGDHASTFGGNPFACRAGLTVARELQRRRLLRHVNARAEQLRQGLESLIQRHPDRLEAVRGWGLLQGLVLRDDWDVSAVDVVRAALDQGLLLVAAGARVVRMVPPLVISRREVTLLLQRLDASLASLPARATQA

SEQ ID NO: 19277 - protein, 318 aa, Ralstonia solanacearum GMI1000
MAAIVVAGELLAEFVAAERGQMLAEPGAFIGPFPSGAPAIFADQAARQGASVAYAGCVGHDVFGDAIIARLERDGVDTAQIRRIERPTGTAFVAYRDDGSRSFVYNIAHSASGCFDASDVDTRLFEGCRYFHVMGSSLSSEGAIAAIRRGLMEAARVGAKISFDPNVRAEMLGFQPMRAALNDILAVCHLFLPSEADLPFFCGAQAPERAIEALLATYPLLERVVLKRGAAGSTAFDRGGSVAVPAYPVGEVDPTGAGDCFGGTLLAALVAGLPIDAALRRANAAGALAVMQRGPMEGNSHAADIDRFLAERGVACPA

SEQ ID NO: 19278 - protein, 145 aa, Zea mays
MASLATVAAVKPSVAVKGLGGSSLAGAKLSFKPSRLSIKTKSIRSGGVVAKYGDKSVYFDLEDLGNTTGQWDLYGSDAPSPYNPLQSKFFETFAAPFTKRGLLLKFLILGGGSLLTYVSASSTGDVLPIKRGPQEKPKLGPRGKL

SEQ ID NO: 19279 - protein, 502 aa, Oryza sativa
  misc_feature (147)..(147): Xaa can be any naturally occurring amino acid
  unsure (1)..(502): unsure at all Xaa locations
MATWILGWLLWLPVFLISLYLVDILAHSCRRLPPGPRPLPFIGSLHLLGDQPHRSLAGLAKKYGPLMSLRLGAVTTVVVSSPEVAREFVQKHDAVFADRSIPDSIGDHTKNSVIWLNPGPRWRALRRIMATELFSPHQLDALQQLRXQEKVAELVDHVARLAREGAAVDVGRVAFATSLNLLSRTIFSRDLTSLDDRGASREFKQVITDIMEAAGSPNLSDFYPAIAAVDLQGWRRRCARLFTQLHRLFDDEMDHRKLHSRHGGPGENGKEKDDFLEVLLRLGARDDDIAGLDGDTLRSLFIDLFAAGSDTSSSTIEWAMVELLKNTLSMGKACDELAQVVGSRRRIEESEIGQLPYLQAVIKETLRLHPPVPLLPHRAKMAMQIMGYTIPNGTKILINVWAIGRDKNIWTEPEKFMPERFLDRTIDFRGGDLELIPFGAGRRICPGMPLAIWMVHVVLASLLIHFKWRLPVEVERNGIDMTEKFGLTLVKAIPLCALATPT

SEQ ID NO: 19280 - protein, 146 aa, Glycine max
  misc_feature (2)..(3): Xaa can be any naturally occurring amino acid
  misc_feature (10)..(10): Xaa can be any naturally occurring amino acid
  misc_feature (13)..(13): Xaa can be any naturally occurring amino acid
  misc_feature (19)..(20): Xaa can be any naturally occurring amino acid
  misc_feature (25)..(25): Xaa can be any naturally occurring amino acid
  misc_feature (37)..(37): Xaa can be any naturally occurring amino acid
  misc_feature (48)..(48): Xaa can be any naturally occurring amino acid
  misc_feature (53)..(53): Xaa can be any naturally occurring amino acid
  misc_feature (79)..(79): Xaa can be any naturally occurring amino acid
  misc_feature (124)..(124): Xaa can be any naturally occurring amino acid
  unsure (1)..(146): unsure at all Xaa locations
YXXVVAVLPXVPXYHRKIXXSQGCXIFREIGPVYPPXNQTHFSISYYXINYSXLRIWEFVEYIKIIYFNRDIEVYDNIXHLFYLPDGNFYSVIDFFCEKTLSHTPQYKVGYFHQFPYNVLLPTXLCHPPSLYFNPGMFVFQPNIST

SEQ ID NO: 19281 - protein, 564 aa, Pseudomonas aeruginosa UCBPP-PA14
MTETAKRPLYVPHAGPSLLEMPLLNKGSAFSTQERIDFNLQGLLPHNIETIEEQTERAYSQYNLCNTDLDRHIFLRSIQDNNETLFFRLLEEHLEEMMPIIYTPTVGQACQEFSKIYRTHRGLFISYPDRERIDDILRSATKNNVKIVVVTDSERILGLGDQGIGGMGIPIGKLSLYTACGGISPAYTLPVVLDVGTNNPDLLNDPMYMGWRHERVSGAQYEEFVDLFIQAIKRRWPNVLLQFEDFAQTNAMPLLERYKDELCCFNDDIQGTAAVAVGTLLAACKAKGEKLSEQTVTFVGAGSAGCGIAEQIIAAMQLEGLDEAQARRRIFMVDRWGLLTDDMSNLLDFQHRLAQKRADLGAWGGQQGDDLALLEVIRNARPTVLIGVSGQRGLFSEEVIRELHSHCKQPLVMPLSNPTSRVEATPQEILNWTDGQALVATGSPFQPVQVGDKRIPIAQCNNAYIFPGIGLGVIAARANRVTEGMLMAAANALANCSPIVTRGEGAVLPALGDIREVSKRIAVAVAKQAQAEGKALHTSDEVLNDAIEANFWFPRYRAYRRTSF

SEQ ID NO: 19282 - protein, 305 aa, Clostridium acetobutylicum ATCC 824
MNLEDIFSILPEKIEREVKRISDYNNLQEIRIKVNKPLIIQIGKKEIISNYIATKEDLKKTFNVMSGYSIYSVEDELRQGYITIKGGHRVGICGDCVLEENKIKTIKNISSLNIRICKEVTGCSNSIMKKIVYGNTVLNTIIISPPNCGKTTLLRDITRNISYGINSIQFRGKKVCVIDERSEIGACLNGVNQMDIGIRTDILDNCPKSIGIMMAIRSMAPEVIICDEIGTYDDIKSILTAVNCGVKLITTIHGFGIEDLNSRDVFKDAIKNNVFERAIVLSGRSGVGTVEYIYDFYTKERERGL

SEQ ID NO: 19283 - protein, 271 aa, Brassica napus
  misc_feature (225)..(225): Xaa can be any naturally occurring amino acid
  unsure (1)..(271): unsure at all Xaa locations
MSETGEKSRDISRWSLRGMTALVTGGSKGLGEAVVEELSMLGARVHTCARDETQLQESLLEWQAKGFQVTTSVCDVSSRVQREKLMETVSTLFQGKLNILVNNAGTCITKPTTEFSAEDFSFLMATNLESAFHLSQLAHPFLKASGSGSIVFMSSAAGVVHINVGSIYGATKGAMNQLARNLACEWASDSIRVNSVCPWFIATPLANKYIDHEEYNKEVEKVDPXSGVGEANEVSSLVAFLCFPAASYITGQVICVDGGATINGLSFKSLP

SEQ ID NO: 19284 - protein, 473 aa, Oryza sativa
MASKPSSRAESNQAAAAVPSLYGRALPSPPAVEFASAEGRRLFAEALQGGTMQGFSSLVSVFQTQSEPAFCGLATLAVVLNALRIDPGRRWKGPWQWFDESMLDCCEHLDTVRAEGITFGKVACLAHCSGADVRTFRAAQATLADLRRHLLRCASSQDCHLVASYHRKLLGQTGTGHFSPIGGYHAGQDMALILDVARFKYPPHWIPLPLLWEAMNTIDEATGLLRGFMLISRNTEAPLLIRAVSKLTCQCLVNQILNHLPPNAGNFIKWVIEVRRQEEGGSSPSKEANEMPFLKEKVLQQIRDTKLFQLVHKLQCSKQPCCSCSSLTDEDSISQIAASVCCEATALLSGNLSSRDGLFFSETCSGCTQVNDEGLKNVITGKVVSEGNGHVDKLSPISSTETCFCNSTLSNETVNYPSNTDILTVLLLSLHPSTWLCIEDEKLKAEFQSLVSTDDLPDPLKLEVCCLTPRTLH

SEQ ID NO: 19285 - protein, 305 aa, Escherichia coli CFT073
MQCEFKGVISALPTPYDQSQQIDMESLRKLIRFNIEQNIKGLYVGGSTGEAFLQNVAEREKILETVADESDGRLTLIAHVGGISTAESEVLAKAAKKYGYHAISAVTPFYYPFSFEEHCIHYRKIIDSADGLPMVVYNIPALSGVRFSLDQINELVTIPRVCALKQTSGDLFQMEQIKRNHPELVLYNGYDEIFASGLIAGADGGIGSTYNIMGWRYLEIFEAVKNNDVIKAKEMQVACNQVIDTLIQSGVLAGIKTLLYYMGIINTPVCRSPFSPVKEKNLDVLSKLAERLFEEHDRNKKMKII

SEQ ID NO: 19286 - protein, 125 aa, Acidobacteria bacterium Ellin345
MRDVIVTNQGPKAIGPYSQGIRANGFIYLSGQIPLDPATQQLVEGDIHAQTDRVLRNIQGMLEASGSSVAKVVKTTVFLKNMSEFTAMNEVYGMYFRDNPPARSTVEVARLPKDVLVEIEVIALA

SEQ ID NO: 19287 - protein, 364 aa, Rickettsia parkeri
DISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGW

SEQ ID NO: 19288 - protein, 167 aa, Adiantum capillus-veneris
MFLAIIKFQNYGQQVLEAANYIGQGFAVTLDHSNRLPITVQYPYEKKLPSERFRGRIHFEFDKCIACEVRVRVCPINLPVVDWIFLKDVKKKKLKNYSIDFGVCIFCGNCVEYCPTNCLSMTEEYELSSYNRHELNFDQTALGRLPPPASEDVSIQLVLNSRNSFRR

SEQ ID NO: 19289 - protein, 333 aa, Saccharomyces bayanus
HWRDLCYDVPVKGGERRILNNVDGWVKPGTLTALMGASGAGKTTLLDCLAERVTMGVITGNIFVDGRLRDESFPRSIGYCQQQDLHLKTATVRESLRFSAYLRQPSSVSLEEKDKYVEEVIKILEMEKYSDAVVGVAGEGLNVEQRKRLTIGVELAARPKLLVFLDEPTSGLDSQTAWDTCQLMRKLATHGQAILCTIHQPSAILMQQFDRLLFLQRGGQTVYFGDLGDGCKTMIDYFESHGAHKCPPEANPAECMLEIVGAAPGSHATQDYNEVWRNSDEYRAIQEELAWMEKKLPGKSKDPTADAHKPYAAPISYQFKMVTVRVCQQYWRS

SEQ ID NO: 19290 - protein, 209 aa, Brassica napus
  misc_feature (67)..(67): Xaa can be any naturally occurring amino acid
  misc_feature (196)..(196): Xaa can be any naturally occurring amino acid
  unsure (1)..(209): unsure at all Xaa locations
MRLLKVATCNLNQWAMEFECNMKNIKASISRAKAAGAVIRLGPELEVTGYGCEDHYLELDTLTHAWXLCSIGMPVIKGAEPYNCQVLCMNRRIIMIRPKLWLANDGNYRELRWFTAWKQRGDLDEFHLPIDVSEALSQTSVPFGYGYIQFIDTAVAVEVCEELFSPVPPHAELALNGVEVFMNASGSNHQLRKLDXRLNALMGATNARV

SEQ ID NO: 19291 - protein, 252 aa, Glycine max
  misc_feature (240)..(240): Xaa can be any naturally occurring amino acid
  unsure (1)..(252): unsure at all Xaa locations
FGSRLPTGSVYPTRDENGNLLVTEFGLCKYKDHQTLSIQEVPENSAPGQLPRTVDVIAEDDLVDSCKPGDRVAIVGIYKALAGKSKGSVNGVFRTVLIANNVSLLNKEANAPIYSAEDVKNIKEIAARDDAFDLLSNSLAPSIYGHSWIKKAVVLLMLSGVEKNLKNGTHLRGDINMMMVGDPSVAKSQLLRAIMNIAPLAISTTGPGSSGVGLTAAVTSDQETGERRLEAGAMVLADRXVVCIDEFDQMND

SEQ ID NO: 19292 - protein, 735 aa, Ralstonia solanacearum GMI1000
MFGPTSQPAAPPRQQVVSIAGLTEKLSYLKPADIKLVKEAFHFSDEAHLGQYRQSGEPYITHPVAVAEICAGWKLDVQSIMAALLHDVIEDQGVTKSELAEKFGPKVAELVDGLTKLDKLEFQSREQAQAESFRKMLLAMARDVRVILVKLADRTHNMRTLDHVPPEKRRRIAGETMEIYAPIAHRLGLNTTYRELQELSFRIGSPFRYATLEKAVKAARGNRREVVSRILEAAQRALGDAGVSAELTGREKTLYSIYRKMHDKQLSFSQVLDVYGFRVVVETQMHCYMAVGALHGLYKPMPGKFKDYIAIPKINGYQSVHTTLVGPFGTPVEFQIRTREMNQIAEAGVAAHWMYKQHHDEPDRAQQQAHQWLQSLLDIQSQSGDSQEFLEHVKIDLFPDAVYVFTPKGEIRALPRGATALDFAYAVHSDLGNQCVAVKINNALLPLRTELKNGDIVEVVTAPYSKPNPAWLTFVRTGKARAAIRHFLKTAKLDEAIQLGERLLEQALRQLGIDMKAVPAQVWERIVQWTGNKAREDIFADLALGRRVAAVVARRIEIGLQEGGHEGDEALIAAVHAFAGEEAPAVTVSGDEGMAMVFSPCCRPIPGDPIVGYIGKGEGLQIHVEECRVAKRLHGKDPEHWIDVMWAEHTTRAFDVSIKVLVRNTKGILARVAADLTSADANVAHVSMEQEGGGQEATYMTFLIQVHDRVHLADVMRALRRNLDVIRIARDRGGE

SEQ ID NO: 19293 - protein, 327 aa, Chlamydophila caviae GPIC
MSSQFEQLKLLSVLVCDTGDPELVKTSGSQDATTNPSLILKVAQEPKYQELLTEAIAWGIRQNGDDIQTLTFVLDKIQVNFGLEILKCIPGRVSLEIDARLSFNTEAMIQRAIFLSELFAATGGDKKRLLVKIPGTWEGIRAVEVLEKQGIACNVTLIFNLIQAIAAAKANATLISPFVGRIYDWWIAAYGDEGYSIDADPGVASVSNIYTYYKKFDIPTQIMAASFRSKEQVLALAGCDLLTVSPKLLDELKKDQSPVAKKLDVAAAKKLDVQPVELTESVFRFLMNEDAMATEKLAEGIRIFSGDTQILEAAVTEFIKQIAAQDA

SEQ ID NO: 19294 - protein, 415 aa, Oryza sativa (japonica cultivar-group)
MEAVAVAGGGAGLTRWQAAALSAVAGWVWAASSFDLTRRSRALVQPWVTRRVLAETPSIVRFQKVHHKLLDSFFSVLSCVVSVPFYTGFLPLLFWSGHSKLARQMTLLMAFCDYLGNSVKDAVSAPRPSSPPVRRVTATEDEKENAMEYGLPSSHALNTVCLMGYLLHYVLTYGSHDNVMVVTGLSLAFLLVMLVGIGRIYLGMHSLIDVIAGICFGVVILAFWLAVHNHVDAFVVSGQNVTTFWASLSLLLCFAYPKPEFPTPSFEYHTAFNGVAFGIVYGIQQTYFHFHNPDVPLIFSPQLPLIVFVGRVLVGIPTILVVKFCSKALSKWLLPVMCNTLGIPIVSTCYVPALKASEKCKVKSDAKQGGYLQKVFSLFPQKAYDVDTGIRFVQYASLAWSVVDLVPAIFTHLSL

SEQ ID NO: 19295 - protein, 817 aa, Pyrococcus furiosus DSM 3638
MAYRFIKWFEELSKNDVPLVGGKGANLGEMTNAGIPVPPGFCVTAEAYKYFVENVKVSKEDVKRILGEKVNKGTISEVLAQAPDEPRPLQDWIMDIISKTDVDDSKMLQENTEAIRTLIKSLDMPSEIAEEIKQAYKELSQRFGQEEVYVAVRSSATAEDLPEASFAGQQETYLDVLGADDVIDKVKRCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGRGTVMVKVAEYLGPEWVEKQVLTDEQIIEVAKMGQKIEDHYGWPQDIEWAYDKDDGKLYIVQSRPITTLKEEATAEEAEEVEEAEVILKGLGASPGIGAGRVVVIFDASEIDKVKEGDILVTTMTNPDMVPAMKRAAAIVTDEGGRTSHAAIVSRELGIPCVVGTKEATKKLKTGMYVTVDGTRGLVYKGIVKSLVKKKEEAKAEGGQVVVAGAPLVTGTMVKVNVSMPEVAERAAATGADGVGLLRAEHMILSIGQHPIKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIREAKRIAREVGLEPHKDVAWGVMIEVPAAAIIIEDLIKEGIDFVSFGTNDLTQYTLAIDRDNERVAKLYDETHPAVLKLIKHVIKVCQRYGVETSICGQAGSDPKMARILVRLGIDSISANPDAVQLIRQVVAQEERKLMLEAARKQLFEEEEEEELF

SEQ ID NO: 19296 - protein, 492 aa, Campylobacter jejuni subsp. jejuni NCTC 11168
MKQKCVLIITDGIGYNKNSKFNAFEAAKKPSYEKLFKEVPNSLLKTSGLAVGLPEGQMGNSEVGHMCIGSGRIIYQNLVRINKAIENKELEKNENLKKLLAKCKRVHIIGLYSDGGVHSMDTHFKAMLEICAKNGNEVFAHAITDGRDVSPKSGLNFIKDLKEFCENLGVHFATLCGRFYAMDRDKRWDRVKEYYECLLGKAYKVPNLLEYLQKSYDENVTDEFIKAAQNENYKGMREEDGIIFINFRNDRMKQLVEVLNSKDFKEFEREKIFENLLTMSVYDDKFKLPVLFEKEKIENTLAQVISKAGLSQLHTAETEKYAHVTFFFNGGKEELLENETRVLIPSPKVKTYDEKPQMSAFEVCDAVKKGIEKGEDFIVVNFANGDMVGHTGDFNATIKAVEAVDTCLGEILECAKKHDYAFIITSDHGNCEAMQDEKGNLLTNHTTFDVFVFVQARGVSKIKDNMGLSNIAASVLKILDLEIPKEMNEALF

SEQ ID NO: 19297 - protein, 470 aa, Lactobacillus plantarum WCFS1
MDVSESTNKKSNSHTGFLWLATFIAAMGSLLFGYDTGIVNGSLEFMAVKGQLDLTAFQQGIVSSGLTLGAAFGAIIGGPFADKIGRKKILTILGIIFSVGALGCAFATNITILIVFRFILGLAVGSASANVPVYIAEIAPTELRGKMVTTAQVMIVSGQFVAFGVNAALTPLGAQNAAIWRWMLGLGTIPGIILWIGMYLIPESPRWLVSQGKMDKALGVLRRIRSAASVESEMKEIQDKDKADKELNAEQATFKELISKRWVVQILITGAMLGIIQQFAGINSIMYYGGKIIQESGFDTTVAAILNAGNGFLSIVGAVLGMFTIDWLGRRKLEFAGLTICGITLVSAGVIHTVAPNASWAGITIVVLVYLYIIFFQGTLGPVTWLINSEIFPQRYRGIGTGITIFVLWIGNFIVGLLSPVLLEWNMSNTFYIFAVCCVLGIIFVALRVPETKGVPLEEIEKYFRTKYDK

SEQ ID NO: 19298 - protein, 465 aa, Bacillus cereus G9241
MTIVTFSKSTTDKPSYTYEELSEKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKAKKQRFVTLKEAYHGDTIGAVSVGAIDLFHQVYSSLLFEAIKMPYPYTYRSPYGNDKAEIVRKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGGYEEQKTFFHGHSYTGNPLGCAVAIANLELYEKTNLIEEVACKTEYVATQLEELFACKHVGDIRQCGLMVGIELVKNKETKEAFEWTERVGVQVCKRSRELGMILRPLGNTIVFMPPLASTIEEIDDMLRILYKAISDVTEGE

SEQ ID NO: 19299 - protein, 104 aa, Brassica napus
  misc_feature (82)..(82): Xaa can be any naturally occurring amino acid
  unsure (1)..(104): unsure at all Xaa locations
MGSTVHYCCVSRGNQILYGYNNGGDHHRNESLAALCLEKTPPFHKWYFETISKWTFGFLIEEDGLVYFAIVDEVFKRSSVLXFLENLRDELKKAAEKNSRGSFS

SEQ ID NO: 19300 - protein, 201 aa, Glycine max
MEFSQDDFDRLLLFEHTRKTAEANYAENPQDADNLTRWGGALIELSSFQAPRDAKAMIDDALSKLEESLLINPTKHDTLWCLGNANTSYAFLIPDITEAKGYFDKALEYFQKAAEEDPENDLYRKSLQVAVKAPELHMEIHKNGLGLMSNAGSSATSKEKESKKQKSNDFKYDIFGWIILAVGIVAWVGMAKSNIPPPPPR

SEQ ID NO: 19301 - protein, 433 aa, Synechococcus elongatus PCC 7942
MVTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 19302 - protein, 222 aa, Prochlorococcus marinus str. NATL1A
MLISVLTGFSAGAVHVVSGADHMVAMAPFSVRKPRVALINGLAWGIGHSAGVLILSILGILAKDLINIELLSSYAEFLVGISLLIVGGVAIKTSLKVNIHMHQHMHGEEATHKHFHFHSLGNKLHTSHTHAATGLGVLHGFAGASHLVAVIPALALPLFGALAYLFSYLLGSIFAMGCVVLGISFATSKANKMFYPFLMRSIGALSIVTGIFWLQKTSILTF

SEQ ID NO: 19303 - protein, 488 aa, Lactobacillus plantarum WCFS1
MSAEKSISSDHVPLSDPALKTINRNAGRNLNHIAFISTLGGLLFGVDTGVINGAIGYMATPAELNLSPNNEGLVTSGITLGAAFGAVFAGHLSDRIGRKRLLKYLALLFFVCTLACSLAPNALFMIISRVLLGLAVGGASVIVPTYLSEISTPEIRGRLVTQNELMIVTGQLLAFIVNAILGNWFGHISNIWRYMIGFGMIPAVALFFGMMVVPESPRWLVMVNQLDNAFDSLRKIRSHPETCNEEITQIQDTLNQESEIKQATFKDLSTPWIRRLVFIGIGLGVMQQFIGINIMMYYGTTILTNSGFAHNAALIANIGNGLVSVIATFIGMSIMNRVNRRSMLIAGIIGTTTSLILIVGVSAFLSQSPLLPILVVLCTMMFLGFFQGFISPLVWLLLSEIFPQNLRGLGMGVSTFFLWFANFLVGYFFPILLSAVGMTWTFLIFVFFNILSFIFAYKYAPETRGKSLELIQMEFKYGDTTGINPEDK

SEQ ID NO: 19304 - protein, 487 aa, Xanthomonas campestris pv. vesicatoria str. 85-10
MMAPTMSVTSAISQWPDVDQLYRRFDALVKQPMRPVRREGMDKVMRYFEQRCQGSKQLGDAAQRVIPGGVQHNLAFNYPFSLAMRSAEGAYLTDVDDNRYIDFLQAGGPTLLGSNPPALRARVNEVLDQCGPVTGLLHEYEVKLAELVCASMPAVEMVRLLGSGTEAVMGAVRLARAYTRKRWIIKIGGAYHGWSDQLVYGLRLPGTGRMEAIGIPRGATAHTQECLPNDLDALRRKLQFNRLRGGTAAVLLEPLGPESGTRPVHADYNRQVRALCDEFGALLIFDEVVTGFRLGPGGAQGYFGVAPDITVLGKCLAGGYPMAGAIGGRREVMMSLVGGIGTTARRAFVGGTLSANPLSCVAGYYALLEAQQNDAAGRAGRAGDRLRAGLEAIIQRRGLPYVVYNMGSIVHLQTSGVLLLDTGNLYKLWRVRNEAKARKHMMEEMGAAYSAHGLITLAGSRIYTSMADTDAVIDEALNRFDDVFALV

SEQ ID NO: 19305 - protein, 240 aa, Glycine max
MDTDGFVSFDHVSPEDSHEVHVLAVDDSLVDRKVIERLLKISACKVTAVDSGIRALQFLGLDEQRRTSESDGFVPDLKVDLIITDYCMPEMTGYELLKKIKESTMFREIPVVIMSSENILPRIDRCLEEGAEDFIVKPVKLSDVKRLKGYMTPKEVIKMRSQEDRRSDGYVNGGDGGVLEINNKRKLEEQDTSDVSLSPPSTSTLSSSPSVSSPSPSSSPTSSASVLASPIRRLKMTSTD

SEQ ID NO: 19306 - protein, 412 aa, Zea mays
  misc_feature (254)..(254): Xaa can be any naturally occurring amino acid
  misc_feature (271)..(271): Xaa can be any naturally occurring amino acid
  unsure (1)..(412): unsure at all Xaa locations
MRASVEEAGALLARSDSAGRRRRSPPPVQTASPRPGSLRRQSSSFREDVGHAASETYLVSRLTFTLLQYLGLGYRWMSQLLSLTIYAIVLMPGFIQVGYYYFFSSQVRRSVVYGDQPRNRLDLYIPEDNSRPCPVVAFVTGGAWIIGYKAWGALLGRRLAERGIIVACIDYRNFPQGTIGDMVHDASQGISFVCNNIASHGGDPNQIYLIGQSAGAHIAACALMEQAVKESGGNPVSWSLTQIKAYFGLSGGYXIGYLMKWYLVTIRYNSXGLMMDLKYNFSIMEGEESLSRYSPEIVAKTSSAETIALLPLVVLMHGTEDYSIPSSSSQTFVDVLQQAGAQARLLLYEGKTHTDIFVQDPLRGGRDPLVEDVLSIIHADDANACQKIALAPTPRRLVFEWQLKLARKISPF

SEQ ID NO: 19307 - protein, 449 aa, Triticum aestivum
  misc_feature (49)..(49): Xaa can be any naturally occurring amino acid
  misc_feature (59)..(59): Xaa can be any naturally occurring amino acid
  misc_feature (180)..(180): Xaa can be any naturally occurring amino acid
  misc_feature (193)..(193): Xaa can be any naturally occurring amino acid
  misc_feature (204)..(204): Xaa can be any naturally occurring amino acid
  misc_feature (320)..(320): Xaa can be any naturally occurring amino acid
  unsure (1)..(449): unsure at all Xaa locations
MAAHAALAATRIPTSARLHSKAASRQRVDFADFSGLRPGSCSVSAAARXEASFSDVLGXQLVARASGENAVRAPAEAKLKVAINGFGRIGRNFLRCWHGRENSPLEVIVINDSGGVRNASHLLKYDSMLGTFKADVKIVDNETISVDGKNIQVVSNRDPLKLPWAELGIDIVIEGTRSVXVDGPGAGKHLQGXGPRKVIITAPXAKGADIPTYVVGVNEGDYGHEVANIISNASCTTNCLAPFAKVLDEEFGIVKGTMTTTHSYTGDQRLLDASHRDLRRARAAALNIVPTSTGAAKAVSLVLPQLKGKLNGIALRVPTXPNVSVVDLVINTVKTGITADDVNAAFRKAADGPLKGILDVCDEPLVSVDFRCSDVSTSIDASLTMVMGDDMVKVVAWYDNEWGYSQRVVDLAHLVAAKWPGAGTGGSGDPLEDYCKTDPNAVECKVFDE

SEQ ID NO: 19308 - protein, 143 aa, Triticum aestivum
  misc_feature (24)..(24): Xaa can be any naturally occurring amino acid
  misc_feature (32)..(32): Xaa can be any naturally occurring amino acid
  misc_feature (35)..(35): Xaa can be any naturally occurring amino acid
  misc_feature (37)..(38): Xaa can be any naturally occurring amino acid
  misc_feature (42)..(43): Xaa can be any naturally occurring amino acid
  misc_feature (66)..(66): Xaa can be any naturally occurring amino acid
  misc_feature (72)..(72): Xaa can be any naturally occurring amino acid
  misc_feature (81)..(81): Xaa can be any naturally occurring amino acid
  misc_feature (87)..(87): Xaa can be any naturally occurring amino acid
  misc_feature (91)..(91): Xaa can be any naturally occurring amino acid
  misc_feature (103)..(103): Xaa can be any naturally occurring amino acid
  misc_feature (110)..(110): Xaa can be any naturally occurring amino acid
  unsure (1)..(143): unsure at all Xaa locations
MGPTVMGSSGTSVAPFQGLKSTAXLPVSRRSXSAXLXXVSNXXRIRCMQVWPIEGIKKFETLSYLXPLSTEXLLKQVDYLXRSKWVXCLEXFNKGGFVFREHXSSPGYYXGRYWDNVESWLCSGWTDATQGAQTKVGGGQRKE

SEQ ID NO: 19309 - protein, 370 aa, Xanthobacter autotrophicus Py2
MATHKLLLLAGDGIGPEVMAEVKRVAAWLDQAGLASFAIEEDLVGGCAYDAHGAAISEDAMVRAKAADAVLLGAVGGPKWASVPYEARPEAGLLRLRKDLQLFANLRPAICYPALADASSLKREVVEGLDILIVRELTGGVYFGEPKTIMDLGNGQKRAIDTQVYDTYEIERIAAVAFELARTRRNKVTSSEKHNVMKSGVLWKEVVTALHERAYKDVELEHNLADSLAMQLVRWPKQYDVIVTDNLFGDILSDIAAMLTGSLGMLPSASLGAADPVTGKRAALYEPVHGSAPDIAGKGIANPIAMIGSLAMALRYSFNQGEVADRIDQAIAGVLASGKRTGDIAGPGTETIGTQDMGKAIIAELDAATA

SEQ ID NO: 19310 - protein, 531 aa, Gibberella zeae PH-1
MSIKEDTKGHLEHLEHSNSPDSIQEVNIDDLDSIEQTQTGKFSWLVSITAAIGGMLFGYDTGIISAVLVYIHQDLGKTLTSQEKELVTSVTSGGAFIGAIFAGATADRYGRKVAIYVGCLLFTVGAIIQAASFSVAQMTVGRVVVGFGVGSAAMIVPLYIAECSPSKYRGRMIGLDNMSITGGQLVSYGVGAAFAHVSSGWRWMVGIGAFPAIILACLLPFCPESPRQLIFHGKPDEAAAVIRRIFPNGTEQQVQDKIQHLTYHVNEAKALNAGKSGWWVFKQLYVIPANFRALVSACGLMAISQLSGFNSLMYYSPLLFSLVGFSNPVAVGTIIAGTNFIFTWVNLMLVDRAGRRRILLCTVPFMGIFLVIAAVCFKFIPINHDLSLASDAKIGWPAIVVLISMVFFVGFYSSGIGNTAWLSSEFFPMEVRAMGTMMLTMTCWGSNIIVASTFLTQMENTTPSGAFGFYAAICILGWVCIYFCYPEVKGMTLEDIRDIFQHGFGVQRAREVQKQMKMANKAITSEVLTRA

SEQ ID NO: 19311 - protein, 328 aa, Oryza sativa (japonica cultivar-group)
MDNYVNLLGSNIDVENWDPSQNFPPTGQQPQHSPMVGEQPSAEVGGSSRPNNKRSKNFNTAEDQMLVSAWLNTTLDAITGVEQHRDSYWARIHQYFHENKNFPSDQNQNSLNNCWGTIQEQVNKFCGYYEQILNGPQSGMVVQDYITQAFTLYKSAEKKTFSLMHCWEILHHHPKWNDRLFQKRQKAHVDPLVRPSASTNSSEFHYSPDINTSDPLVRPPGKKVEKAKCPRGNTSSCSSESSPVVIALNNMWSEKKEMSAQSREERNDRLVEVISLEKERLKVEKRKLDIETHEREERIMNMDLSAMDGPRKTYYLRLQQEIIKAHMD

SEQ ID NO: 19312 - protein, 473 aa, Arabidopsis thaliana
MSSSVPNSDRKIVTGPAGYILEDVPHFSDDFPDHPTYPNPLQDNAAYSVVKQYFVDEDDTVPQKIVVHPDSPRGTHFRRAGPRQRVYFESDDVLACIVTCGGLCPGLNTVIREIVCGLSYMYGVKRILGIDGGYRGFYARNTIHLDLKTVNDIHRSGGTILGTSRGGHNTTKIVDSIQDRGINQVYIIGGDGSQKGAAAIFEEIRKRKLKVAVAGIPKTIDNDIPIIDRSFGFDTAVEEAQRAINAAHVEATSFENGIGLVKLMGRYSGFIAMHATLASRDVDCCLIPESPFFLEGSGGLFEFIDKRLKESGHMVIVIAEGAGQDLLSESMKESTTLKDASGNKLLQDIGLWISQRIKDHFAKKMTLTLKYIDPTYMIRAVPSNASDNVCCTLLAQSAVHGVMAGYNGFTVGLVNGRHTYIPFNRITEKQNKVVITDRMWARLLSSTNQPSFMKQADKIHSNQLVGEPGTMKW

SEQ ID NO: 19313 - protein, 430 aa, Clostridium acetobutylicum ATCC 824
MKNFIDVEEKLPIGKTIPLSFQHLFAMVGATILVPILTHMNPSIGLFCSGVGTILYILCTKAKLPAYIGSSFAFITPMVTASQNYGPNAMLSGVISAGIVYIIVSTIIRYTGVNWLNKILSPVVVGSVVIVIGLSLASSAIGWAGLDPHQAITSGASRTSWIVVSMVTLAVGVIGSMYFKGFLGVIPILIAIICGYVLALLLGVVPDKTIHTILSAKLFEIPPFMTPKFNINAMIIMAPVSFVTIAEHIGHVYVTNNVVGRDFTKEPGIHRSMLGDGVATIFAGLVGGPPNTTYGENIGVMAITKVYSVWVIGIAAVIAIILSFIGPVASVIANMPRPVMGGVSILLFGIIASSGYRMFVDGKIDFSLKKNLIVTSVIIVLGIGGASINFKFNGSPVVISGVALATIVGIVLNLILPEKSLSERQEEKTA

SEQ ID NO: 19314 - protein, 520 aa, Zea mays
  misc_feature (211)..(211): Xaa can be any naturally occurring amino acid
  misc_feature (487)..(487): Xaa can be any naturally occurring amino acid
  unsure (1)..(520): unsure at all Xaa locations
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSXGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKDAFISDGCLLRECNIEHSVIGVCSRVSSGCELKDSVMMGADTYETEEEASKLLLAGKVPVGIGRNTKIRNCIIDMNARIGKNVVITNSKGIXQEADHPEEGYSYYIRSGIVVILKNATINDGSVI

SEQ ID NO: 19315 - protein, 308 aa, Kluyveromyces lactis NRRL Y-1140
MSTYSYLADSTYGKDNVKFLKVKKSKTDPKVHEVMECNVQVLLKGDFEVSYTEADNTPIVPTDTVKNTILVHARKFDTWPIEKFAANLALHFTGKYAHVSGITVKIIQDRWIKYDVDNKESYHSFIHQGPEKKICFLDYDKKNGSSSYTLVTSIKDLTVLKSTGSMFYGYNVCEYTTLKPTTDRILSTDIFASLTWNSAKLGSLETLEAGKKDDIFNQYYASARDITLDIFAKENSPSVQATMYNMATAILKVAPEVEHVSYELPNKHYILFDLKWFKGLDNNNELFYPSPDPNGLIKCTVGRNQAKL

SEQ ID NO: 19316 - protein, 430 aa, Campylobacter jejuni subsp. jejuni NCTC 11168
MKTQMNYAKEGIFTKEMQIVAQKENLSKDFLLENIACGKIIIPANINHKSLDPNGIGFGLRTKVNVNLGVSNDCVDYSEEMKKVELAHKFGIEAIMDLSNYGKTSRFRDELVNVSKAMIGTVPVYDAVGFLEKDLKQINAKDFLDVVYHHAKSGVDFMTIHAGINSRAAHIFKQSKRLTNIVSRGGSVLYAWMMMKDAENPFFEYYDDLLDICLKYDVTLSLGDALRPGSTHDASDGAQISELIELSLLTQRAWDVGIQVMIEGPGHMAINEIEANMQLEKRLCKGAPFYVLGPLVTDIGAGYDHISGAIGGAVAAASGADMLCYVTPAEHLRLPNLEDVREGIVATKIAAHAGDIAKLPKERARDDEMSKARQEIDWEKMFKLAIDGEKAKKMFNERRPDDLNSCSMCGKMCAMNTMNQILKGEDVSLA

SEQ ID NO: 19317 - protein, 448 aa, Prochlorococcus marinus str. NATL1A
MLLSENLSSIKGLDARKAAWEVIQAVGGGSFADVALERIFNLYSFKSIDKALITELSYGAIRQRYYLDCWIDHLGKVPAKKQPPLLRWLLHLGLYQVLKMKRIPPAAAINTTVELAKTHHLRKLAPVVNGILRSALRSKERGLLLPKSNNPSLELAKNESLPVWFAEELIAWKGVEHAQQIAKAFNSVSPIDIRVNKLRADLKDVKELFDTCGIQNQLIPNCPSGLEVRAGIGEPRQWPGYEEGKWSVQDRSSQLIAPSLGPLPGEKILDACAAPGGKSTHIAELINNEGNLWSVDRSSRRSKKILANSERLGTKCLQILVADSNELLLKKPDWKGFFDRILIDAPCSGLGTLARHPDARWRMNQDNIQQLVAVQSQLLNSLAPLLKNGGKLVYSTCTIHPEENSHQIKNFLQSKSEFLLEYEKQIWPGEGDNGDGFYIAVLNKLKNQ

SEQ ID NO: 19318 - protein, 564 aa, Rhodospirillum rubrum ATCC 11170
MMHDSPLPPSSLTTAPRLPLPSGPVCAMLDAIIARFPDNPAIDFLGRKWTYRELGEQIDRACAGFQSLGVEPGTRVGLCLPNTPYYIICYYGVLKAGGIVVNFNPLYVERELRELVEDSGTTLMVTLDLRQIYPKVAALLGDTALERIVVCSMSAILPSVKSLLFSVLKRSELADVPTDRRHIGFAKLIATKTPPRPVAIDPATAVAVLQYTGGTTGLPKGAMLTHANVTGNLTQILGWFPEARWGEEKMLAVLPFFHVFAMTVAMNVALALGAELILLPRFDLETVLKTIARKKPTLFPGVPTIYSAIIGAVAKTPYDLSSLRFCLSGGAPLPIEVKTRFEELTGCTLIEGYGLSEASPVVCCNPLDGAIKPGSIGQPLPGTTVEIRSVLDPALIVPRGERGEICVRGPQVMAGYWRRPQDTEDTFIDGALRTGDIGYIDDEGYVFLVDRIKDVILCGGYNVYPRIIEEALYQHEAVAEAVVIGLPDDYRGEAPKAFVRLRDGHSATPEDLKTYLATQISRIEMPKTIELRDDLPRTMVGKLSKKALVDEERAKALAGADKAS

SEQ ID NO: 19319 - protein, 553 aa, Neurospora crassa
MKPFLGLRGQPLNLAVGAVAGCDFLLFGYDQGVMGGILTLPEFLGYFEQINPDAPGLTPHESSMRSTYQGISVASYNLGCFIGAIITIFIGNPWGRKKIILLGTSIMIVGAILQASATTLGHFIIGRIITGIGNGGNTSTVPTWQSETSKAHKRGKMVMIEGSLVTAGIMLSYWIDLGLSFAPGSVAWRFPLAFQIIFCILILIFIPFLPESPRWLVFKGRDAEAKEILAALNDVELDDPIVDTEFHFIHDTVVEMSKGSFKDLFTMDKDRNFHRTLLAYLNQVFQQISGINLITYYAAVIYSGLGMSDFLARLLAALNGTEYFIASWPAVFLVERVGRRKLMLFGAIGQAATMAILAGVNSRPDDKPYQIAGIVFLFVFNTVFAVGWLGMSWLYPAEIVPLRIRAPANALSTSANWIFNFMVVMITPVAFNKIKYQTYIIFAVINAFIVPVVYFFYPETACRSLEEMDMIFHKVDGWKGYFTVVHQAKVEPKWYDKDGQRIGGADFEKTAGYQSHSIPESSGFEKPTKAHVESPRADDGITSSSSDGGNRES

SEQ ID NO: 19320 - protein, 314 aa, Oryza sativa (japonica cultivar-group)
MGSGSLLKVLAKNFDVLAGPLVALAYPLYASVKAIETKSPVDDQQWLTYWVMYSLITLFELTFASIIQWLPFWPSMKLIFICWLVLPYFNGAAFVYQNYVRPMFVKHQMVNIWYVPQKKGLFGKSDDFLTALDKFIEENGPEALKKLTNKAGKSSKQSGKSWKDSKSSKESKDSKSSKESKEPKPSKDSKQLKPPKVSKESKPLKDSKEDKKAVKEDKKAAAKDSKEQKKALKDSKELKKALKDSKEQGSQKDSDELKPKSNKRVTFAEVEPEKELKASNSDWHPTSEYHSVYPEHNSWSSSFMIFEDENSYWN

SEQ ID NO: 19321 - protein, 393 aa, Agrobacterium tumefaciens str. C58
MRDIVAETGTPCFLYDNSAMRQAYRDLETALSGFADIYYSVKANPLPAIISLFREEGAGAEIASVGEYRAAVKAGVAPDNIIFAGPGKSMAELREVIEGGIGEIHIESAEEIARIEAINRPVKASIRINPVPDAQAGAMRMGGKATAFGFDEEELENVLKLFANVRHIDLVGIHIYGGTQILDADMLVSQWRHAIALAGRMAQMLGKPLETIDLGGGLGIPYFAGETSLDLAKVAAAIPDLKALLKAHPLIADAHVIVEPGRFLAGPGGLYVVEVNSVKTSRGTTFVVTDGGMHHHLAASGNLGQIVKRNYPIVAPAMMQAAHDETATIVGPLCTPLDTLARNATLPKLNAGDLLAILQSGAYGASASPGGFLSHTVAKEVLVEDGAFEVIGR

SEQ ID NO: 19322 - protein, 585 aa, Cryptococcus neoformans var. neoformans B-3501A
MFLSRLAARQTRVQSYLPRQIAYRSFSSTIAIGMSMNDDILTKAVLPDNELKNGEKKAVDFGEGKVLLSKINGRVYATSAFCTHYGAPLEKGVLSHDGRLVCPWHGACFNVCSGDVEDAPGLDSLWSFSANVKNGQIEVTASKKEVTSKVGRIVARKRTKDQMQNQGQVSEETVVIVGGGSGGIHTLESLRMNGFGGKIVLISAENYAPIDRTKMSKSLLDDVEKLQWRTPDELRDSFGVDFHPGTTVTKVDFEAQTVTDSSGVLYKYNHLVLSPGGRPKKIPIPGADLKGVVTLRHVEDTKTITSSITKDSDVVLIGTSFISMEASVAVLKKGPKSVTLVGMDDVPFQGLLGKEFGSALMESMKEQGIKFHMSAQIEKITASDSNPDHAGMLHVKGSDPIPANLIIMGTGVSPATSFLEGSVKLEEDGGVLVDEYLHLKGYKNVYAIGDIAHYIQYPDKFPRRVEHWNVASNHGREVGHNITHPDNPVIYTKVPIFWSSIGKGLRYLGTGAGYDDMYVDGNFKELKFAAYQAKGGKVTAVATMQRDPIVSKASELMRLDLMPPLEEIKKGKDILQIELINKGQK

SEQ ID NO: 19323 - protein, 132 aa, Boechera holboellii
ASWHPPWYSSYTAHYREAESMKEAMEELLYSYGTDIVFNGHVHAYERSNRVYNYELDLCGPVYIVVGDGGNREKMAIEHADEPGKCPEPLTTPDPFMGGFCAWNFTPSGKFCWDHQPDYSAMRESSFGHGIL

SEQ ID NO: 19324 - protein, 1448 aa, Botryotinia fuckeliana
MERLEHMSWRNKTPCMGLSWGTQHWTPTPQILTYINGLKCKFWHVQVFIWTQTNCTCRMMRLVDENGVIQRRAGIVFKNLKVCGSGSAINVQKNVGSLLMAPLRFKEFIGKGPEKTILNDFNGVLKSGEMLIVLGRPGSGCSTFLKSLMGELYGLDMKAQSEIHYNGITQKQMLKQFRGEIVYNQEVDKHFPHLTVGETLEFAASVRTPQQRLVEGTTRSAWAKHMTKVVMAIYGLSHTYNTKVGNDFVRGVSGGERKRVSIAEMALAGSPIASWDNATRGLDAATALEFTKSLRMTANLSGSCHLVAIYQASQQIYDQFDKAIVLYEGRQIYYGPCDQAKQYFEDMGWECPSRQTTGDFLTSITNPSERKARPGYENKVPRTPEEFEKYFKDSKIFQRMMSEMKSHEEEFPMGRKTLEQFKASRKGMQADHLRPESPYTVSIVMQTKLCARRAVQRLWNDKTSTITTIVGQIAMALIIGSIFYNTPSNTASFFQKGGVLFFAVLLNALIAISEINTLYSQRPIVEKQASYAFYHPFTEALAGVVVDIPVKFAIATCFNIILYFLSGLKREAGAFFVFFLFNFVAILTMSQIYRSIAAATKTISQALAIAGVATLAIVIYTGFVIPRPLMHPWFKWISWINPVAYAFEALFVNELHGKEFVCSTLVPTGPGYVQAGNNFVCAVAGSVVGATTVSGDDYLQAQFQYSYSHIWRNLGFLFAFMIFFLAFYLLATEFNASTDSKAEVLVFRRGHVPTNLLAAEKAAKNDEEAHAGNGSAVKEGNSDKQGDEVQALAPQTDIFTWKDVCYDIKIKNEPRRLLDNVSGWVKPGTLTALMGVSGAGKTTLLDVLAQRVSMGVITGDMLVSGKPLDASFQRKTGYVQQQDLHLETTTVREALRFSAMLRQPKTVSKKEKYDFVEEVIKMLNMEEFSEAVVGVPGEGLNVEQRKLLTIGVELAAKPALLLFLDEPTSGLDSQSSWAIVSFLRKLADNGQAVLATIHQPSAILFQEFDRLLFLAKGGRTVYFGDIGHNSETLLNYFESHGAAKCGEDENPAEYMLTMVGAGAQGKSTQDWHEVWKASDEAKGIQTEISRIQQEMGHQPSQDDSNSHGEFAMPFTVQLLEVMKRVFQQYWRTPGYVYSKLVLGVASALFIGFSFFHADASQQGLQDVIFSIFMITTIFTTLVQQIMPRFILQRDLYEVRERPSKAYSWKAFIIANIAVEIPYQIILGIMVFASYFYPIYTKNGIPPSGRQGLILLLLIQFFVFASTFAHMLISALPDAETAGNIATLMFSLTLTFNGVFQPPQALPGFWIFMYRVSPLTYLVSAIASTGLSGRQVICSDNELAVMQPPAGDTCGSYLQSYATAAGGSIYNPEAMADCQYCSSSNADQFLSSVAISYTTRWRDYGIVFVYIFFNIFMAVLLYYLIRVRKSSGKSLKEKFGALGALFKKN

SEQ ID NO: 19325 - protein, 132 aa, Boechera holboellii
ASWHPPWYSSYTAHYREAERMKEAMEELLYSYGTDIVFNGHVHAYERSNRVYNYELDLCGPVYIVVGDGGNREKMAIEHADEPGKCPEPLTTPDPFMGGFCAWNFTPSGKFCWDQQPDYSAMRESSFGHGIL

SEQ ID NO: 19326 - protein, 1412 aa, Botryotinia fuckeliana
MESEATFEDGISNITKVEDMGATIITPRSERTWHMASEIQEIKDRDEEGGQLPRKLGVTWQNLTVKGISSDATFNENVLSQMYPFHKKPKETPMKTIIDNSNGCVKPGEMMLVLGRPGSGCTTLLNVLSNNRLGYEEITGDVSFGNMSAQEAARYRGQIIMNTEEEIMFPTLSVEDTIAFAARMKTPYHLPPGIKTAEEYAQFNRDFLLRLVGISHTASTKVGDAFTRGVSGGERKRVSIIECLTTRASVFCWDNSTRGLDASTALDWVKAIRVMTDVLGLTTIVTLYQAGNGIYEHFDKVLVLDEGKQIFYGKQHDAVPFMEGLGFIRDSGSNRSDFLTGVTVPTERRIAPGFEKSFPRTADEVRAAYDQSSIKSQMLEECQSYATSEEAKENTSLFKDMVRLEKHKGVSENSAVTTDFGTQIKAAVTRQYQIMWGDKSTLIMKQGATVIQALVGGSLFYAAPNNSAGLFLKGGALFFSILYNALIALSEVTDSFTSRPILAKHRAFALYHPAAICIAQIIADFPILMFQVTHFGIVFYFMVGLKRTAGAFFTYLVSNFMTAMSMTALFRLIGAAFPTFDAATKVSGLTTVGLFSYMGYMITKPNMHPWFVWIYWINPMAYGFESLLGNEFHGQELDCVGPYLIPNGPGYTPGDGGQSCIGVGGAVTGATSVTGDEYLASMSFSHSHLWRNFGIVCAWWVFFVGLTIFFTSKWKLLGEGGRSLLVPREQQQKSKHLLQPKDEEAQAHEKSLKESASVSGTDTPNGSLNKDLIRNKSIFTWKNLTYTVKTSDGDRVLLDNVQGYVKPGMLGALMGSSGAGKTTLLDVLAQRKTEGTIHGSVLVDGRPIPISFQRSAGYVEQLDVHESLATVREALEFSALLRQSRDTPDEEKLRYVDTIIDLLELNDLEHTLVGRPGAGLSVEQRKRLTIGVELVAKPSILIFLDEPTSGLDGQSAYNTVRFLRKLAGAGQAILVTIHQPSAQLFAQFDTLLLLAKGGKTVYFGDIGQNASTLKDYFARHGEPCSPEANPAEHMIDVVTGLGNSGKDRDWNQIWLQSPEHEKLSQKLDAMVSEAAARPVEDTVDGYEFAASQWTQTKLVTHRMNVSLFRNIEYLNNKFAMHVSLALLNGFSFWMIGDHLSDLQRNLFTVFSFIFVAPGVIAQLQPLFIDRRDIYEAREKKSKMYHWAPFVTGLIVSEFPYLIVCALLYYVCWYFTAGLPSGANSAGSVFFVVILYELLYTGIGQSIAAYAPNAVFASLVNPLVITTLVSFCGVMVPYSQIEPFWKYWLYYLDPYNYLMSSLLIFTSWDKSVHCTPDELAIFDPSPNQTCGEYLDIYQRGMGAGINLWNPEATADCRVCQYTHGGDYLKGLNLAEKSYGWRNTGIVVAFVVGIYGLVYFMMKLRTKATKKAES

SEQ ID NO: 19327 - protein, 132 aa, Boechera holboellii
ASWHPPWYSSYTAHYREAECMKEAMEELLYSYGTDIVFNGHVHAYERSNRVYNYELDLCGPVYIVVGDGGNREKMAIEHADEPGKCPEPLTTPDPFMGGFCAWNFTPPGKFCWDQQPDYSAMRESSFGHGIL

SEQ ID NO: 19328 - protein, 132 aa, Boechera holboellii
ASWHPPWYSSYTAHYREAECMKEAMEELLYSYGTDIVFNGHVHAYERSNRVYNYELDLCGPVYIVVGDGGNREKMAIEHADEPGKCPEPLTTPDPFMGGFCAWNFTPSGKFCWDQQPDYSAMRESSFGHGIL

SEQ ID NO: 19329 - protein, 439 aa, Prochlorococcus marinus str. MIT 9313
MPALSSTMTEGKIVEWLKQPGDKVGRGESVLVVESDKADMDVESFQDGYLAAVLMPAGCSAPVGETIGLIVESEAEIAAVQANAPAAPASDPAPLKTAAKVVDDPAPASTPAPVVESPPVAAPPPVASQAVDTDKRIVASPRAKKLAAQMGVDLAKLRGSGPHGRIQAEDVQLAAGQPISVPQLAEGNASFATTHATSAGVAHAVSSPVGQSFGAPGETAAFNNLQQAVNRNMEASLAFPCFRVGYTITTDQLDAFYKQVKPKGVTMTALLAKAVALTLVRHPQVNAAYSTAGMVYPEQVNVAVAVAMDDGGLITPVLQNADRTDLYEMSRQWADLVKRSRSKQLQPEEYSTGTFTLSNLGMFGVDRFDAILPPGTGAILAVAASRPAVVAGKDGSIAVKRQMQVNLTADHRVIYGADGAAFLKDLAELIETRVESLAL

SEQ ID NO: 19330 - protein, 555 aa, Candida glabrata CBS 138
MSQSAISSTSATDPERQTPETKLEGEDFQLKADEASIQGAEIPRKPLGAYWTVMCLCLMIAFGGFVFGWDTGTISGFVAQTDFKRRFGQRHSDGTYYLSNVRTGLIVAIFNIGCAFGGLTLGRTGDLYGRKKGLVIVVSVYVVGIIIQIASVDKWYQYFIGRIISGLGVGGIAVLSPTLISETAPKHLRGTCVSFYQLMITLGIFLGYCTNYGTKNYSNSVQWRVPLGLCFAWALFMIGGMSMVPESPRFLVEKGRLEEARRSIAISNKLSMDDPGVTFELDTISAGVEAERLAGSASWGELFSNKGKILPRVIMGVMIQSLQQLTGNNYFFYYGTTIFKAVGLEDSFQTSIVLGIVNFASTFVGLWTVERFGRRRCLLWGSATMAACFVIFASVGVKSLYPHGRDHASSKGAGNCMIVFTCFFIFCFATTWAPIAYVIVSETYPLRVKNRAMAIAVGSNWIWGFLIGFFTPFITSAINFSYGYVFMGCLVFSYFYVFFFVCETKGLTLEEVNDMYEEGVLPWKSPNWVPPSRRDASYDIDAMMHDDKPWYKRFL

SEQ ID NO: 19331 - protein, 1134 aa, Coccidioides immitis RS
MRGSSLLPRRFREVTSADSADAGWMNRHVTKLLQVVSRRACFHPIHTIVVIALLASTTYVGLLDGTLFDSVKQANYSPGYLDVDTLLAGGRNLRLGQQTGWRWQVDDTFKLGDSDAARHLALTTFVFPDSSARSPQIAPLAENVPLPPNSSARSVPHTPSLLAPISQDSSLAFAVPYDEISPFLQAVREIPDSSGLKDGTEQKRWIMKAARSPVSGSRAALRIWLTEAWTSFIDLLKHAETIDILIMVLGYLSMHLTFVSLFLSMRRLGSKSWLAATVLISGGFAFLFGLLVTTKLGVPINMVLLSEGLPFLVVTIGFEKPIILTKAVLSASLGGSSQSAAGQGSDARKAPPVRSIQDAIQHAVKNKGFEIVRDYCIEIGILVIGAASGVQGGLRQFCFLAAWILFFDCALLFTFYTTILCIKLEINRIKRHVALRKALEEDGITRRVAENVASSNDWPRVNGGENGQGSNVSSSGIFGKKVRASSVPKFKFLMVGGFVLVNVLNLCTIPFRSRQDGQIMPALAKLSNVLAPAPIDPFKVAENGLDAIYVNAKSQGLETVVTVLPPIKYKLEYPSVHYAEPDTSVFDIEYTDVVGGRVIESLLKSLDDPIISKWIIAALTLSLVLNGYLFNAARWSIKEPETEKEPEKQQPEPLPKPVVVRQPVVKADGSVRTREECEQMLKDKLAYLLDDEELIDLSIRGKIPGYALEKTMECEGMSRTDAFTRAVKIRRAVVSRNASTSATTGSLEYSKVPYQHYNYSLVHGACCENVIGYLPLPLGVAGPLTIDGQSFFIPMATTEGVLIASTSRGCKAINAGGGAVTVITGDGMTRGPCVGFPSLARAGAAKVWLDSEEGQTVMKNAFNSTSRFARLQSMKTALAGTYLYIRFKTTTGDAMGMNMISKGVEKALHVMATEAGFEDMATISVSGNFCTDKKPAAVNWIDGRGKSVVAEAVIPGDVVKSVLKSNVDALVELNISKNLIGSAMAGSVGGFNAHASNIVTALFLATGQDPAQNVESSNCITIMKNVNGNLHISVSMPSIEVGTIGGGTILEAQSAMLELLGVRGSHPTTPGDNARRLARIVGAAVLAGELSLCSALAAGHLVRAHMAHNRAAPPPTRSMTPVSAAVATTLTDKK

SEQ ID NO: 19332 - protein, 546 aa, Rhodospirillum rubrum ATCC 11170
MISATMMTTPLLLSGVIEHAARCHGETEVVSRRDDGTLHRQTYADTASRARRLARALIELGAAPGDAIGTLAWNGNRHLELYYGVPGAGMVCHTINPRLFAEQIAFIIKDAGDRFLFVDPGFLGLLAGILPDLPALEAVVVMDDHAPAAELAGVRLLAYEEVLAAQTDDAFDWPSFDENAAAGICYTSGTTGNPKGVVYSHRSTILHALSAVQPDVFALSARDTVMPVVPMFHVNAWGMPHAAPMVGAKLVLPGGRLDGASLIELIRGEQVTATAGVPTVWQGLLGHVEAKGGGLAPLDRVVIGGAACPQSMMSRFAALGTRAIHAWGMTETSPLCVASVLTARHRDLGEDEALRLRLKQGRPAFGAELRIVDHAGRALPWDGVTRGMLEVRGPWICAGYLNNPDRTAFSADGWFATGDVATITTDGFMDIVDRTKDVIKSGGEWISSIALENIAIGHPAVREVAAIARPDARWGERPRLIVALREGATLTPGEMAAWFEGKVAKWWIPDDLVIVETLPHTATGKLQKRELRQVYGAERLESAQAL

SEQ ID NO: 19333 - protein, 177 aa, Triticum aestivum
  misc_feature (58)..(58): Xaa can be any naturally occurring amino acid
  misc_feature (68)..(68): Xaa can be any naturally occurring amino acid
  misc_feature (78)..(78): Xaa can be any naturally occurring amino acid
  misc_feature (147)..(147): Xaa can be any naturally occurring amino acid
  unsure (1)..(177): unsure at all Xaa locations
RTGFPSKNNVTPKWLIFPGLFSFKPARKVCFPTGGPTKTVLQTYLKRSLRCLDRVWDXQVLAVEHVTXLSQHSSVYDXLHEQNRCRVMQSYSSVSIVLVAETIEQSIEHAEKQLSHMIMISKFAGDQDQGADCFLIFQDHKSEAILXITLEQYKNVGKHVEILYKTSAKIMARGDDR

SEQ ID NO: 19334 - protein, 375 aa, Xanthobacter autotrophicus Py2
MRIRAAVLRASPVSKPYGQTRPLSIETVELAPPQAGEVLIKIAAAGLCHSDLSVINGDRPRQLPMVLGHEASGVVVEPGPGVTDLAPGDHVVMSFVPTCGTCPSCLDGRAQMCGPGQAANGAGTLLGGGRRLTCDDGTDAYHLCGISGFGEYAVISRRSIIKIDPEMSLVDAALFGCAVMTGVGAIVNTCGVRPGQSVAVVGLGGVGLSAVMGAVAAGAEQIVALDLSPAKLDIARSLGATDTFLANDPDVVDAVKAATKGGVDHAVEMAGSAPAFELAYKITRRGGTTATGGLANPNARVSLPPVHLVAEERTIKGSYMGSCVPPRDIPRFMALYQRGKLPVNRLLSSTGPLDEINEGFDRLDRGEVVRHVIVY

SEQ ID NO: 19335 - protein, 289 aa, Chlamydophila caviae GPIC
MKLLTACITPFLPNYEIDFLSFERILYSQKKEGNGVVLLGSTGESLALTVKEKESLVAFACSLKLQIPIVVGVSGTSLNDALEWMKICHAYPIDGFLIPSPIYTKPGVYGQTLWFESLLNTTDKPVILYNIPSRAGTPLYLETVGALASHPSCYGVKDSGGSIERCREYAQIAPHLVVYCGDDSLWPQMHSYGAQGLISVLSNSWPREARSYVDNPYQESNTLLWQELSLWLSLTTNPIAIKAVLAYKQDIAHSVLRLPLSIADLQNAEALPNVVEKMLKWSQIYPVHT

SEQ ID NO: 19336 - protein, 489 aa, Idiomarina loihiensis L2TR
MIKNGPYLALDTSYQKLSVDELLETAGKRLPEHFDDYRQQLCRGEYRNISEDRPVTHVLSRSVHAVAKQSNRKTRFVDTVQKLRSGRRLGSTGKPITDVVNIGVGGSDLGPQMGAFALREFANDAALHNLQVHFVSSMDGGQLYAVLPIVDPETTLFIISSKSFGTVDTFANVDTVRKWIEPELTQEQWLENHVIGVSANAQGMTDYGIPPAQQFTFGDGVGGRFSLWSALGLSIALTTGIRPFERMLEGAKAMDEHFLDAPLNENLPVLLALYGVYNREQLGINNLAILPYDGRLRMLPNYLQQLDMESNGKQYTAENEAIDYPTGPIIWGGFGPNGQHAFFQHLHQGYDQFTADFVTVLKREAPGFSDATRSGLAEQQRLAVANCLAHRRLMSDGSENADSPSDHYPGGHPSNLLIMDELTPESFGALIAAYEHKVFTQGVIWGLNSFDQPGVEKGKKIAMDVLRVLDGESDESFDESTDAVIQRMR

SEQ ID NO: 19337 - protein, 1484 aa, Magnaporthe grisea
MDQKANDVASLEEGNKAPSTANTAVGSLPRSADPSINLEELRVAAHQKNPNGTSNVGSGISVARAEADFAELQRELTGMSRASRRKSHASQRDAEKANGEDLGETSSSESEPFDLESWIRGGIQAEREAGIRPKHIGVYWDELTVKGMSAFTNYVETFPDAVIRFFDYYTPIKNKLGLGGKAPEATLLDSFRGVCKPGEMVLVLGKPGSGCTTFLKNITNQRYGYTGVEGDVLYGPFTAKEFEKYRGEAVYNQEDDIHHATLTVEQTLGFALDCKVPGKLPAGITKAQFKKDVITMLLKMFNIEHTRNTVVGGSLVRGVSGGERKRVSVAEMMITSGSILAWDNSTRGLDASTALDFIKSLRIQTNLYKTATFVSLYQASENIYKLFDKVLVIDAGRQVYFGPATEARGYFEGLGFLPRPRQTTPDYVTGCTDEYERAYSEGYSPDNAPHSPETLAEAFKKSDFAKRLDNEMVEYRESLKEDQQKYEDFKIAVKEGKRTGAKKSVYTVGFHRQVWALMKRQTVLKLQDRMALFLAWMRTILIAIVVGTLYINLGQTSATSFSKGGLMFISLLFNAFEAFAELGSTMLGRGIVNKHKAYAFHRPSALWIGQIFVDQAFGVPRVLAFSIIVYFMTNLFRSAGAFFMFFLFIMLGNIAMTLFFRIIGCISIDFDYAVKFAVVTITLLITTSGYIIQYQSQQVWLRWIFWINPLGLMFSSMMGNEFSRIDMTCTAESLIPSGPGYNNPENQVCTLPGSKPGSLEVSGSDYIRTGFAYDPNDIWRNFGIVMGLVAFFLIMNVVLGEVIEFGMGGNSALVYQKPNKERKELNEKLVAKREAQRSSKSEAQGSDLKIESKRVLTWENLTYDVPVPGGNRRLLNNVFGYVKPGQLTALMGASGAGKTTLLDVLASRKNIGVIGGDILVDGKKPGKEFQRSTSYAEQLDVHEPTQTVREALRFSADLRQPFDTPQEEKYAFVEEMITLLELEDLADSIIGWPEFGLTVEQRKRVTIGVELAAKPELLLFLDEPTSGLDSQSAFNIVRFLKKLANAGQAILCTIHQPNSALFENFDRLLLLQRGGRCVYFGDIGKDANVLRDYLKRHGAEASPTDNVAEYMLEAVGAGSAPRVGDRDWADIWEESPEHANVKDTISQLKEERKAEVANDSNSALEKEYASPISHQLKVTSHRTNLALWRSPNYLFTRLFNHVVIAIVTGLTYLQLDNSRSSLQYKVFIMFQVTVLPALILSQVEAMYHVKRGIFFRESSSKMYNTSAFAASMLLAELPYVVLCAVAFFLPLYYMPGFTYDSSRAGYQFLMILITEFFSITLAQALSSITPSTFISSQLDPFLMITFSLFCGVTIPFPQMPDGYKWLYQLDPFTRLIGGMVTTALHDLDVKCASIELNKFTPANGSTCEEYMRPFFNAGGNGYIVDPSSTAQCDYCAYSSGDQFYTPLGMTFDNRWRDLGIYLAFCASNIVIIFVANRFLNFNKR

SEQ ID NO: 19338 - protein, 568 aa, Cryptococcus neoformans var. neoformans B-3501A
MPDPSIPVVGHKTQRRLVGHNLLYSVSVFLSIGVWLFGYDQGVMSGIITGPYFKAYFNQPTSTQIGNMVAVLEIGAFITSLAAAHIADNYGRRMTLRTGAIVFTIGGAIQTFCVGYNSMVLGRIVSGFGVGMLSMVVPIYQSEISPADHRGLLGSVEFTGNIIGYASSVWIDYACSFFQSDWSWRLPLSVQCIGGSVLFIGSFVTPESPRYLVDTDQEVEGLAVIADFQGKALDDISVQAEYKEIRDAVLADRAVGDRSYRALWRRYKGRVLIAMSSQLFAQLNGINVISYYAPLVFEQAGWIGRDAILMTGINALFYVASSLPPWYLMDRAGRRPILLSGAVAMAIALTATGWWIYIDQAITPNAGSSFVLPLVICVVIYNSAFGMSWGPVPWLYPPEIMPLSFRAKGVSLSTATNWISNWWVGVSTPLFQELIGWRLYPMHAFFCALSFILVYFLYPETRGVPLEEMDKLFGDESDEDEVDSDFDEVEEAESEISSLVSNPRHRRRSASSSLGPSLPTSRKPSPIPSREASSSRGLFGRITDSVNGLIGSTKQQSRSVGYTAVNEE

SEQ ID NO: 19339 - protein, 150 aa, Triticum aestivum
NKFVQKSRLVPVRNSRDIVDPRVRAKQVGIKDEESVVVRITGCPNGCARPYMAEVGFVGDGPNSYQIWLGGTPNQTTLAETFMNKVKLQDIEKVLEPLFSYWNSTRQEGESFGSFTNRMVSGFYFSIRYCCSFVICERVVWTSEKMVICC

SEQ ID NO: 19340 - protein, 133 aa, Brassica napus
  misc_feature (111)..(111): Xaa can be any naturally occurring amino acid
  unsure (1)..(133): unsure at all Xaa locations
RQRLGEQRKVNPTTSRMIPKQPVPTSRLQMMSKPAAKRPPQRDIHDDGRPFKKKKPAIMSKDAKALSMIRQMFNTHRYPGRDDDDKNMEANFADIIKEKRPSARIAREEDXKEAQLIAPKKEPERLRKIRKNR

SEQ ID NO: 19341 - protein, 167 aa, Candida glabrata CBS 138
MSTPARRRLMRDFKRMKEDSPPGVSASPLPDNVMVWNAMIIGPADTPYEDGTFRLLLEFDEDYPNKPPHVKFLSEMFHPNVYANGEICLDILQNRWTPTYDVASILTSIQSLFNDPNPASPANVEAATLFKDHKSQYIKRVKETVEKSWEDNMDDMDDSDEDDEDDE

SEQ ID NO: 19342 - protein, 796 aa, Oceanobacter sp. RED65
MKFSENWLREWVNPKLSTDELVAQITMAGLEVDAVEPVAGEFSGVVVGEVVKKEQHPDADKLALCVVSDGSETFQVVCGAPNVREGLKIPFAKIGALLPPGKDGKPFKIKKAKLRGVESQGMLCAEAELQLSDAYEGLMELPADAPVGQDFREYLGLNDSIIEVDLTPNRADCLSLKGLAREVGTLNNEDVCEPKIEAVSASIQDTFKVTLEDAESCPKYLGRVIKGVDVSAQTPLWMVERLRRSGIRSIDPIVDVTNYVLLEQGQPMHGFDLAKLNGQIHVRKAKQDEKLTLLDGQEVKLDDDTLVIADDQKALAIAGVMGGEDSGVNSDTQYIFLEVAYFNPIAIAGKARKYGLHTDSSHRFERGVDFELQAPAMERATQLILEICGGEAGPVVESIEQTAMPASASIDLRADRVKEILALELPAEQIEEMLTRLGMKVSSTDAGWKVDAPSYRFDMAIEADLIEEIARIYGYNKLPVNTPSAAIGLQVQEEVQTPVEVIKQLWVDLGYQEAITYSFVDPKIQKLVDPSIDALALANPISADMGVMRSTLWVGLIKAAEHNLNRQQDTVRLFETGLRFVPQANGELEQTPMISGILCGQQVSKGWTNPSAKVDFYDLKGDVEAMLGLNGASDIRFERGEHSALHPGQAAKVVKNGKDIGLLGALHPELQKQLGIKTPLFVFELDLNAVSEGVLPHFAPLSKYPEVSRDLAFVVEESVTWSQVEDIIREKAGDKLINVTLFDVYRGQGIENGRKSLALGLTWQDASRTLNDEEITSWVNDIVQSLAEGLDAQLRG

SEQ ID NO: 19343 - protein, 490 aa, Candida glabrata CBS 138
MSRVETRNVTTEFQKDGLDEVDLVQANILAAGLDKKTVRVVNGLGKLMGSKEMVQVEFNKDKPTSKISASTPHISEQPWTLNNWHEHLNWLNLVLVCGLPMIGWYFVVSGKAKLTWQMALFATFYYALGGISITAGYHRLWSHRAYSARLPLKIFFAFFGAASVQGSIKWWGHSHRIHHRYTDTLRDPYDARQGLWYSHMGWMLLKPNPKYKARADISDLTDDWVVRFQHKHYIPMMLLSGFVLPCLLGGYLLNDYLGGLIYGGFIRIFVIQQATFCINSMAHYLGTQPFDDRRTPRDNWITAIVTFGEGYHNFHHEFPSDYRNAIKWYQYDPTKVFIYLTSLFGLSYDLKTFSQNIIQQALIQQRQKKIDRDSKSVNWGPKLADLPAWTKEEFLEKNRENDGLVIVGGIVHDVSGYITEHPGGEKLLKNALGKDATKAFSGGVYRHSNAAHNTLATMRVAVMKDNKETAMRFAQKRGERAERVERAHMN

SEQ ID NO: 19344 - protein, 392 aa, Xanthobacter autotrophicus Py2
MSAPVVIVGAGQAAAQAVTSLKAEGYAGDIIVIGDEPYLPYQRPPLSKAYLGDEMTEDRLELKAPKFYADAGAELRLATRVARLLPSEKAVELADGSRLAYGALLIATGTRARALPVPGAELAGLFSIRSIDDVKHFRASAVPGAKLVIIGGGYIGLEVAAKAKKLGLEVTVVEGQPRLLARVACATISDFARTLHEGNGVTILTGMGVARLVGTERVTGVELADGRVLPADLVLSAVGAVPNAELASEAGLVLENGISVDEATRTSAPDIYAAGDVASFPSRLYGRRVRLESVQNAIDQAKAAAKAITGGGVVYDPIPWFWSDQYDVKLQIAGLLDGCERTETEGEVAAGRFCVRYFAGDRLLAVCSVNDPKSHMLARKALATPPPVPAPG

SEQ ID NO: 19345 - protein, 454 aa, Synechococcus sp. RS9917
MADSAASQGVAATTGLGPRRVAWEVLEAVAAGAYADVALERALRGAGLSGADRGLATELAYGAIRRRLWLDAWLDRLGRVPARKQPPRLRWLLHVGLYQLFWMERIPAAAAVNTTVELAKHHRLARLAPVVNGLLRAALRARQAGDTLAMPADAAERLSLEQSLPLWFCRELLAWTGDVGCAAIPAAERIAAACNQVPPLDLRVNRLRSTPEAVAAAFAAAGLATRPIEGCGSGLQVLGAAGDLRQWPGYAEGHWCVQDRAAQWVAPLLEPRPGERLLDACAAPGGKSTHLAELIGDAGEVWAVDRSAGRLQRLAANAARLGCGCVNALAADACELLQERPQWRGAFQRVLLDAPCSGLGTLARHADARWRVTPATITELLPLQARLLEAMLALLAPGGRLVYATCTIHPAENQNQIATFLAAHPELTLHSEQQRWPDPAGGDGFYAAVITTPC

SEQ ID NO: 19346 - protein, 525 aa, Idiomarina loihiensis L2TR
MTRDIHDHRILILDFGSQYTQLIARRIREIGVYCELWAWDVDEADIREFAPKGIILSGGPESVAEEGSPRAPEYVFNAGVPVFGICYGMQTMAHQLGGSVQCSLEREFGYAQIELVEQSPLFKAIEDAVSESGAPLLDVWMSHGDKVEMIPEGFHTVAKTSYCPYAAMADEERQFYGVQFHPEVTHTRQGQRMLEHFVSDICGCEKQWTPAKIIDDAIERIREQVGSDKVILGLSGGVDSSVTAMLLHRAIGEQLTCVFVDNGLLRLNEAEQVMEMFGDHYGLNILPIRAEDRFLDALAGENDPEKKRKIIGNTFIEIFDEEAGKLTEVDWLAQGTIYPDVIESAGSKTGKAHVIKSHHNVGGLPEDMKLGLVEPLRELFKDEVRKIGLELGLPYNMLYRHPFPGPGLGVRVLGEIKKEYCDLLRRADAIFIEELHNADWYNKVSQAFAVFLPVRSVGVMGDQRKYDWVIAIRAVETIDFMTARWAHLPYELLEKVSNRIINEVNGISRVTYDISGKPPATIEWE

SEQ ID NO: 19347 - protein, 444 aa, delta proteobacterium MLMS-1
MEKVTEFMKVVTDKNPGESEFHQAVLEVVETLMPFIEDNPKYRETKILERMVEPERVIIFRVPWVDDKGEVQINRGYRIQMNSAIGPYKGGLRFHPSVNLSILKFLAFEQVFKNSLTTLPMGGGKGGSDFDPKGKSDNEVMRFCQSFMTELYRHIGAETDVPAGDIGVGGREIGFMFGQYRKITNEFTGVLTGKSRNWGGSLIRPEATGYGAVFFAEEMFKVRGDSLAGKTCIVSGSGNVAQYTIEKVNQLGGKCVTLSDSAGFIHDPEGIDDEKLAYVMELKNVKRGRISEYAEKYGCKYYPGERPWKIPGDVAFPSATQNEIDAQDAETLVAGGCTCVSEGANMPSTSEAVRIFLKAKIMYGPGKAANAGGVATSGLEMSQNSLKLSWPREEVEERLRQIMEGIHEACYKYGKEGDFVNYVKGANIAGFVKVADAMIEQGVI

SEQ ID NO: 19348 - protein, 755 aa, Xanthobacter autotrophicus Py2
MRGALGGPRVLLRRLREVMAEQVSAQDRLDKIVVLIAANMVAEVCSVYVLRVDQTLELYATEGLNRDAVHLTVMRVDEGLVGHVAREAESLALSDAHAHPEFSYRPETGEEVYNSFLGVPILRAGNTLGVLVVQNRARRTYTEEEIEALQTTAMVLAEMIASGELTALAKPGAEPAVRRPLHLKGVALADGLGLGHVVLHEPRIKVTNVIADDVVKETARLDAAIGKLRHSIDLMLEDDGLAKAGEHRDILEAYRMFAHDRGWMHKMREAVLSGLTAEGAVERVQSDTRARMMRASDPYLRERLHDLDDLANRLLRELTGRNRGSEREALPENAILVARNMSPAALLDYDRTRIRGLVLEEGGTTSHVTIVARALGIAAVGQVENAAGLADPGDPVIVDGQAGEVHLRPPGDVEEAYAEKVRFRARRQAQYAALRTRPSVTKDGVHIELHLNAGLLVDLPHVSETGAAGIGLFRTELQFMIASAFPRISEQLKLYRAVLDAAGEKPVTFRTLDIGGDKVLPYMRTVEEENPALGWRAIRLGLDRPGLLRSQLRALLRAGAGRDLRIMFPMVAAVEEFDRARAIVERELTHLRKHGHGLPEKVYVGAMVEVPSLLFQLDEILSRADFLSVGSNDLVQFLYAADRSNVRVADRFDPLSPPALRAFRMVAEAGQRHGKPVTLCGELASRPLEAVALAALGYRALSVSPASIGPVKAMMLELDVSAARKVLLPLLEDKTGTADPRAALAAFAKASGLPI

SEQ ID NO: 19349 - protein, 775 aa, Coccidioides immitis RS
MTVSYDQSYRTPNTAPLEDRFEVIRQIGDGSFGSVVVARVRTAGSHVAKRGTMVAIKTMKKTFESFSSCLELREVIFLRTLPHHPHLVPALDIFRDPLSKKLHICMEYMDGNLYQLMKARDHKCLDGKSVKSILFQILSGLDHIHAHNFFHRDIKPENILVSGSAPFESVLGRYATPPSTPPNYTVKIADFGLARETHSKVPYTTYVSTRWYRAPEVLLRAGEYSAPVDMWAIGAMAVEIATLKPLFPGGNEVDQVWRVCEIMGSPGNWYNKSGAKVGGGEWKDGIRLAQKLGFSFPKMAPHSLESILQPPQWPASLSHFVTWCLMWDPKNRPTSTQAINHEYFADAVDPLRPKSSTARLIGRKQSDKSFKAQGDSPGLSSKSSWFRRSLIGRSESPAPTLEQIDSSKQTPYNGGADSPAKAKASTSKRATWTHGAPMPILPSIRPVSPLSNAVHAQANSSITGDNSPSKANSKTASKKIGRQLSVNSNGNHYADIHRQEAERALNGGTNVTSPSALKESFFSHLRKRARRLSGRNQVPAPSDDVEASNGCVPWSNRSSMALDPVNIAEGKSGQDLLDLDTALQNVRYSMDMSSPPNVPIHTCGTTGNTPKRQSVPHAQAVRVTENGTIANGTSLSSRTRRVMQGSTRSVPRYETPEEEDELLHEVLHSTNSAARRLGQGSITMDEATRDTLFQNLNNQPSLSTDANRHNPYPTPSPTARRDGPAFLSDITPSKPLGMNKPGVESHRQWPTPPYDEAEWANATAADMFAAENTYR

SEQ ID NO: 19350 - protein, 477 aa, Chlamydophila caviae GPIC
MLCATISGPSFFEAKQQLLHSLPFVDSIELRIDCLLSLSSDQLKHLVCLAKKPILTLRRHASLSEIAWVERTMELAKLQPDYLDIDKDFPKEALRKIRNQYPNIKIILSYHSQTSEHVPTLYNEMLKQQAHHYKIAITSTKSVDALRLIQIKKHLPENTTVLCMGNEGIASRILSPLMKNAINYASGIHAPKVAPGQLSIEDLLAYNYANLSSEARIYGLIGNPIDRSISHLSHNKLFSELHMKTSYIKILLSSADLKEFFSLTRDLPFGGLSVTMPFKTDVLDYIDVFDPSVKHCQSCNTLVFNKNKITGHNTDGLGLLNLLKRKNIAVHNTHVGIVGSGGAAKAIATTFAYSGACISIFNRTEENGKKLAELCNGNAFPLSSLSEKHAIDILILCLPPHVKIPEIFPPVVIDINTLPKESPYTRKAKAQGCHVLYGYEMFAEQALLQFSLWFPRSLSQDDSERFRINVENIVNTM

SEQ ID NO: 19351 - protein, 132 aa, Oryza sativa
  misc_feature (22)..(22): Xaa can be any naturally occurring amino acid
  misc_feature (42)..(42): Xaa can be any naturally occurring amino acid
  misc_feature (47)..(47): Xaa can be any naturally occurring amino acid
  misc_feature (50)..(50): Xaa can be any naturally occurring amino acid
  misc_feature (64)..(64): Xaa can be any naturally occurring amino acid
  misc_feature (67)..(68): Xaa can be any naturally occurring amino acid
  misc_feature (71)..(72): Xaa can be any naturally occurring amino acid
  misc_feature (78)..(79): Xaa can be any naturally occurring amino acid
  misc_feature (81)..(83): Xaa can be any naturally occurring amino acid
  misc_feature (86)..(87): Xaa can be any naturally occurring amino acid
  misc_feature (91)..(91): Xaa can be any naturally occurring amino acid
  misc_feature (93)..(93): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(109): Xaa can be any naturally occurring amino acid
  misc_feature (111)..(111): Xaa can be any naturally occurring amino acid
  misc_feature (118)..(119): Xaa can be any naturally occurring amino acid
  misc_feature (121)..(121): Xaa can be any naturally occurring amino acid
  unsure (1)..(132): unsure at all Xaa locations
THAALLTKKPRDRRRAAAAARXGRGKGGKGLGKGGAKRHRKXLRDNXQGXTKPAIRRLARRGGXKRXXGLXXEETRGXXKXXXENXXRDAXTXTEHARRKTXTAXDXXXAXKRQGRTXXGXGGARREATRGR

SEQ ID NO: 19352 - protein, 630 aa, Candidatus Desulfococcus oleovorans Hxd3
MCGISGIITRSLAENQVLARLERMGQLQRHRGPDDRREQVFDGPEDRRIGLGLARLSILDLETGMQPIVCPEDGAAIVCNGQVYNYLELRRELAGQSFVSKGDIETALHTYRKKGLDFVNDLNGMYGGAIYDPVNHRVVLFRDRFGIKPLYYTTHKGTFVFASEIKPLLAGSGRPARLNEARLATFFTYRYVPGEQTLFEGVLRLPPASFLIYDLRTGKHEIHRYWNYQPDRPEPAMTPEAAQETFYDLFSDAVRIRLRSDVEVGALVSGGIDSSAVASQAVALRGPARLFTIAFEEQAYNELADVNAFLAANSGRFAGCDHIVQSCDRLMLERLPGIVESLEEPVSLGTVLPTDQVCELAGSHLKVVVTGEGADEIFAGYRKFLVEAAAHAYPTLLPADQKELAATYPELLPYLAVRHGDPAKRYIQSELLFDAPFLEQLLGRGGLDTAFPADALPTVDPAGHPVNTAIAFECRARLPDYVILRLDKLSMRHSLETRTPFLDYRLAEFAARLPVHLKLDTFAGMEKVVCRQAFERFGVLDRQTAFRKKKPFTIPLAPWLSEPDRLPEPIQEVVRGDMVARQGIVDPAIFKRLVENITSDNIGPHTLVSEADRVFAVIVFTLWYDRFMEK

SEQ ID NO: 19353 - protein, 286 aa, Oryza sativa (japonica cultivar-group)
MQSIDGVDQVLNHGVPVELTLSVLAVAHDFFRLPAEEKAKLYSDDPAKKIRLSTSFNVRKETVHNWRDYLRLHCYPLHRYLPDWPSNPPSFREIISTYCKEVRELGFRLYGAISESLGLEQDYIKKVLGEQEQHMAVNFYPKCPEPELTFGLPAHTDPNALTILLMDQQVAGLQVLKEGRWIAVNPQPNALVINIGDQLQALSNGRYKSVWHRAVVNSDKARMSVASFLCPCNDVLIGPAQKLITDGSPAVYRNYTYDEYYKKFWSRNLDQEHCLELFRTTPTDTS

SEQ ID NO: 19354 - protein, 136 aa, Candida glabrata CBS 138
MGSYLFILAVVVNCINLFGQVHFTILYADLEADYINPIELCSKVNKLIVPEAALHAVVSLLMLLNGYWFVFLLNLPVLAYNANKFYNKIQLLDATEIFRTLGKHKRESFLKLGFYLLMFFFYLYRMIMALIADSED

SEQ ID NO: 19355 - protein, 383 aa, Oryza sativa (japonica cultivar-group)
MAIVDLVNAGEQQQMGSKRAAAEDGDGGVDDSREYYCRRGVRHLCDSGITRLPGNYVLPASDRPGQAAGAAAAAGGSVKLPVVDLSRLRVPSERGAVLRTLDAACREYGFFQVVNHGVGGEVVGGMLDVARRFFELPQPERERYMSADVRAPVRYGTSFNQVRDAVLCWRDFLKLACMPLAAVVESWPTSPADLREVASRYAEANQRVFMEVMEAALEALGVGGGGVMEDLAAGTQMMTVNCYPECPQPELTLGMPPHSDYGFLTLVLQDEVAGLQVMHAGEWLTVDPLPGSFVVNVGDHLEILSNGRYRSVLHRVKVNSRRLRVSVASFHSVAPERVVSPAPELIDDRHPRRYMDTDLATFLAYLASAAGNHKSFLHSRRLY

SEQ ID NO: 19356 - protein, 231 aa, Sorghum bicolor
MGRGRVELKRIENKINRQVTFAKRRNGLLKKAYELSVLCDAEVALIIFSNRGKLYEFCSGQSITKTLERYEKHMRPDTAVQNKENELVQSSRNEYLKLKARVDNLQRTQRNLLGEDLGSLGIKELEQLEKQLDSSLRHIRSTRTQHMLDQLTDLQRREQMLCEANKCLRRKLEETSNQVHSKCGARCQLTRLRAATPPHSRPHHILAMDCSFIPWKLQQSQPCRSGSLLNI

SEQ ID NO: 19357 - protein, 297 aa, Arabidopsis thaliana
MGKQVDSKTITWVIENFSSLQSASIHSDQFVVGDCKWRLKAYPKGNEKATYLAYRANNLALYLNVANSKSFPIGWTRHTKFSLTLVNQKSEKLSKLTESQHWFDHKSTSRGFPAMIPLTNLHTNEGFLVNGELTLVAKVEVLEVVGKLDVSKKSSPVMETIDVNGFQVLPQIESVNRLFAKHLDIASKFRPKKPYMKTAYMNVLLSLTKTLCQSPQDLSNDDISGAGAALTYLREAGFKLDWLEKKHGEIKEKKKKEEASLKRLQEMEKQIFNEAQIYKEKVLAARAPLSLNEDNVF

SEQ ID NO: 19358 - protein, 319 aa, Clostridium acetobutylicum ATCC 824
MKTIAVLTSGGDAPGMNAAIRAVVRTAIEKGINVKGIQGGYSGLINGEIFDMNRHSVSDIIQRGGTILRTARCPEFLKEEVRQKAANVLRVFGIDGLVVIGGNGSFMGAQKLSKLGVKTVGLPGTIDNDLPYTDYTIGFDTTLNTVLDAINKLRDTSTSHERVSIIEVMGRDCGDIALFSGIAGGAESVIIPEIGYDFNELCKNILEGKLRGKMHNLIILAEGVGGAAELAKKVEEVTGIETRSTILGHIQRGGSPSAFDRMLASRMGVKAVEVLMEGKTSRVIGIKEGKIMDQDIDEALAVPRSFNKELYDIANMLSK

SEQ ID NO: 19359 - protein, 255 aa, Medicago truncatula
MYPGGYTAEITNLTPRATENDVQNFFGYCGVIERVDVIRSSDYESTAYVTFRDAYALETALLLNGSMILDRCISISRWETYTDDSNNWNNLTPNHEDSITYSQDMHMDKFVSSPGEALTMAQQVVKTMVAKGFVLSKDAFVMAKAFDESRSVSSTAANKVAELSNKIGLTETINSGIETFKSVDEKYHVTDITKSAATVTGTTAIVVATVTGRAAMAAGSAIANSSYFAKGALWVSDMLSRAAKSTADLGHHQNK

SEQ ID NO: 19360 - protein, 634 aa, Xanthomonas campestris pv. vesicatoria str. 85-10
MNQPTEPLDMDVCAREPIHIPGLIQPYGVLLVIEPADGRIVQASSTAADLLGVPMDALLGMPYTQVLELPDAQPFAVDDQPQHLLHADVRFPQRSAPTDHPWVAAWHLYPEQWLIEIEPRDARLMDVTLREALPLLRSIERDAGIDEAAVRAAKGLRSMIGFDRVMVYRFDEEWNGDVIAEARQPELEAYLGLHYPASDIPAQARALYLRNRVRQIADVRYQPSPIQPTLHPRLGTPVDLSDVSLRSVSPVHLEYLANMGVSATLVSSIVVNDALWGLISCHHYSPHFTSHAMRDATDAVTRALAGRIGALQAVGRARLESVLLTIREKLITDFNDAEHLTVDMLADMAPDLMDVVDADGVAIFHGNEISRHGSVPDAEALRRIRDHIESEHHDALREDAVGALHVDAIGEVFPELADLAPLAAGFIFVPLMPQSRSALLWTRREQVQQVKWAGNPQLAKLQDIPNSRLSPRKSFDLWQQTVRGRARRWSPLHLESARSLRVLIELMERKRFQQDFTLLEASLSRLRDGVAIIERGAKGAAHRLMFVNPAFAELSQTEVAELIGCDILALLADDAARGKVELFEEALRLGRAAYVTLPLRTRDGAPVYRQFHLEPLPSPSGVTAHWLLQLRDPE

SEQ ID NO: 19361 - protein, 527 aa, Chlamydophila caviae GPIC
MNKKGFLDSSSTKILQDLAVAPIDLTAPGVISKERIERFSLSVEGFTLSYATERVDEGILSALEDLASERGLIESMQAMQNGEVVNYIENFPSESRPALHTATRAWVKESPLQGNAEDISLRSKIEAQRLKDFLNRYRDVFTTIVQIGIGGSELGPKALHWALKGCCPSDKKVYFVSNVDPDNAAEVLQEIDCAKTLVVTVSKSGTTLETAVNEELLADHFLKQGLHFQDHFIAVTCEGSPMDDTSKYLEVFHIWDSIGGRYSSTSMVGGVVLGFAYGFDVFLQLLEGAASMDLAALEPRMSENLPLLSAMLGIWNRNFLRYPTSAVVPYATGLEYFPAHLQQCGMESNGKSVAQTGEVIGFATSPILWGEVGTNSQHSFFQCLHQGSDIVPIEFIGFQENQRGKDIVIAGSSSSQKLFANMVAQSIALAKGRENTNPNKNFRGNRPSSLLVSERLTPYTMGALLAFYEHKIVFQGFCWGINSFDQEGVTLGKDLANQVLQVMQGQEKEGALLEAEALLRLFNNIKK

SEQ ID NO: 19362 - protein, 265 aa, Pyrococcus horikoshii
MVLYFIGLGLYDERDITVKGLEIAKRCDYVFAEFYTSLMAGTTLGRIQKLIGKEIRVLSREDVELNFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLHIVEAEYLVEIAGAPREILRVNV

SEQ ID NO: 19363 - protein, 429 aa, Escherichia coli
MTTDDLAFDQRHILHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 19364 - protein, 192 aa, Coprinopsis cinerea okayama7#130
MQTIKCVVVGDGAVGKTCLLISYTTNKFPSEYVPTVFDNYAVTVMIGEDPYTLGLFDTAGQEDYDRLRPLSYPQTDVFLVCFSVTSPASFENVKEKWFPEVHHHCPGVPCLIVGTQVDLRDDAQVIEKLARQKQRPVSAESGERLARELGAVKYVECSALTQKGLKNVFDEAIVAALEPPIVPRKKNKCNVL

SEQ ID NO: 19365 - protein, 480 aa, Roseovarius nubinhibens ISM
MIEKKEFYINGAWTAPAAARDHEVINPSNEEPCAVISLGDQADTDAAVAAAKRAFPAWASTPVEDRIAKVEKLRDIYKRRGEEMAQAISLEMGAPIDMASTQQVGAGSWHMDALIKAGREFHWVAPLGDHAPNDRIVHEPIGVAAMITPWNWPMNQISLKVAAGLIAGCTMVLKPSEESPLSAMLFAEMVDEAGIPAGVFNLVNGDGAGVGSQLTAHPDVDMVSFTGSSRAGKLISKSAADTLKRVSLELGGKGANLIFADADDKAVKRGVLHCMNNTGQSCNAPTRMMVERSIYDKAVETAAEVAQSVTVAAADQSGNHMGPVVNKTQFDKIQDLIQTGIDEGARLVAGGTGRPEGLNRGFFIKPTVFADVTPDMTIAREEIFGPVLSIMAFDNEEQALEMANDTVYGLTNYVQTQDPARLKRAALALRSGMVEMNGKGRGLGSPFGGMKQSGNGREGGKWGLEDFLEVKAVSGWPDEA

SEQ ID NO: 19366 - protein, 594 aa, Neurospora crassa
MRRAAVKALRASYQCTCRGLRVSSRGSPLPLLQSSKAASSGSPTAHYNPRLGTATARYLSSTGARDSSGLVAYGAWYNSGDSNSESPIASTTSATTTATGAVPTRSVLVIGADELHTGTFVGDGPISKTTSDNERVVEMLSPEQATRKLRQYEQSVYVNRGQGVVRYDVAQLPSNDPIEDDHAEKIVEVPNKAPSSDPSDWMFWGVFDGHSGWTTSAKLRQALISFVARELNETYKSSPDLIPSAAAVESAIKTGFTRLDDEIVHQSVQRVLKSNNRLVAAEHLAPALSGSCALLSFYDSKSKLLRVACTGDSRAVLGRRSESGKWTATALSTDQTGSNPDEAARLRKLHPGEEHVVRHGRVLGGLEPTRAFGDASYKWSRELSEKLREKFFGRSVSPLLKTPPYVTAEPVVTTTKIEPEKGDFVVMATDGFWEMLTNEEVVGLVGKWIESQAGSSSKSSGYFSFLQKGSKTALPVESSESEKNSGNKTPIRQRQWGATGTDPMERFVVQDKNVATHLVRNALGGKNQEQVSALLTLPSPFSRRYRDDLTVQVIFFGYDGPKTGEIVVNKEATAAALAAAAADGNKTGPVKPKL

SEQ ID NO: 19367 - protein, 80 aa, Brassica napus
IVLPALALPSRIAGSAFLIMFLVGTVVAMGSYTAFIGSCSEALKEKVPRITEKLTWVSSLVAIGLGLGIVISPFFGFSLY

SEQ ID NO: 19368 - protein, 169 aa, Nicotiana tabacum
GLIVSFGEMLIDFVPTVSGVSLAEVPGFLKAPGGAPANVAIAVTRLGGKSAFVGKLGDDEFGHMLAGILKQNGVQADGINFDKGARTALAFVTLRADGEREFMFYRNPSADMLLTPDELNLEVIRSAKVFHYGSISLIVEPCRSAHLKAMEVAKEAGALLSYDPNLRLP

SEQ ID NO: 19369 - protein, 413 aa, Treponema denticola ATCC 35405
MASTYEKLLTTITEAAKTANLEEDDYISLLSPEREMHVSIPVKMDNGKIKVFSGYRVQHSTLRGPAKGGIRFHQDVNIDEVRSLSAWMTFKCAVADIPYGGGKGGICVNPSNLSETELEKLTRGYTRRITSFIGPKTDIPAPDVGTNAKIMSWIVDSYSSYAGEFTPAVVTGKPLPLGGSKGRVEATGRGVLFATREILKKLNKTLKDQSVVIQGLGNVGGVTADLFYKEEARIIAISDTSSAIYNEKGLDIPQILKHKKGGKKLKSFEGDFKRITNEELLELKADILIPAALENQITEKNASNIKASIIIEAANGPITPEADKILEKKNIITVPDVLANSGGVIVSYFEWVQNLQGFYWTEEEVNKRLEDKMIEAFKLVWDVKEAYKVSMRKAAYIKALKELVETQKVKGIN

SEQ ID NO: 19370 - protein, 426 aa, Acidobacteria bacterium Ellin345
MPEVHSSLPIPSGPSFLRKLVAFAGPGFLVAVGYMDPGNWATDLAAGSQFNYALLSVVLISSLMAILLQSLSLKLGIVVERDLAQACRDAYSKPVSIGLWVLAEIGIAACDLAEVIGSAIALQLLFHIPLTIGVCITAGDVLLMLLLQQRGFRYIEAIVVTLIATISICFGLEILYSRPELWPMLAGFLPHQELVTNHAMLYIAVGILGATVMPHNLYLHSAIVQTRQYERTPEGKREAIKYCNIDSAIALSFAFLVNAAILIMAASVFYRSGHREVAEISDAYRLLSPLLGVTGASVIFAIALLASGQNSTLTGTLAGQIVMEGFLSIRLKPWLRRLVTRLIAIIPAVIISFFYGASGTAKLLIFSQVVLSMQLSFAVFPLVAFTSSKEKMGEFANGALLKLVAWTVAIVIAGLNIWLLVEAVRG

SEQ ID NO: 19371 - protein, 306 aa, Lactobacillus plantarum WCFS1
MNTVTVIGSINLDRTIRVENMPKPGETIHTKEIFSAGGGKGANQAVAAQRSGANTHFIGAVGDDAAGKTMLDLLTQEKINLAGITKMTNQSTGQAYVTVDDAGENQIMIHGGANMAFTPADVEAHRDIIETSDFVVAQFESAVDSTVEAFKIAQAAGVRTILNPAPAMEKVPAELLAVTDMIVPNETETETLTGIAITDEVSMLKASAALHALGISAVIITIGSKGAFYDIDGRHGIVPAFKVEAVDTTSAGDTFIGAMSSVLNKDFSNLEDAIRYGNRASSIAVQRFGAQPSIPYKNEITAAEGK

SEQ ID NO: 19372 - protein, 720 aa, Xanthomonas campestris pv. vesicatoria str. 85-10
MTLARRALPFVLGLLPLAASADPAFDRCLAGLQPQAAAKGVDAASFQRFTAGLAPDPSVLPLLDAQPEFTTPIWDYLASLVDSQRVSDGQAMLVTHRELLARLSEQTGVDPATIVAVWGVESDYGRVTGKRPLLVSLATLSCAGRRQPFFRGEFLALLSLLQQGDLSAEGLTGSWAGAFGQTQFMPSTYARIAVDGDGDGRRDLVTSIPDALASTANYLVKAGWERARPWGMEVTLPRGFDASKAGRTRRQPLQAWQRAGLLGTDGTPLAPAGLPAETPAALLLPAGASGPAFLVFGNYDAIYAYNAAESYALSIALLADRLRGGPGLIAAWPTDDPGLGRPERRELQQLLLARGYQIGEADGMVGSATRRAIQVEQTRLGLQPADGRPGQRILTALRAAPPVTGAAAMRATAFKLPAAYPAFAQSPSVHKASPMSDTTGLTTGDFHGFPSLLIDTPFSTAAISLFGGQLLSFVPKGGQDVMWLSPSAKQPPTPIRGGAPVCWPYFGRQDQTGDVPAHGFVRTVAWQLTESRREDDGTVVLTLTPPRFDDLALRLRMTLRIGRTLEQRLITENTSAAPVRFTQALHNYFRVGDALKVSVQGLDGLDYLDKYENYATAHRQQGDWSLRDPRDPGRSDRIYTNAGGRYTLTDPVLGRRVVIATEGSRSLVAWNPGEEAGRQMADVGEGWRDYVCLEAANAGPDVIELAPGASHTLTQTISVE

SEQ ID NO: 19373 - protein, 472 aa, Oryza sativa
MASDIGELLPPWTSPSKIELPFRVAAYITLYESSSFAFNALLRSPFLATAHCAHNTLAPIQSGVMRLIAAFPRRPAAGDAMLHLRQCLLPLLRAAAAAHPHTSAASSSSLHLSRRLFSTAAGPDTAPPFSVEEYLVATCGLTGAQALKASKKLSHLRSPAKPDAVLAVLSGVGLSRADLAAVVAADPMLLCARARNVARRLHSLRDRVGLSDADVARFLLAGGAMGLRKCDIAPRLEFWIGFVGSFDKLLPALKGNNGILMSDLDKVVKPNIALLQECGLSVCEIAKLSTLKWTVLSLSPERVKASVLCVEKLVVPRSSDRFKHVLKSACWISEDMLAMKMEFLRSTLGCSEDKLRAAVCISPHIFYLSDKNLCRKIDFLISEVGLEREFIVERPWVLGYSLEKRMVPRHSVMKILRTMGLMKDAVDFSSSLVYSEKKFVARYIDPYKQAAPTLADSYAAACAGKMPAHVHR

SEQ ID NO: 19374 - protein, 430 aa, Bacillus licheniformis ATCC 14580
MPYIVDVYAREVLDSRGNPTVEVEVYTESGAFGRALVPSGASTGEYEAVELRDGDKDRYLGKGVLTAVNNVNEIIAPELIGFDVTEQVSIDKLLIELDGTENKGKLGANAILGVSMAVARAAADFLQIPLYQYLGGFNSKTLPVPMMNIVNGGEHADNNVDIQEFMIMPVGAENFREALRMGAQIFHSLKSVLKEKGLNTAVGDEGGFAPNLGSNEEALQTIVEAIEKAGFKPGEEVKLAMDAASSEFYNKEDGKYHLAGEGVVKTSAEMVDWYEELTSKYPIISIEDGLDENDWEGHKLLTERLGSKVQLVGDDLFVTNTKKLAEGIKNGVGNSILIKVNQIGTLTETFDAIEMAKRAGYTAVISHRSGETEDSTIADIAVATNAGQIKTGAPSRTDRVAKYNQLLRIEDQLAETAQYHGIQSFYNLNK

SEQ ID NO: 19375 - protein, 265 aa, Pyrococcus horikoshii
MVLYFIGLGLYDERDITVKGLEIAKYCDYVFAEFYTSLMAGTTLGRIQKLIGKEIRVLSREDVELNFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLHIVEAEYLVEIAGAPREILRVNV

SEQ ID NO: 19376 - protein, 511 aa, Bacillus licheniformis ATCC 14580
MSNKLAALIILDGFGLRDETVGNAVAQAKKPNFDRYWNKYPHQTLTASGEAVGLPDGQMGNSEVGHLNIGAGRIVYQSLTRVNVAIREGEFEQNETFLAAMKHVKEKGTNLHLFGLLSDGGVHSHIHHLYALLKLAKKEGVENVYIHGFLDGRDVGPQTAEKYIKELQDQIEEIGVGEIATLSGRYYSMDRDKRWDRVEKAYRAMAYGEGPKYQNPLDVVKDSYENGIYDEFVIPSVITKENGEPVATIKDNDAVIFYNFRPDRAIQISNTFTNDDFRDFDRGDKHPKNLHFVCLTHFSETVDGYVAFKPVNLDNTVGEVLSQNGLKQLRIAETEKYPHVTFFMSGGREEKFPGEERILIDSPKVATYDLKPEMSAYEVKDALVKEIEAEKHNAIILNFANPDMVGHSGKVEPTVKAIEAVDECLGEVVDAILAKGGYAIITADHGNADVLITEEGKPHTAHTTNPVPVIVTKEGVTLREGGILGDLAPTLLDLLGVEKPKEMTGSSLIQK

SEQ ID NO: 19377 - protein, 265 aa, Pyrococcus horikoshii
MVLYFIGLGLYDERDITVKGLEIAKKCDYVFAEFYTSLMAGTTLGRIQKLIGKEIRVLSREDVELNFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKARKRMYMTANEAMELLLKVEDMKKGGVFTDDTLVVVLARAGSLNPTIRAGYVKDLIREDFGDPPHILIVPGKLHIVEAEYLVEIAGAPREILRVNV

SEQ ID NO: 19378 - protein, 332 aa, Glycine max
MITNSAAVKPNFHLPMRSFELKNRTSPEDIKALRLITAIKTPYLPDGRFDLEAYDDLVNMQIGQGAEGVIVGGTTGEGQLMSWEEHIILIAHTVNCFGGKIKVIGNTGSNSTREAIHATEQGFAVGMHAALHINPYYGKTSLDGMVAHFRSVLSMGPTIIYNVPARTGQDIPPHVIQTLAESVNLAGVKECVGNDRIKQYTDDGIVVWSGNDDQCHDARWGYGATGVVSVASNLVPGLMRELMFGGVNPTLNSKLLPLIDWLFHMPNPIGLNTALAQLGVIRPVFRLPFVPLPVDKRIEFANLVKEIGREHFVGNKVVEVLDDDDFFLVSRY

SEQ ID NO: 19379 - protein, 359 aa, Nicotiana tabacum
MSSSIIGRCHFVADSIEAAGTKRRTTRWRSPRAAVIPSFHLPMRSNEVKNRTFADDIKALRLITAIKTPYLPDGRFDLEAYDTLVNLQIENGAEGVIVGGTTGEGQLMSWDEHIMLIGHTVNCFGGSIKVIGNTGSNSTREAIHATEQGFAVGMHAALHINPYYGKTSLEGLISHFESVLPMGPTIIYNVPSRTGQDIPPRVIQTMAKSPNLAGVKECVGNDRVEQYTSDGVVVWSGNDDECHVSRWDYGATGVISVTSNLVPGLMRELMFGGKNPALNSKLMPLMEWLFHEPNPIALNTALAQLGVVRPVFRLPYVPLTKAKREEFVKIVKEIGRENFIGERDVQILDDNDFILVGRY

SEQ ID NO: 19380 - protein, 335 aa, Metarhizium anisopliae var. anisopliae
VKVGINGFGRIGRIVFRNAAEHPEIEVVAVNDPFIDTEYAAYMLKYDSSHGIFKGDIKKEADGLVVNGKKVKFFTERDPSAIPWKSAGAEYIVESTGVFTTTDKAKAHLAGGAKKVVISAPSADAPMYVMGVNEKTYDGKADVISNASCTTNCLAPLAKVIHDKFTIVEGLMTTVHSYTATQKTVDGPSGKDWRGGRGAAQNIIPSSTGAAKAVGKVIPDLNGKLTGMSMRVPTANVSVVDLTARIEKGASYDEIKEAIKEAANGPLKGILAYTEDDVVSSDMNGNTNSSIFDAKAGISLNKNFVKLVSWYDNEWGYSRRVLDLLAYIAKVDAGK

SEQ ID NO: 19381 - protein, 223 aa, Streptococcus agalactiae A909
MDELKKLAGVTAAKYVKNGMIVGLGTGSTAYFFVEEIGRRVKEEGLQVVGVTTSNRTTEQARGLAIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVAGKNGLDILEK

SEQ ID NO: 19382 - protein, 240 aa, Hordeum vulgare subsp. vulgare
MDGAAPVAGAPPAVPPAVLCAAEEALAATESVGDRLAEMLAAAAEDPDAVAELPPLHRARAFLAVAHAATSLFSGTGSRLLLPPYSSRWDALMLVSLPLLLERRVTYREEGEVKPVAGEVKSIERMGQGYLTYSLLCALGLQIGTPLRPSTTVNTQAAARFIGRSLSHLTDDQRRGMQAISKGEGAGWSGRKRKSQPLPERKSVRAAAEEFLAKASQELIGHNGSGVKGPVRLVLDEDED

SEQ ID NO: 19383 - protein, 152 aa, Cryptococcus neoformans var. neoformans JEC21
MSTTEQTYIMIKPDGVQRGLVGEIIGRFEKRGFKLVALKLHTPSKEHLEKHYSDLSEKPFFPRLIEYMMSGPVVCMVWEGLDAVKTGRVMLGATNPLASAPGTIRGDYALQVGMNVCHGSDSVENGQKEIALWFPEGINQYKLSSQAWLYEA

SEQ ID NO: 19384 - protein, 117 aa, Nicotiana tabacum
WSYHNGGAWPTLLWQLAVASIKMNRPEIAAKAVEVAEKRISRDKWPEYYDTKKARFVGKQARLFQTWSIAGYLVAKLLLANPSAAKILITQEDSELLNAFSCAISSNPRRKRGPKSP

SEQ ID NO: 19385 - protein, 591 aa, Glycine max
  misc_feature (246)..(246): Xaa can be any naturally occurring amino acid
  unsure (1)..(591): unsure at all Xaa locations
MDRILKAARASGSLNLSNRSLTEIPDEVYRNLEGLGGDDKWWEAAELQKLILAHNSIASLKEDLRNLPFLSVLNLSHNSLSQLPAAIGELPQLKMLDVSFNSIVNIPEEIGSAMSLVKLDCSNNRLTELPSSLGRCLELSDLKGSNNLITSLPEDLANCSKLSKLDMEGNRLTVISENLISSWTMLTEFNSSKNLLNGIPTSIGGLSRLIRLDLHQNRISAIPSSIIGCHSLTELYLGSNSNLSRXNNNISTLPVEIGALSRLGTLDLHSNQLKDYPVEACKLSLLVLDLSNNSLSGLPPEMGKMTTLRKLLLSGNPMRTLRSSLVSGPTPALLKFLRSRLSEDEDSEAVTTTKEVITMATRLSISSKELSMEELGLSAVPSEVWESGEVIKLNLSRNSIQELPVELSSCVSLQTLILSKNQIKDWPGSILKSLSSLSCLKLDNNPLRQIPSDGFEMVPKLQILDLSGNAASLLDGPAFSSLPYLQELYLRRMRLSEVPSDIVGLHQLRILDLSQNSLQSIPVGLKALTSLQELDLSNNNIAVLPPELGLLEPSLQALRLDGNPLRSIRRTVLDKGTKAVLQYLKDKLPEQ

SEQ ID NO: 19386 - protein, 149 aa, Nicotiana tabacum
RYKTEEYSTDATNKFNIYPEQIPHWLMDWIPEEGGYLIGNLQPAHMDFRFFTLGNLWSIVSSLGTPKQNEAILNLIEAKWDDIVGSMPLKICYPALENEEWRIITGSDPKNTPWSYHNGGSWPTLLWQFTLACIKMNRTDLAKKAVDSA

SEQ ID NO: 19387 - protein, 455 aa, Coprinopsis cinerea okayama7#130
MPSPEDASTSSATPEAQKHTFKSLGLIDPLLEALEQVGYKSPTEIQSESLPHALEGRDIIGVAETGSGKTAAFALPILQKLWEEPKGLFACVLAPTRELAYQISQQFEALGAAMGARCAVIVGGMDLPTQAIALAKRPHVVVATPGRLLQHLEETKGFSLRTLKFLVLDEADRLLDMDFGPAIDKILKLIPKERTTYLFSATMTSKVAKLQRASLVNPVRVEVSGKYQTVSTLLQHYLLVPLKDKVVMLIYLANSLAQNSIIIFTRTVRDARLLSIILRTLGFPAVPLHGQLSQSQRLGALGKFKSGGRKILVATDVASRGLDIPSVDVVINYDIPTHSKDYIHRVGRTARAGRAGKAITLVTQYDVELLQRIEKVIGKKMDAWPTDDEEVLLLKERVSEAERLAVNEIKDQDMKEGGGKKRRRGGEGGGADDRDRDDDVVEAGMPTKHKKTKRR

SEQ ID NO: 19388 - protein, 103 aa, Zea mays
MSGRGKGGKGLGKGGAKRHGKILRDNIQGITKPAIRRPARRGGVKRISGLIYEETRTVLKSFLEGVIRDAVTYTEHAKRKTVTSLDVVYALKRQGRTLYGFGG

SEQ ID NO: 19389 - protein, 708 aa, Oryza sativa (japonica cultivar-group)
MSLPAISLYTSPPPGAVYSSEFDPSSRGSSPPCSTAPPSTSHRPPAAAGGLSCLFSSPAAAASPPRAPPHDELGALWQDRSDEPAFAGGGGGYSSSPLKWRDLHHHHHHSPVSVFQGPSSSPAASRSPPASWLAGRDRDRERLFAGFVRNALGSCVDYAPALSPRSEVGGGELAFELDENLAEASPACEPCARELLAGAQARHRIFHEELVVKTFFEAEKAHRGQTRASGDPYLQHCVETAVLLANIGANSTVVSAGLLHDTIDDSFIDYDHIFHMFGAGVADLVEGVSKLSHLSKLARDNNTASRIVEADRLHTMLLAMADARAVLIKLADRVHNMKTLEALPLGKQQRFAKETMEIFVPLANRLGIASWKDQLENLCFKHLNPEEHKDLSSKLTKSFDEVLITSAVDKLDRGLRDAGLSYHNLSGRHKSLYSIHNKMLKKNLTMDEIHDIHGLRLVFEKEEDCYRALDVVHELWPQVPGRFKDYISRPKLNGYRSLHTVVMSENVHPFEVQIRTKEMHLQAEYGFAAHWRYKEGTCRHSFVLQMVEWARWVLTWQCEAMNKERPASLGDSDAIRPPCPFPMHSEDCPYSYTRQCDHDGPIFVILLEHDKMSVQEFQANSTVMNLMDRVGTNTPRWSPYRIPMKEDLRPKVNHEPISDLNRKLSMGDVVELTPALPHESLPNYREEIQRMYDRGGFALATRGGSSRR

SEQ ID NO: 19390 - protein, 253 aa, Bacillus licheniformis ATCC 14580
MRKPIIAGNWKMNKVLSEAVSFVEEVKSSIPAADKAEAVVCAPALFLEKLTSAVKGTDLKVGAQNMHFEESGAFTGEISPAALKDLGVEYCVIGHSERREMFAETDETVNKKAHAAFKYGIVPIICVGETLEEREANKTNELVADQVKKALAGLTTEQVAASVIAYEPIWAIGTGKSSTAQDANEVCAHIRKTVASEFGQTAADSVRIQYGGSVKPANIKEYMAESDIDGALVGGASLEPQSFVQLLEAGQYE

SEQ ID NO: 19391 - protein, 150 aa, Apium graveolens
MADQLTDDQISEFKEAFSLFDKDGDGCITTKELGTVMRSLGQNPTEAELQDMINEVDADGNGTIDFPEFLNLMARKMKDTDSEEELKEAFLVFDKDQNGFISAAELRHVMTNLGEKLTDEEVDEMIREADVDGDGQINYEEFVKVMMANV

SEQ ID NO: 19392 - protein, 394 aa, Bacillus licheniformis ATCC 14580
MNKKSVKDIDVKGRVVFCRVDFNVPMKDGKVTDDTRIRAALPTIQYLTEQGAKVLLASHLGRPKGQVSEELRLTPVAARLGELIGKEVKKADEAYGDAVKAQISEMKDGDILVLENVRFYPGEEKNDPELSKAFADLADVYVNDAFGAAHRAHASTAGIAEHLPAVAGFLMEKELEVLGKALSNPERPFTAIIGGAKVKDKIGVIESLLEKVDNLIIGGGLAYTFVKALGHEVGKSLLEEDKIELAKSFMDRAKEKGVNFYMPTDVLVADDFSNDANTKIVPVSEIPSDWEALDIGEETRKTYADVIKNSKLVVWNGPMGVFEIDAFAKGTRAVAEALAEANDTYSVIGGGDSAAAVEKFGLADKMSHISTGGGASLEFMEGKELPGVKALNDK

SEQ ID NO: 19393 - protein, 581 aa, Acidobacteria bacterium Ellin345
MKTSASQLQYGASLRDGRVHFRVWAPNAKSLSIRLIQGSSQNDQPMQRDDRGEWTLEADAHAGDRYFCVINGEQAVPDPVSRFQPEGVHGPTEIVDPSQFQWSDENWEGVDYDDYVIYELHVGTFTPEGTLDAAIEKLPYLKALGITVVELMPVNAFPGKHNWGYDGVGLYAVQESYGGPEALRRFVDAAHAHGLAVILDVVYNHLGNEGNYLRMFGPYFTDHHKTPWGEAINYDTTPGCEHVRRFVIDNALYWIREYHLDGLRLDAVQTIKDDSSKHVLQELQENVQTLAAELGRKVCVIAETDENISKYVRPFGSGYGLQGFWSDDFHHAIHAYFTGERQGYYQDFGDPEQIVTAIRDGYAFQGQPFKFWKGTKRGELPVNVQLPRNVICTQNHDQVGNRAKGERLTTLVPRGARYVSAALLLLAPHTPLLFMGQEYDEEHPFQFFTDYGDPVLQNAVSEGRRKEFEDFDFREVPDPQDPETFNRSRLDWSKAVDTNPMLRWYRELLRLRKRYVTSGERTAYATYQDGVITMMAPGDTPDLILFATLEPGRQLPAEEDGWNLTLKYKSEDGYQVRIFTR

SEQ ID NO: 19394 - protein, 335 aa, Bacillus licheniformis ATCC 14580
MAVKVGINGFGRIGRNVFRAALNNPEVEVVAVNDLTDANMLAHLLQYDSVHGKLDAEVSVDGSNLVVNGQTIQVTAERDPSKLSWGEQGVEIVVESTGFFTKRADAAKHLEAGAKKVIISAPASEEDITIVMGVNEDKYDAANHHVISNASCTTNCLAPFAKVLNDKFGIKRGMMTTVHSYTNDQQILDLPHKDYRRARAAAESIIPTTTGAAKAVSLVLPELKGKLNGGAMRVPTPNVSLVDLVAELDKEVTAEEVNAALKEAAEGELQGVLGYSEEPLVSKDYNGNTNSSTIDALSTMVMEGSMVKVISWYDNESGYSHRVVDLAAYIAKQGL

SEQ ID NO: 19395 - protein, 161 aa, Acidobacteria bacterium Ellin345
MIILLMGVQGSGKTTVGKALAARLGWDFRDADEFHPAANKAKMAAGIPLTDEDREPWLQAIRAAMDRANAEHRNLVVTCSALKETYRQQLAAPNTTLVWLKGDQQLIASRLALREHHFAKSNLLASQFADLEEPQGAVAIDIHQTVEAIVDEIIRRLQINA

SEQ ID NO: 19396 - protein, 253 aa, Silicibacter pomeroyi DSS-3
MADSGYLFSVRGRVACVTGASSGLGRRAATVLAQAGAQVVGVARRADALAEWQAEAGGETHAIPYDLSDRDGLEGLARQVVDPFGAPDILVHAAGINTRQPADEVTPEGWDITLTLNLSVPFFLSQYLVPGMKARGWGRIVNFASLQTTRAFPGGIAYGASKGGVAQMTRAMAEAWSPHGITANALGPGFFRTELTAPVFADPERAARNAAQTCIGRNGEPEDLDGPLLFLCSQASAYVTGQVLMVDGGYTAK

SEQ ID NO: 19397 - protein, 455 aa, Bacillus licheniformis ATCC 14580
MEKDMQKLERTMTSRHIMMMALGGAIGAGLFKGSSKAIDLAGPSVMIPYLIGGVILLFIMQGLAEMAVRNSEARTFRDLVQSILGPYAAYFLDWIYWKMWVLNIAAEAVVAAMFLQYWLPGLPIWVLALFVSLVITSVNLLSVKSFAETEYWLALIKITVIVVFIISGFILLFFSFGQHSAVGFTHLTDHGGFFPNGAGGLITAMLVVIYSYGGTEIIGVTLAETKNPEKVVPKAVRGTLTRIIAFYLLPFFVIVSLIPWNQVNGVSESPFVMVFKMIGVPGADHLMNAVILLAVISSMNSGLYGASRILYTQASDGRMPKIFSRLSARKVPVYSILLCTSFLYLGVLFSLFAGSQTFEYLMGSLGYTVLVIWMLIAAAHLKSRKRNQTAGNGYYVKWFPYTTWVAIISLTAILIGVILTTSIVITLVTAGIYLLISAAYFFKGRNQTAGQTAAS

SEQ ID NO: 19398 - protein, 327 aa, Rhodospirillum rubrum ATCC 11170
MSETKLDALRRHTIIVADSGDIDAIRSFAPQDCTTNPSLILKAAKMPAYAGLIAQAIEAGSAEAGPSEGLIDRILDHLAVTFGSELARIVPGVVSTEVDARLSFDTQATVARAERLIGLYAARGVAAERILIKVAATWEGIRAVEILQSRGIACNVTLVFSLAQAVAAAEAGAFLISPFVGRILDWHVKASGKSFDIDEDPGVRSVTEIYTYFKHFGYKTIVMGASFRSSAEVEALCGCDRLTVSPALLDQLRSQTGDVPKRLDPAASKAATISRLAVDEASFRWQINEDALATEKLAEGIRLFNADTDALRRTIAETLAKRASTVA

SEQ ID NO: 19399 - protein, 258 aa, Rhodospirillum rubrum ATCC 11170
MNARLWIGTSWKMHKTIAEAEAYVGELTASPLLDRVEAFIVPPFTALAAVHRALGDAPVHLGAQTMHWQDEGAQTGEISPLMLRDCGVGIVELGHSERRASHGETDATVNAKVASALRHGLRPLICVGDQGDDLDAGASIETVLRQVKLAIKGIDTASLGRALIAYEPVWAIGEAGRPAEPAHVAEVHGALRAMLGQRGLAALPLLYGGSVDRANAGALTALANVDGLFVGRAAWTARGFEEVIEAALHGAKDRAGLA

SEQ ID NO: 19400 - protein, 445 aa, Mycobacterium avium subsp. paratuberculosis K-10
MGSSDQATAHARAQAASARLFDDACAVIPGGVNSPVRAFTAVGGTPPFITAARGCRLTDADGNHYVDLVCSWGPMILGHAHPAVVEAVAKAAASGLSFGAPTPAESELAAEMIARVAPVERIRLVNSGTEATMSAVRLARGFTGRAKIVKFSGCYHGHVDALLADAGSGVATLGLPSSPGVTGATAADTIVLPYNDIDAVRQAFTEFGDQIAAVITEASPGNMGVVPPAPGFNAALRALTADHGALLIVDEVMTGFRVSRSGWYGIDPVDADLFTFGKVMSGGLPAAAFGGRAEVMERLAPLGPVYQAGTLSGNPVAMAAGLATLRHADAAAYAALDANADRLARLLSDALTNAGVPHQIPRAGNMLSVFFTDTPVTDFASARATQTWRYPPFFHALLDAGVYPPCSAFETWFVSTALDDDAFDRIAAALPAAARAAAGADEGNS

SEQ ID NO: 19401 - protein, 319 aa, Glycine max
  misc_feature (273)..(273): Xaa can be any naturally occurring amino acid
  unsure (1)..(319): unsure at all Xaa locations
MAFTGSGSGQPQFISSTGNRSFSNAPLIENSDTNQIVVPDRRSWKNLFAYMGPGFLVSIAYIDPGNFETDLQSGAQYKYELLWIILLASCAALVIQSMAANLGVVTGKHLAEHCRSEYPRVPNFILWIIAEIAIVACDIPEVIGTAFALNMLFNIPVWIGVLLTGLSTLILLALQQYGVRKLEFLIAFLVFTIAACFMAELGYAKPVAKEVVTGLFVPKLQGHGATGLAISLLGAMVMPHNLFLHSALVLSRKIPRSVRGIKVREYCERINLXETAQTMEACRFYMIESAFALTVAFLINISVISVSGAVCNSSNLSAG

SEQ ID NO: 19402 - protein, 300 aa, Bacillus halodurans
SFMSELSNYIGPDIDVPAGDIGVGAKEIGYMFGQYKKMRGGFEAGVLTGKGIGYGGSLARKEATGYGTVYFVEEMIKDHGFSFAGSTVVVSGSGNVSIYAMEKAMQLGAKVVACSDSGGYVYDKNGIDLQTVKRLKEVERKRISEYVNEHPHAHYVQGCSGIWSVPCDIALPCATQNELDEAAATMLIANGVKAVGEGANMPSTLQAVHTFQEHGVLFAPAKAANAGGVSVSALEMAQNSTRLAWTFEEVDAKLYEIMKNIYRESIKAAELYEASGNLVVGANIAGFVKVADAMISHGVV

SEQ ID NO: 19403 - protein, 498 aa, Sinorhizobium meliloti 1021
MDQLNNFLSPPAAPRDFGFFVDGKWQSGHDFFVRHSPGHGVAVTRTAKCSVDDLNAAVAAARRAFEDRRWSGLPGGSRASVLLRVAEILRTRRDELAYWETLENGKPIAQARGEIDHCIACFEVGAGAARLLHGDSFNSLGDGLFGMVLREPIGVVGLITPWNFPFLILCERVPFILASGCTMVVKPSEVTSATTLILAEVLAEAGLPDGVYNVITGSGRTIGQAMSEHPDIDMLSFTGSTAVGRSCVHAAADSNFKKLGLELGGKNPIIVFADSDLEDAADGAAFGISFNTGQCCVSSSRLIVERSVAREFEALLAEKMKRIRVGDPLDETTQVGAITTEAQNTTILDYIAKGKTEGAELVTGGTAIDLGRGQYIAPTLFSGVSREMAIARDEIFGPVLCSMTFDTVEQAVELANDTVYGLAASVWTKNIDKALTVTRRVRAGRFWVNTMMAGGPEMPLGGFKQSGWGREAGMYGVEEYTQVKSVHVEIGKRTHWIS

SEQ ID NO: 19404 - protein, 897 aa, Cryptococcus neoformans var. neoformans JEC21
MGTSMHSPFPSPEGSVLKRLKKKASNVGLGLGRPDNYDDEAVGRRGDEDELLEDNEGERANGTRVWYSSFATIDWIHDAIKESSRVRRLRNAASRSLRGKIANTWDRFQGWLVVTLTGIITALIAFLIIRAEMAFFDLKEGFCSTSWGTARRFCCAPRHQSPGSDGGEDECSDWIEWGQFFNPKEKDGPFGGWVYGGPEFMAYATVALLLAVTASCMTVYLSSSAHHTTSKDSTFLTPPSKIPTAKQSTASSPTKRTASLPYGPHNECQPLLDSVANEPPTPLIESPPETFRKVMFYAAGSGIPEIKTILSGFVIHGYLGGWTLLTKSAGLALSVGSGLSLGKEGPLVHMSSCVGNIVSRMFLKFECNEAKRREVLSAACAAGVAVAFGAPVGGVLFSLEEVSYYFPPKVMWRSFWCAAIAAITLKALNPFGNGSLVLFAVTYTKEYHYWEYIIFVVLGVFGGLYGAVFARLNIIWSRHVRNGTWLRRHPIFEVVLVVLLTTIVSFSNPYTRMGGTEFVASLFEECNSSSSSSLCVNHPHELATVIWEVFMALIIKGCLTIITFGIKVPAGIFIPSLAVGACFGRIVGHMMEYIEFTYPELSIFNVCKDTDCIVPGVYAMVGAAATLAGVTRTTVSLAVIMFELTSTLNYVVPVMLSILIAKTVADGLEKKGIYDLVIDLNQLPYLDSKHEYLWGSRRAYSVADRSVPHLRADKPHTVRSLTGKLLELVRLGMEDTGFPVLVKEMTSAGGPGTSAGVGLEGGIGSGRERSCLRVVGFLGINELEHALSELADEPDAAINLIPDDASQARVRSSAMSIFSFADSFVDNVWNPCDLSRYIDQAPITVQIHSPLELVQQLFVKLGVRQVIVVNSRGVFQGIITKKAWLNFLSELEEGTGH

SEQ ID NO: 19405 - protein, 439 aa, Bacillus anthracis str. Ames
MAVENITMPQLGESVTEGTISKWLVNVGDHVNKYDPLAEVMTDKVNAEVPSSFTGIVKELIAGEGDTLAVGEVVCVIQVEGADEVAATAVEEKTKEEPKAEVNTPEKAPKAKQPTDGKPRFSPAVLKLAGEHNVDLDLVEGTGANGRITRKDILKLVESGNIPQAGAVKKEEAVAAVVEARPEAPKAAPVAQKVEAAKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEDELFVPVIKHADEKTIKGIAREITELAGKVRTKSLKADEMQGGTFTINNTGSFGSVQSMGIINYPQAAILQVESIVKRPVIMENGMFGARDMVNLCLSLDHRVLDGLICGKFLGRVKEILENTSENNTSVY

SEQ ID NO: 19406 - protein, 327 aa, Bacillus anthracis str. Ames
MAVMSYIDAITLAMREEMERDEKVFVLGEDVGKKGGVFKATHGLYDQFGEDRALDTPLAESAIAGVAIGAAMYGMRPIAEMQFADFIMPAVNQIVSEAAKIRYRSNNDWTCPITVRAPFGGGVHGALYHSQSVEAMFANQPGLKIVIPSTPYDAKGLLKAAIRDEDPVLFFEHKRAYRLIKGEVPEDDYVLPIGKADVKREGDDITVITYGLCVHFALQAAEKLAQDGISAHILDLRTVYPLDKEAIIEAASKTGKVLLVTEDNKEGSIMSEVAAIIAENCLFDLDAPIARLAGPDVPAMPYAPTMEKFFMVNPDKVEKAMRELAEF

SEQ ID NO: 19407 - protein, 473 aa, Bacillus anthracis str. Ames
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLIATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIVAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGKALHA

SEQ ID NO: 19408 - protein, 700 aa, Frankia sp. EAN1pec
MCPARGHCRLHGGRQPRFARPGGAAADPADQRVGNRRRRRAPAGPAGGWRRWSRLHVHLLRQLGRGLLPPCRGGGAGRHGLGRDGGGRRRGGRPRRGPLRRRSRARGDQGVPEPRPAGGAGRDAPRRRRRERGRGGRALGGHGGLARPPARSRLTDGPPRYARRGAVRHRAAPGVDLRDRGHSRREHDRMLEAHTVAEVRDAEAPLLASLPSGGLMQRAVSGLVSHAVRRVDRVYGARIVVLAGSGDNGGDALWAGARLAARGARVHALAPGRTHPEGTAALLAAGGRLHRTGPVDPPAPEGMGADAAADLLDSADLVLDGLLGIGGRGELREPYAQLTTLAPARRTVAVDVPSGVDADTGAVAEGAVRAAGTVTFGTYKRGLLVGPGAVHAGRVELVDIGLTLPEPDLRALQDVDVARLLPVPVAADSKYSRGVLGLVGGSDRYPGAAVLAVGGALRGGAGYLRVVAEAGAAEYVRRAHPESVLTVIEAGDAEAMLGVGRVQAWAIGPGLVPDEATRRLVDALLEQTESGLLVDAGALDTLAAAVAARPAVLRDRAGAVVLTPHEGEFIRLTGTALGWDQAGTPERLRADRLGTVRQAARDLGAVILLKGNRTIIAAPGGEALVNLTGTPWLGTAGSGDVLTGLAGSLLAAGLPAPHAAAVGAFLHGRAGERGPVPLAAADLPALLPGVVEDLLASVEG

SEQ ID NO: 19409 - protein, 107 aa, Acidobacteria bacterium Ellin345
MKKIFVGNFAFTATEDDIRQLFTPYGKVDSVSLVTDRDTGRARGFGFVEMPNDTEAAAAIEGLNGRDSGGRALNVNEARPKTERGNSGGGGGRGNFRDKGRKREPRW

SEQ ID NO: 19410 - protein, 277 aa, Lactobacillus plantarum WCFS1
MKKYRKILAMLAVLAIVLVLSGCSNTPITDKSTGFWDGLIILNFSRAIIWLSNLFGHSYGLGIIVFTLIIRIIILPLMIFQTRNMVAMQEVQPQMKALQKKYSSRDMETQQKLQAEMKKLYAKHGVHPMASMLPLLVQLPILIALYQAIWRTQALKTGSFLWLQLGSKDPYYVLPILAAIFTFASSWLAMKSQPEQNGMTTSMTYLMPVIILITAINVPSALSLYWVISNAFQVGQTLLLQNPFKINREREAKKQAERDRKRTLEKARKRAIRNHKR

SEQ ID NO: 19411 - protein, 374 aa, Arabidopsis thaliana
MTNQNVIVSDRKPILGLKTITVSVSNSPLFSNSFPTYFNFPRRKLLKLLEAADKNNLVVAPKITSMIDSMRDSSPTRLRSSSYDSDSDNDDKTSWIVRFPSALNMFDEIVNAAKGKQIVMFLDYDGTLSPIVEDPDKAFITHEMREVVKDVASNFPTAIVTGRSIEKVRSFVQVNEIYYAGSHGMDIEGPTNENSNGQSNERVLFQPAREFLPMIEKVVNILEEKTKWIPGAMVENNKFCLSVHFRRVDEKRWPALAEVVKSVLIDYPKLKLTQGRKVLEIRPTIKWDKGQALNFLLKSLGYENSDDVVPVYIGDDRTDEDAFKVLRERGQGFGILVSKVPKDTNASYSLQDPSQVNKFLERLVEWKRKTVGEE

SEQ ID NO: 19412 - protein, 101 aa, Glycine max
  misc_feature (57)..(57): Xaa can be any naturally occurring amino acid
  unsure (1)..(101): unsure at all Xaa locations
MSRPHDGHRSFFPMGNPLRMILPRGARLPPKLTELLTPYEDGLASSSRKVKPEATSXVFTLSWMKLAVECLSELHTTIATLITELELALSDWDETWVDSYL

SEQ ID NO: 19413 - protein, 362 aa, Oryza sativa
  misc_feature (196)..(196): Xaa can be any naturally occurring amino acid
  unsure (1)..(362): unsure at all Xaa locations
MPLLLRCSPAASPPLLPRRRSGSLLSAAPPGRRPLLPAAAGRVVLGCGLVTLDYLATVDAYPRPDDKIRSGELQVSGGGNAGNALTGAARLGLNTRLISKVANDEIGGTVLSELKEAGIDISHVIISDGGNTTFVYVIIDKQTKTRTCIITSGYPPMIPSDLRMSSLSAALQDVSLLYLDGYSDEMALAVAKQKCXADQMKIPILVDAEPERTREELGGLLSLASYIVCNGKFPEKWTSVPSIPSALLEILLQYPRACFAVVTLGENGCMMLERGKDGENYETEPVDIENVAESLRLKVDKDDILPTCVSSKFMRLTARGSGNIFARLLIGTAESIPASELVDTTGCGDAFIGAVLHGRHQM

SEQ ID NO: 19414 - protein, 524 aa, Synechococcus sp. WH 5701
MVLAILDGWGFREEARHNAVQGASTPVMDALWEVYPHTLIQASGGDVGLPDGQMGNSEVGHLTIGSGRIIRQELVRIGKAVRDGSLAANPALNELADRLLRDGGTLHLLGLGSDGGVHSHIDHLGGLLQWAASRGLSDVCIHVITDGRDTPPQSAIPYLECIEAQVEAAGVGRISTICGRYWAMDRDNRWERTEKAYRLLSEDGEITSLSFQEAIHAAYAEGINDEFLEPLRLAPGSLKPGDGLICFNFRPDRVRQLIRSLVLDDFDQFERKRISPLHVVTFTQYELGLPVAVAFPPESLDGLLGQVVSAHGLRQLRTAETEKYPHVTYFLNGGIEQPFPGEDRHLVPSPRVATYDQAPAMAADQLTDNCIAFLNKGVYSLVVINYANPDMVGHTGRMDATQQAITTVDHCVGRLVEATNRLGGTVLITADHGNAELMEGEDGRPWTAHTTNPVPVILVEGEKRKIGGHGAAPQLRQGGGLADIAPTLLQILGLPQPSSMTGSSLVEPLDLVSPKAAFAEALQV

SEQ ID NO: 19415 - protein, 217 aa, Glycine max
TAARRRQKGVTRIGLPHFATSICLQPVTLLERERKKMVKGRSEMDGVEVPEAMIDTLNRTLESLQQLETQLPQFLSLSDPDFLAELPLVERAHSLFSLAKLTSTLFSLKLRCRGVNPNGHPVKSELDKINVLQKKLERLPRFTEAQEQDTRNISEEEEPEMNYQERTSQKRKYPSSEEQFVQIDAVGSLVKVKEEHVGDNNGNIKEAIVIDISDDDE

SEQ ID NO: 19416 - protein, 1299 aa, Magnaporthe grisea 70-15
MMTFRAEIGNPASSSLNRVDETHDDSLPHHASEPGRRPSSSGRGLRRIESREQRIGTILERGIARAQTNQSDSTTQSTTKRMEPLLGNASRQRQHHEDTSDDDGLEIGRPGRNGAAGKRRDSGSQPNYQTINAQQNQGSRISADGSTIHRRSTASNHNRRRGTSGNATRQVDREADGRQTEGESDGNGLFAWVRATMAMFMSVELDNKGSVARDHLALERTFLAWLRTSVSFASIGIAVTQLFRLNTSINSGRDRDGESGRDLAELRRLGKPLGAAFLGISILILFLGYGRYVRGQRWVMDGRFPASRGTVILVTLLTFAVMVASLAIVIDLICLHEAVHFEIIPHQREPTMNTYDLGGKRVTFTNSERLSKRAEAPAIPKPPNSVMLVAEQVPAFAAAQLSLLAAEQEAEAAGAAELISAHTPAALQRAGAALTNLTVQGRRTGAGGRTVVELSSDPAVGGIELPEHGLRVGDVVLVAEQPAGSAKKREVREMERNGVRGVVTRVRRSDLNVALDAGDDKSGGAGKEEKGLAGRVWVVRLADDVTYRRMTWTMEKMERMADAEHSNFIRVLFGHSSPSPVPSNLKTDPEFGELEWLDPTLNDSQKDAIRFALASKEIALIHGPPGTGKTHTLIELILQMLKQGLRILVCGPSNISVDNIVERLAPHKVPIVRLGHPARLLPSVVGHSLDVLTQTSEAGAIVRDVRAEMDAKQASIKKTKSGRERKAIYGELHELRKEFRDREKRCVANLLQSSKVVLATLHGSGGFQLRQEKFDVVIIDEASQALEAQCWVALLSAKKAVLAGDHLQLPPTIKSLNSKAAKTATGGDGSGTADGEESSAGQSRKKKGVTLETTLFDRLLDLHGPAIKRMLTTQYRMHEKIMRFPSDELYGGRLVAAEAVKERLLKDLPYKVEDTDDTSEPLIFIDTQGGDFPERNDEMDNGDADDKKKTKRMLLHGESKSNEMEAALVAQHVRSLVDAGVKPEDIACITPYNAQLAVLAPLLKDRFPGIELGSVDGFQGREKEAVVVSLCRSNPDGEVGFLGERRRLNAPTRRPDVVESYSNREESRVPVVGRSVKIRSIVPRKCSRGTGVATERGSSRGKNWNVFIRRKNSGKNKKQKSCTSTLHSKGCTVRRPELSFLVGPENGWACSGFGCTWGGEFVKLDSVMNMHEWLVDIFLVALENDNLGTPYQYLRSDVVGRKWAFFPVRRVGEEPVALPSQTSISHNHNLALWTKAKGWVCKTWGKLSPLFGHRPLSMKSRQLPSDESSVRLKARGRVSEQTSVDAYLDSFEPSCPPLP

SEQ ID NO: 19417 - protein, 176 aa, Triticum aestivum
  misc_feature (32)..(32): Xaa can be any naturally occurring amino acid
  unsure (1)..(176): unsure at all Xaa locations
MPPPRCGLLRPPPVAPFPGLKSTAGLPVSRRXNGASLGSVSNGGRIRCMQVWPREGIKKFETLSYLPPLSTEPLLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 19418 - protein, 472 aa, Zea mays
MAFFRGLTAVSRLRSRMAQEATTLGGVRWLQMQSASDLDLKSQLQELIPEQQDRLKKLKSEHGKVQLGNITVDMVLGGMRGMIGMLWETSLLDPEEGIRFRGLSIPECQKVLPTAVKGGEPLPEGLLWLLLTGKVPTKEQVDALSKELLERSTVPAHVYKAIDALPVTAHPMTQFTTGVMALQVESEFQKAYDNGLPKSKFWEPTYEDCLNLIARLPPVASYVYRRIFKGGKSIETDNSLDYAANFSHMLGFDDPKMLELMRLYVTIHTDHEGGNVSAHTGHLVGSALSDPYLSFAAALNGLAGPLHGLANQEVLLWIKSVIQETGSDVTTDQLKEYVWKTLKSGKVVPGFGHGVLRKTDPRYSCQREFALKHLPEDPLFQLVSKLYEVVPPILTELGKVKNPWPNVDAHSGVLLNHFGLSEARYYTVLFGVSRSMGIGSQLIWDRALGLPLERPKSVTMEWLENYCNNKAA

SEQ ID NO: 19419 - protein, 371 aa, Candidatus Desulfococcus oleovorans Hxd3
MSRNLYYTGPPKFIIKGIMNSTALPQEIQNLTRARFADWLNAHNIAPYRADQVFKWLFVHRAESFDQMTNISKPVRTLLAESFIIGRLKIARTQQSADGTRKYLFELSDGEHIESVLIPEEDHFTLCVSTQVGCAQGCAFCMTAKKGFVRNLTPAEITGQVLGALKTLAPEERLTNIVLMGMGEPLANYDNVITSLDTICDGDCGLQFSTRRVTLSTSGLVPRMAPLGLATTVNLAVSLNATDNKTRDMLMPINKTYPIEVLLEACRTYPLSNRRKITFEYILMAGVNDSEKDALRLVKLLRSIKAKVNLIPFNEHEGAAFKRPDDAAIERFKQILHDRQYTVMTRQSKGADISAACGQLAADIKKYGQNK

SEQ ID NO: 19420 - protein, 143 aa, Brassica napus
  misc_feature (23)..(24): Xaa can be any naturally occurring amino acid
  misc_feature (26)..(26): Xaa can be any naturally occurring amino acid
  misc_feature (28)..(29): Xaa can be any naturally occurring amino acid
  misc_feature (31)..(32): Xaa can be any naturally occurring amino acid
  misc_feature (34)..(34): Xaa can be any naturally occurring amino acid
  misc_feature (39)..(39): Xaa can be any naturally occurring amino acid
  misc_feature (49)..(49): Xaa can be any naturally occurring amino acid
  misc_feature (53)..(53): Xaa can be any naturally occurring amino acid
  misc_feature (58)..(64): Xaa can be any naturally occurring amino acid
  misc_feature (66)..(66): Xaa can be any naturally occurring amino acid
  misc_feature (70)..(71): Xaa can be any naturally occurring amino acid
  misc_feature (78)..(78): Xaa can be any naturally occurring amino acid
  misc_feature (82)..(83): Xaa can be any naturally occurring amino acid
  misc_feature (87)..(87): Xaa can be any naturally occurring amino acid
  misc_feature (89)..(90): Xaa can be any naturally occurring amino acid
  misc_feature (93)..(94): Xaa can be any naturally occurring amino acid
  misc_feature (96)..(96): Xaa can be any naturally occurring amino acid
  misc_feature (103)..(106): Xaa can be any naturally occurring amino acid
  misc_feature (109)..(109): Xaa can be any naturally occurring amino acid
  misc_feature (111)..(116): Xaa can be any naturally occurring amino acid
  misc_feature (118)..(118): Xaa can be any naturally occurring amino acid
  misc_feature (126)..(126): Xaa can be any naturally occurring amino acid
  misc_feature (131)..(132): Xaa can be any naturally occurring amino acid
  misc_feature (134)..(134): Xaa can be any naturally occurring amino acid
  misc_feature (141)..(141): Xaa can be any naturally occurring amino acid
  unsure (1)..(143): unsure at all Xaa locations
NVKRKEEEEVVVASSMLSSAAVXXSXAXXTXXAXFTGLXASAAFPVTRXAYNXITSIXXXXXXXSXMKVXXPVEKKKXETLXXLPDXTXXELXXEXDYLLRNXXXXCGXFXXXXXXVXREHGNTPXYYDGXXWXMWKLPLXGC

SEQ ID NO: 19421 - protein, 117 aa, Candidatus Desulfococcus oleovorans Hxd3
MEAIRQLEKEHMRLDLPDFSSGDSVKVHVKIKEGEKERIQVFEGVVLKRHNGSKSTAATFTVRKTSFGIGVERIFPLHSPSIDRIEVVKRGLVRQSRIYYFRKLTGKAAKIREKRDR

SEQ ID NO: 19422 - protein, 215 aa, Oryza sativa (japonica cultivar-group)
MTGLGSPCGACKFLRRKCVKGCVFAPYFCHEQGAAHFAAIHKVFGASNASKILMHLPVSDRCEAAVTMSYEAQARLRDPIYGCVAHIFSLQQQVVSLQAQLESLKAQATQGYGDGCSISSPQNDSCGNMLTSIVQDEQQFVGPTMASNSSVKNENHSYIANGHLAPMSAQSSQGFEAELCMAEYSNTNPCCSVQGNWYHDMEDLQSVAFAYLNQA

SEQ ID NO: 19423 - protein, 371 aa, Streptococcus agalactiae A909
MNNTEFYDRLGVSKDASQDEIKKAYRRMSKKYHPDINKEAGAEEKYKEVQEAYETLSDTQKRAAYDQYGAAGANGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLNISFVQAALGDTIDIPTVHGAVEMSIPAGTQTGKTFRLRGKGAPKLRGGGQGDQHVTVNIVTPTKLNDAQKEALHAFAEASGDKMVHPKKKGFFDKVKDALDVD

SEQ ID NO: 19424 - protein, 416 aa, Mannheimia succiniciproducens MBEL55E
MDFFQYKNNKLYAEDLLVSELAEQFGTPLYIYSRATLERHWKAFDSALGDHPHLVCFAVKSNPNIAILQVMAKLGAGFDIVSQGELERVIAAGGDPHKVVFSGVAKNEKEIARALELDIRCFNVESLAELQRINEVAGKSGKIAPISLRVNPDVDAHTHPYISTGLKENKFGVSVDEAREVYRLASRLPNIKVTGMDCHIGSQLTEIQPFLDATDRLILLLEQLREDGIELEHLDLGGGLGVTYSDETPPHPSEYATALLNKLKQYTNLEIIMEPGRAISANSGILVTKVEYLKSNETHNFAIVDAGMNDMIRPALYQAYMNIIEADRTLNRESKIYDVVGPICETSDFLGKQRRLAIAPGDYLVQRSAGAYGASMSSTYNSRPLTAEVMVDGSQAHLIRRRAELTELWALESLLP

SEQ ID NO: 19425 - protein, 441 aa, Streptococcus agalactiae A909
MTLNAKGESNQILVDKEVHSTNLLLDIDEKPELFQGLLLSFQHVFAMFGATILVPLILGMPVSVALFASGCGTLIYQVATKFKVPVYLGSSFAYITAMALAMKQMHGDISAAQTGILFVGLIYVVVATVIKFVGNSWVDKILPPIIIGPMIIVIGLGLANSAVTNAGFVAKGDWRKMLVAVVTFLIAAFINTKGKGFIKIIPFLFAIIGGYILSIILGLVDLSPVEKADWFELPKFYLPFKTGLFHSYKLYFGPEMLAILPISIVTIAENIGDHTVLGQICGRNFLKKPGLNRLLIGDGLATAFSALIGGPAETTYGENTGVIGMTRIASVTVIRNAAFIAIAFSFFGKFTALISTIPSAVLGGMAILLYGVIASNGLKVLIENRVNFAEVRNLIIASSMLVLGLGGAVLDLGALTLSGTALSAIVGIILNLILPKESMKS

SEQ ID NO: 19426 - protein, 305 aa, Arabidopsis thaliana
MSQPSVILATASYDHTIRFWEAETGRCYRTIQYPDSHVNRLEITPDKHYLAAACNPHIRLFDVNSNSPQPVMTYDSHTNNVMAVGFQCDAKWMYSGSEDGTVKIWDLRAPGCQKEYESVAAVNTVVLHPNQTELISGDQNGNIRVWDLRANSCSCELVPEVDTAVRSLTVMWDGTMVVAANNRGTCYVWRLLRGKQTMTEFEPLHKLQAHNGHILKCLLSPANKYLATASSDKTVKIWNVDGFKLEKVLTGHQRWVWDCVFSVDGEFLVTASSDMTARLWSMPAGKEVKVYQGHHKATVCCALHD

SEQ ID NO: 19427 - protein, 978 aa, Brassica napus
MAMRLLKTHLLFLHLHYVISILLLSFSPCFASTDMDHLLTLKSSMVGPNGHGLHDWVRSPSPSAHCSFSGVSCDGDARVISLNVSFTPLFGTISPEIGMLDRLVNLTLAANNFSGMLPLEMKSLTSLKVLNISNNVNLNGTFPGEILTPMVDLEVLDAYNNNFTGPLPPEIPGLKKLRHLSLGGNFLTGEIPESYGDIQSLEYLGLNGAGLSGESPAFLSRLKNLKEMYVGYFNSYTGGVPPEFGELTNLEVLDMASCTLTGEIPTTLSNLKHLHTLFLHINNLTGNIPPELSGLISLKSLDLSINQLTGEIPQSFISLWNITLVNLFRNNLHGPIPEFIGDMPNLQVLQVWENNFTLELPANLGRNGNLKKLDVSDNHLTGLIPMDLCRGGKLETLVLSDNFFFGSIPEKLGRCKSLNKIRIVKNLLNGTVPAGLFTLPLVTIIELTDNFFSGELPGEMSGDLLDHIYLSNNWFTGLIPPAIGNFKNLQDLFLDRNRFSGNIPREVFELKHLTKINTSANNLTGDIPDSISRCTSLISVDLSRNRIGGDIPKDIHDVINLGTLNLSGNQLTGSIPIGIGKMTSLTTLDLSFNDLSGRVPLGGQFLVFNDTSFAGNPYLCLPRHVSCLTRPGQTSDRIHTALFSPSRIAITIIAAVTALILISVAIRQMNKKKHERSLSWKLTAFQRLDFKAEDVLECLQEENIIGKGGAGIVYRGSMPNNVDVAIKRLVGRGTGRSDHGFTAEIQTLGRIRHRHIVRLLGYVANRDTNLLLYEYMPNGSLGELLHGSKGGHLQWETRHRVAVEAAKGLCYLHHDCSPLILHRDVKSNNILLDSDFEAHVADFGLAKFLLDGAASECMSSIAGSYGYIAPEYAYTLKVDEKSDVYSFGVVLLELIAGKKPVGEFGEGVDIVRWVRNTEGEIPQPSDAATVVAIVDQRLTGYPLTSVIHVFKIAMMCVEDEATTRPTMREVVHMLTNPP

SEQ ID NO: 19428 - protein, 426 aa, Bacillus licheniformis ATCC 14580
MNHPIQKKSNVRWVVAFMMWAAIAINYIDRTVLSAAAPYITEEFNLTPGQMGIIMSGFFWSYALLQLPSGWAADKYGQKKTLGFAVVWWSVATALTGLATGFKSLLGLRVALGVGEAAAYPSNAGIAAKWFPKKERATVAGIFDSGSKFGGAVAMPLIAWMIAVFDWKLTFLLIGLVGVAWGIVWMIFFKENPADHKRVNEAELAHIREGQAHMEETGGGQPLKWYQLFKYRNIWAMCIGFFMINYNSYFFITWLPTYLVKERGMDLIEMGIMASLPLLTAMVVEVGAGWMSDRIYAKGKLSLTAVRKLFLIIGLVMASCIGFAAFADSAILAVILLCVAKSGTTVAASQVWALPGDVAPKNMTSMVAGIQNTVSNMGGVVGPIITGFIVGATGSFVPALLFSAALIIIAILNYLFLLGKVKQIQV

SEQ ID NO: 19429 - protein, 295 aa, Bacillus licheniformis ATCC 14580
MGFVPKGIYPAMLTPLTKDQSIDESALKQLTNHLIDAHVHGLFALGTNGEFHMFNIEDKLKVAEIIIQETAERVPVMVGSGGNSTEEAIWLSKEIERLGADALSVITPFFIPPTQEEAAVHYKTIAASVSLPILLYNIPSKTGFHLEPETVAELAKVDNIVGIKDSSGNFENIQQYIEQTKNDDFSVFAGTDSLILKTLQAGGAGAVAATANMLPDIVTSIYHHWAEGETEKAEAAQMELQPLRDTFRLGTIPAALKKAVELYSIPVGPPKAPVKELTGPALLEVEKMVASYQSK

SEQ ID NO: 19430 - protein, 294 aa, Crocosphaera watsonii WH 8501
MVNKIDKVALFGGTHGNEMTGIYLIKKYLQNPDLIERSTLKVFPFLSNPRAIESRVRYTEIDLNRCFGSEEIDNLDNFLYEQLLAKTIHQKLLNEQINFVVDLHSTTANMGLTIILSDTDDFHLQLCSYLSSIYPEIKVLFYASKEKDKLLRSNTELGLTIEIGAVAQGVLDANLFIKTEKIVESLLDYLDKKNQDQIPEKSHKLGFYEVFERLDYPRINEEIAAMIHPNLQFKDYKPLNPGDDLFITFDGKTITYQGDSTVYPVFVNEAAYYEKGIAMCLAKQREIVVNFNNG

SEQ ID NO: 19431 - protein, 590 aa, Cryptococcus neoformans var. neoformans JEC21
MFFKKNSDAPKKPRHAPDRDDVPSLEDLGVELHPDTARYVADSQALADAIGGNGLKDIFSSGLVLIAAFSTCMGGLLFGFDQGILSIVLTMSQFLGQFPDVDANVSSSAAFNKGIMTALLELGAFIGALQAGFVADRYSRKKAIALGSVWFVIGAILQTTSYSFAQLVIGRFVGGLGVGLLSAVAPMYISEISPPNIRGSLLAMEAATIVSGIVIMFYITYGSRYIPGDWSFRLPFLVQVAPCILLTIGLWKLPYSPRWLAQVGRDEDSLHALMRLRGFPVTDPRLQAEWITIRAEAIQNREVIVKAHPSLQGKDFMSELKLEIASWVDMFKPKLIRRTIIGPILMMFQQFSGINALIYYSPTLFEQLGLDYEMQLDMSGVLNIIQLVACVLAFFVIDRVGRRPLLLFGSTANTICHVIVAVVMAKFSHDWVRYSKEAWVAVAFIFIYIFTYGVGWAPVPWAMPAEVHTSSRRAKGVAITTCANWLGNFIIGLITPPMLQNIKYGTFLFFGAFTFLSGLYVWFFCPEPMGKTLEQMDQIFHSNTAHEDNLAKSDIQAVILNSPVAGPLSGTASAEKINDKDTQQEWVETV

SEQ ID NO: 19432 - protein, 203 aa, Brassica napus
QDHIDNNGECKYVVWVSFTGLGNRILSLASVFLYALLTDRVLLVDRGKDMEDLFCEPFPDMSWLLPLDFPLTSQFDGLNQDSSRCYGHMLKNHVVDNDKTSSHLYLHLVHDYGDHDKMFFCQGDQTFIGKVPWLVVKTDNYFVPSLWLIPGFDEGLDKLFPQKETVFHHLGRYLFHPTNQVWGLVTRYYEAYLSNADEKIGIQ

SEQ ID NO: 19433 - protein, 313 aa, Medicago truncatula
MAPPVRGRGGGGFRGGRGGDRGGRGGGRGGFGGRGGDRGTPFKARGGGRGGGGRGGRGGGRGGGRGGGMKGGSKVIVEPHRHEGIFIAKGKEDALVTKNLVPGEAVYNEKRVTVQNEDGTKTEYRIWNPFRSKLAAAVLGGVDNIWIKPGAKVLYLGAASGTTVSHVSDIVGPTGVVYAVEFSHRSGRDLVNMAKKRTNVIPIIEDARHPAKYRMLVGMVDVIFSDVAQPDQARILGLNASYYLKAGGHFVISIKANCIDSTVPAEAVFSAEVNKLKADQFKPMEQVTLEPFERDHACVVGGYRVPKKKKDAE

SEQ ID NO: 19434 - protein, 308 aa, Bacillus anthracis str. Ames
MKEVLEVLPKTMKQLVESCKQYDALEEIRVRIGRPLECIAHGEVFFYDYIVTAEDAIHLLNKLSQFSIYTMEEELKRGYVTLRGGHRIGLAGKVITEKSAVKMIRDVSSFNIRIARQKIGIAEPLLPYLYESRWLNTMVIGPPQTGKTTLLRDVARCMSQGVSASEIPSCKVGIVDERSEIAGCVKGIPQYDFGTRVDVLDACPKAEGMMMMIRSMSPDILIVDEIGRKEDSEAIMEAVHAGVQLFISAHGFSYDDVVKRPSLKAVLELGIFDRFVELSKARGPGTVMQVKDKNGKSVLPHRKAEGVW

SEQ ID NO: 19435 - protein, 142 aa, Glycine max
MAFRAARNVGLRLGGGRRSIATASAKKHDDWATLKAELAPVYMVCGMVAMAVAIGSHTAFQQLARSPTVHINKKRRESMPEVSDPDRTFNSATKFIDGSFLRKLSHIQDNNPTLHDPSHPNPFTTPRTAHTLKTVGVHPSSR

SEQ ID NO: 19436 - protein, 292 aa, Salmonella enterica subsp. enterica serovar Typhi str. CT18
MFTGSIVALVTPMDEKGNVSRSCLKKLIDYHVANGTSAIVSVGTTGESATLSHDEHGDVVMMTLELADGRIPVIAGTGANATAEAISLTQRFNDSGIVGCLTVTPYYNRPTQEGLFQHFKAIAEHTDLPQILYNVPSRTGCDMLPETVGRLAEIKNIIAIKEATGNLTRVHQIKELVSDDFILLSGDDASALDFMQLGGHGVISVTANVAARDMADMCKLAAEGQFAEARAINQRLMPLHNKLFVEPNPIPVKWACKALGLVATDTLRLPMTPITDHGRDIVKAALQHAGLL

SEQ ID NO: 19437 - protein, 523 aa, Candida albicans SC5314
MYQHQDQTQHQYYQQYNSYNPSIEDLIASSDDKRYQNGGIGNSLQRPPVAGLPYISSQVNPNTSSANLSKLTSNINNYGYNNNNNSHIQLHTPPLSSNPSFTSFQNLNYPLSPLSKPTSPEPILSAASVTTSNFLASSFFSWLPPIDVKIVSFCIGWYLCSIISSNSTKLILNDFKFPVTLTQFQFSASFTFCLVFLNIVKVNPESISSKLPPGFIPSMTDTNRISLSEFITPTRLIIQTTLPMGMFQFIGHITSHKATSLIPVSIVHTIKSLSPIITVLIYRFLFGKSYRMRTYVTLIPLCCGIMLTCYKKSHTSNQNNVPGAGSSVINNNLDKINTNNNYSTGLIFAFISMIIFVSQNIFAKKRLTVESTNAIPMNNKSSLRINSNKVDKLTILFYCSIIGFILTCPIYFVTEWMNYNAFGAISLLQLNSYVMSLVLLNGLSHFVQSLLAFQILGMVSPINYSIANILKRIFIILISFIWESKQFSNSQSIGLVITLFGLYCYDRWGTVSNSGSASNPGKY

SEQ ID NO: 19438 - protein, 335 aa, Mycobacterium avium subsp. paratuberculosis K-10
MNTPATVVAGVDFGDPAFAATVRDGVGRIEQLMDTELRSADDIMTESLTHLFKAGGKRFRPLFTVLSAQIGPDPDAAEVTIAGAVIELVHLATLYHDDVMDEAEVRRGTPTANVRWGNNVAILAGDYLFATASRLVSRLGPEAVRLIAETFAQLVTGQMRETRGRKQGSDPIEHYLKVVYEKTACLIAAAGRFGAMFSGADADQVERLSRLGGIVGTAFQISDDIIDIDSDSHESGKLPGTDVREGVHTLPMVYALREPGPDAARLRELLVGPIDDDEVVAEALTLLRASPGMAKAKQSLREYAAQAHRELDQLPDVPGRRALQTLVDFTISRHG

SEQ ID NO: 19439 - protein, 247 aa, Medicago truncatula
MVKIGFGTFDDSFSAASLKAYLSEFIATLIFVFAGVGSAIAYNDLTSDAALDPAGLVAVAVAHAFALFVGVAIAANISGGHLNPAVTFGLAIGGNITILTGLFYWIAQLLGSIVASLLLNYVTAKSVPTHGVAAGLNPIAGLVFEIIITFGLVYTVYATAADPKKGSIGTIAPIAIGFVVGANILAAGPFSGGSMNPARSFGPAVVSGNFADNWIYWVGPLIGGGLAGLIYGDVFIGSYTPAPASEF

SEQ ID NO: 19440 - protein, 136 aa, Oryza sativa
MAAAAEGEKKMITLKSSDGEEFEVEAVGMESQTIRHMIEDKCADNGIPLPNVNSKILSKVIEYCNKHVHASADDSTSSADLKNWTPTSSSAEFVQIYLDMIKGKTPEEIRKTFNIKKDLAPEEEEEIRRENQWAFE

SEQ ID NO: 19441 - protein, 182 aa, Thermus thermophilus HB27
MTLKALAQSLGITLKYLFSKPVTVPYPDAPVALKPRFHGRHVLTRHPNGLEKCIGCSLCAAACPAYAIYVEPAENDPENPVSAGERYAKVYEINMLRCIFCGLCEEACPTGAIVLGYDFEMADYEYSDLVYGKEDMLVDVVGTKPQRREAKRTGKPVKVGYVVPYVRPELEGFKAPTEGGKR

SEQ ID NO: 19442 - protein, 226 aa, Oryza sativa (japonica cultivar-group)
MAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKVTHSCLVEFVICALLNLKGGHEPGWRDVPVHDPVVKDAADHAVKSIQQRSNSLFPYELLEIVRAKAEVVEDFAKFDILMKLKRGNKEEKFKAEVHKNLEGAFVLNQMQQEHDESSSQ

SEQ ID NO: 19443 - protein, 66 aa, Solanum tuberosum
QTQNAHLEFVEVLNVKEQVVAGMMYYITLVATDDGYKKIYKTKIWVKEWENFKEVQEFKQIVYATK

SEQ ID NO: 19444 - protein, 443 aa, Arabidopsis thaliana
MSELKERLLPPRPASAINLRGDAGSRPSPSGRQPLLGVDVLGLKKRGQGLKSWIRVDTSANSQVIEVDKFTMMRRCDLPARDLRLLDPLFVYPSTILGREKAIVVNLEQIRCIITADEVLLLNSLDNYVLRYVVELQQRLKASSVTEVWNQDSLELSRRRSRSLDNVLQNSSPDYLPFEFRALEVALEAACTFLDSQASELEIEAYPLLDELTSKISTLNLERARRLKSRLVALTRRVQKVRDEIEQLMDDDGDMAEMYLTEKKKRMEGSLYGDQSLPVYRTNDCFSLSAPVSPVSSPPESRRLEKSLSIVRSRHDSARSSEDATENIEELEMLLEAYFVVIDSTLNKLTSLKEYIDDTEDFINIQLDNVRNQLIQFELLLTTATFVVAIFGVVAGIFGMNFEIDFFEKPGAFKWVLAITGVCGLVVFLAFLWYYKRRRLMPL

SEQ ID NO: 19445 - protein, 409 aa, Thermus thermophilus HB27
MREEFLEEIPLDAPPEEAKELRTEVMTLNVGPQHPSTHGVLRLMVTLSGEEVLEVVPHIGYLHTGFEKTMEHRTYLQNITYTPRMDYLHSFAHDLAYALAVEKLLGAVVPPRAETIRVILNELSRLASHLVFLGTGLLDLGALTPFFYAFRERETILDLFEWVTGQRFHHNYIRIGGVKEDLPEEFVPELKKFLEVMPHRIDEYEALFAESPIFYERARGVGVIPPEVAIDLGLTGGSLRASGVNYDVRKAYPYSGYETYTFDVPLGERGDVFDRMLVRIREMRESVKIIKQALERLEPGPVRDPNPQITPPPRHLLETSMEAVIYHFKHYTEGFHPPKGEVYVPTESARGELGYYIVSDGGSMPYRVKVRAPSFVNLQSLPYACKGEQVPDMVAIIASLDPVMGDVDR

SEQ ID NO: 19446 - protein, 300 aa, Mycobacterium avium subsp. paratuberculosis K-10
MSTVGFDAPARLGTVLTAMVTPFAADGSLDTAAAARLANHLVDSGCDGLVVSGTTGESPTTTDDEKRELLRVVLEAVGDRARVIAGAGTYDTAHSVRLAKACAAEGAHGLLVVTPYYSKPPQRGLIAHFTAVADATELPVLLYDIPGRSVVPIESSTIRALASHPNIVGVKDAKADLHAGGQIIAETGLAYYSGDDALNLPWLAMGATGFISVISHVAANQLRELLSAFTSGDIATARKINATVTPLCDAMARLGGVTMSKAGLRLQGIDVGDPRLPQVPATPEQIEALTADMRAASVLR

SEQ ID NO: 19447 - protein, 431 aa, Bacillus cereus ATCC 14579
MNKDITKDEHLPSESTTVQSAHLALSGETKGWKRLLPFLGPAFIASVAYIDPGNFATNIAAGSQYGYLLLWVILASNLMAVLIQTLSAKLGIATGNNLPEIARENFPKPVSIGLWIQGELVIMATDLAEFIGAALGLYLLFGIPMLPAALITAAGSFIILEFQRRGFRPLEAIITGMIFIVVIAFGIQVFYAKPELSPLLSGLFIPKFQGVDSILLAAGILGATVMPHAIYLHSALTQRRVVGTTDEQKKKIFRFEFIDIIIAMVIAGAINASMLIVAAALFFKNGLHVEDLDVAYTQFTNLVGPVSAALFGIGLLSAGLSSSSVGTMSGDIIMQGFIRMHIPLYLRRFITMIPPLVIIALGVNPTYALVMSQVVLSFGIAFALVPLIMFTSNKKIMGALVNHRITTFIAWIIAALVIVLNIFLLYQTFVG

SEQ ID NO: 19448 - protein, 299 aa, Pseudomonas fluorescens PfO-1
MNTPNVEAVKLDELNCWRIRHGQAEVLVAQQGAHILSYQVDGQPPLIWLNDKAVFKTGKSIRAGVPVCWPWFGKFERNPQNVQAMRTSEEPAGAHGFVRAMDWELGGIETEGESLKVEFKLPYPEGGFPEWPHQVDLTLTLRLDDQLHISLTSHNRGTDTVSISQALHSYFAVSDVRNVRVEGVDGLDYIETLDDWKTFTQQGDLRFAGETDRIYLDAPAQLSIVDPAWERRIVLTTTGSRTAVIWNPWIDRAAALSDMDNDGWQRMLCIETANVMSDVMNLAPDASHTMGVSVGSQPL

SEQ ID NO: 19449 - protein, 299 aa, Brassica napus
MAEEKKVAPTGVWTAVKPFVNGGASGMLATCVIQPIDMIKVRIQLGQGSAVSVTKNMLKNDGIGAFYKGLSAGLLRQATYTTARLGSFKMLTAKAIEANDGKPLPLYQKALCGLTAGAIGACVGSPADLALIRMQADNTLPLAQRRNYTNAFHALYRISADEGVLALWKGCGPTVVRAMALNMGMLASYDQSAEYMRDNLGLGETSTVVGASAVSGFCAAACSLPFDFVKTQIQKMQPDAQGKYPYTGSLDCAMQTLKSGGPLKFYTGFPVYCVRIAPHVMMTWIFLNQITKFQKTIGM

SEQ ID NO: 19450 - protein, 359 aa, Hortaea werneckii
MAEFVRAQIFGTTFEITSRYTDLQPVGMGAFGLVCSAKDQLTSQAVAVKKIMKPFSTPVLSKRTYRELKLLKHLRHENIICLSDIFISPLEDMYVVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIATICSENTLRFVQSLPKRERQPLKNKFKNADPQAIELLERMLVFDPRKRVKAGEALADPYLAPYHDPTDEPEAQEKFDWSFNDADLPVDTWKIMMYSEILDFHNVDANAEQAAHNNDTVAG

SEQ ID NO: 19451 - protein, 506 aa, Vibrio vulnificus YJ016
MIYAQPGSDNAVVNFKSHYDNYIGGEWVKPVSGEYFDNISPVNGQAYCKVARSSAADINLALDAAHSVRYQWAKTSVTERANILLKIADRIEAHLEELAVAETWENGKPVRETLAADLPLVVDHFRYFAGCIRAQEGSAAELDANTASYHFPEPIGVVGQIIPWNFPMLMAAWKLAPALAAGCCVVLKPAEQTPTSILVLMEKIGDLIPAGVVNVVNGFGAEAGQALATSNRIAKLAFTGSTEVGNHILKCAAESLIPSTVELGGKSPNIYFPDVFDHEDAYLDKCIEGTLLAFFNQGEVCTCPSRVLVHESIYDQFIAKVAERAKSIKQGNPLDTDTQVGAQASQEQFDKILSYLEIGRQEGAKVVFGGEIAKQEDDLATGYYIQPTLLQGHNKMRVFQEEIFGPVIAVTTFKDEAEALAIANDTEYGLGAGVWTRDQNLAYRMGRNIEAGRIWINCYHAYPAHAAFGGYKKSGIGRETHKMMLNHYQNTKNLLISYDVNPLGFF

SEQ ID NO: 19452 - protein, 564 aa, Oryza sativa (japonica cultivar-group)
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVHSLCWLFFQRPVLRNESRHVCVTLISMLAFL

SEQ ID NO: 19453 - protein, 429 aa, Salmonella enterica subsp. enterica serovar Typhi str. CT18
MTRRAIGVSERPPLLQTIPLSLQHLFAMFGATVLVPVLFHINPATVLLFNGIGTLLYLFICKGKIPAYLGSSFAFISPVLLLLPLGYEVALGGFIMCGVLFCLVSFIVKKAGTGWLDVMFPPAAMGAIVAVIGLELAGVAAGMAGLLPAQGQSPDTKTIIISMVTLAVTVFGSVLFRGFLAIIPILIGVLAGYALSFALGVVDTTPIAQAHWFALPTFYTPRFEWFAILTILPAALVVIAEHVGHLVVTANIVKKDLVRDPGLHRSMFANGLSTIISGFFGSTPNTTYGENIGVMAITRVYSTWVIGGAAIFAILLSCVGKLAAAIQIIPLPVMGGVSLLLYGVIGASGIRVLIESKVDYNKAQNLILTSVILIIGVSGAKVHIGAAELKGMALATIVGIGLSLIFKLISLLRPEEVVLEANDAESPHQ

SEQ ID NO: 19454 - protein, 160 aa, Zea mays
  misc_feature (86)..(86): Xaa can be any naturally occurring amino acid
  misc_feature (106)..(106): Xaa can be any naturally occurring amino acid
  misc_feature (115)..(115): Xaa can be any naturally occurring amino acid
  misc_feature (120)..(120): Xaa can be any naturally occurring amino acid
  unsure (1)..(160): unsure at all Xaa locations
KIRSPSLSPILPASPPPPTKSAPPKAHPSHGRAMPPSVDAMPAPGDAAGGGDVRMISSKELRSHASAEDLWISISGDVYDVTPWLXHHPGGDLTLLTLGGQDATDXFAAYHPPSXGPLLXRFFRWAPLRTPVSPRGRAEITGRPSPRGKIFFPPGGGRSF

SEQ ID NO: 19455 - protein, 506 aa, Mycobacterium avium subsp. paratuberculosis K-10
MTVTPQEAADHGAAEADYFDVLIVGAGISGIDAAYRITERNPQLSYAILERRARIGGTWDLFRYPGVRSDSSIFTLSFPFEPWTRKEGVADGVHIREYLTATAHKYGIDRHIRFNSYVRSADWDSTSDTWTVTVEDGARDGERKLYRARFLFFGSGYYNYDEGYTPDFPGIEEFTGTVVHPQHWPEDLDYTGKKVVVIGSGATAVTLLPSLSDRAAKVTMLQRSPTYLISASKYGKVAAVARKVLPRKPAHLVIRMYSALTEAVFFALSRKAPRLVRWLLRRKAINSLPPGYAVDIHFKPRYNPWDQRMCLIPDADLYNAITAGRADVVTDHIDHFDATGIALRSGAHLDADIIITATGLQLQALGGATISLDGNEIKTNDRFVYKAHMLEDVPNLFWCVGYTNASWTLRADITARATAKLLEHMTTHGYTHAYPHRGNEPMTEKPSWDINAGYVLRSVHALPKSGTKRPWNVRQNYLADAIDYRFDRIEEAMVFGRAADRAALAG

SEQ ID NO: 19456 - protein, 398 aa, Oryza sativa (japonica cultivar-group)
MTMVRIIGPSPAQSSSPTPRRPRPPRPRRRPPTMASAAASSSKPPVVLGCGAVSADYLATVASFPNPDDKIRSLTLKVQGGGNTGNALTAAARLGLRPRIISKVSNDPQGRNILKELQDDGVDTSHILVAEEGNSPFTYIIVDNQTKTRTCIHTPGYPPMVPEELTQENLFAALDGADIVYFDVRLHETALLVAEEASQRKLPILIDAERKRDGLDELLNFASYVVCSAKFPQAWTGASSTPVALVSMLLRLPNIKFIIVTLGEKGCLMLERSTTDASEAEEIDVESLLESLEKKEVLSSSMPKCIASKSNLRISADGIGSISGRLLLGTAEIIPSEELIDTTGAGDAFIGAVLYGLCSGMPPEKMLPFAAQVAACGCRGLGARTALPHRTDPRLVAY

SEQ ID NO: 19457 - protein, 499 aa, Gibberella zeae PH-1
MTTVGGIAEPKMSAWLIFSIVVISMGSIFWGYDIGILSTIYVSPGFNKALDNPSSSDKGLITSIFYAGQFIGFAFFAGPLNNRYGRRWAGFGGVCLLCVGAAIQTGSVHLAMMVVGRIVAGLGTGVVSTSVPLYLSEISPAKNRGLYVAANQVGIVSGISIAFWVGYGYSFWKTGNGVDLEWRLSNAMQFVPAVLFLVGVPFIPESPRWLVESDQIEAASRSLSKLRGLSPSEVQPELDEIHANILWHQENSITSARVFIQQKPLWSRLWRAWSLAFLQQMSGAAGIRYYLPTNFIAAGTSKELSLLASGIDGTVQVACTVAAMFFIDKIGRRHSLGVGAIIMAFCLMINGALQLAYPGQTNSHANYVNIFFIFFFTVGYSMGFGPCAWIYASEIFPANCRSKGLGISSSGASLGSIIVGQVWPVAVSRIGPRVYFIFMSFNVFSAILVYSCYPETKNKTLEELDSHFGSLNVHAEEVATPKQMLAVEEELVQARTKDA

SEQ ID NO: 19458 - protein, 453 aa, Mycobacterium avium subsp. paratuberculosis K-10
MAIIHGADRGARPQSWEEVARVTETTTQPVADAVADRPSVSLRTRGRWLRWGLLSVWGPGLVVMLADTDAGSLITASQSGAQWGYRMVLPQLILMPVLYVVQEMTVRLGIVTGRGHGSLIRERFGRGWAWLSAFTLFASAIGALLTEFAGVAGVGELFGVSRWVSIPVATIALLALALTGSYRRVERIGLAVGAAELAFLVAMVMARPDPGALAHGLTSMPLGDSSYLLLIAANVGAVIMPWMIFYQQGAVVDKHLSESTIRQARYDTAFGAVLTQLIMIAVVITMASTIGRHGDGAPLETVGQIAQSLTPYLGHVGGTVLFGLGMLGAALVAAIVASLAGAWGLAEVFGWKHTLNQRPNRATAKFYLTYSLAHIVGAVLVLASVDLVNLAVDVEIMNALLLPIVLGLLLALEARALPEQWRMRGLHKHVTRALCLVTIGFGLYMVPQALGWA

SEQ ID NO: 19459 - protein, 257 aa, Gluconobacter oxydans
MYMEKLRLDGRTAVVTGGAQNIGLACVTALAEAGARVVIADLDEAMAAQSAEELCAEGLDVRSIRMDVTSMENVQAAIKTLHEQEGHLDILVACAGICISEVKAEDMTEGQWLKQVDINLNGMFRCCQAVGRIMLEQKKGAIVAIGSMSGQIVNRPQQQAAYNASKAGVHQYIRSLAAEWAPHGIRANAVAPTYIETTLTRFGMEKPELYDAWIAGTPMGRVGQPDEVASVVHFLASDAASLMTGSIVNVDAGFTVW

SEQ ID NO: 19460 - protein, 370 aa, Oryza sativa (japonica cultivar-group)
MAAMARHLPAILLLSSALLLALASASASAAAPALAAFVDAASRRYLRDQQHHDQAASMSLDQVSAAVSVLLGFAPPPSLPAQSSSKLDKLLLPNPFDRPRAVFLLQIDGFHASVESITSEAGSIFKTTIDGLSDSATGLTDKDDLVIVHSDESPAVDSGSEYFDSDLTDLANWLGGSYEKVDGKLIIPLESGESLTLLITKEADMEFASSLISLRKTIKRGIQVHEDFSGGVMSPAELLVCHFKGIKALEEEYGSTEIVKQGTDVVRTAVTKAFDLLRGAYNGKIVGLVISTKEASPSLVGPASSLHISRWLKETSQTNTTIASSEILVRKSLAWITGIILLVSTLIGVCLLMNMPLTRDTLLYSNVKID

SEQ ID NO: 19461 - protein, 202 aa, Prunus persica
MASYEKQYGATPTDEYGNPIRRTDEYGNPLGHHTTTTGTTAATTGAGGYDPHDFAATTVAGQGQGVHGHDYDRKGHHGVTGAVLHRSGSSSSSSSEDDGLGGRRKKKGLKEKVKEKLPGGTKTDTTYGGTGTTGQHHQEKGTMDKIKEKLPGTGGHRADDPYPSQTHTTATTTPYGGTAYTEEHQEKKGIMDKIKEKLPGQH

SEQ ID NO: 19462 - protein, 158 aa, Oryza sativa
MACSPRVFLSASATPPPPSAAASSSSPFLSTGHVSSAPSTSRQAWTVQYKQPGHTFYRRTHVQSFLAFASTDASEGKRSSGDNVVMVDPLEAKRLAAQQMQQIQAREKLKRRRRAEAINGALAMIGLTVGLVLEGQTGKGILAQLAGYLTALSSLFGQ

SEQ ID NO: 19463 - protein, 135 aa, Oryza sativa (japonica cultivar-group)
MIEIIDLSQYIGPELDKKKAKLEKAKSKLLELEKKADIEENTRVTAVESVMQALVFLDSEHDVNMIVSDYCMPEMTGYDLLMEVKKSPRLVHLPVIIASSDNIPERIRKCFDGGAKDYILKPVKIADVPRILNYI

SEQ ID NO: 19464 - protein, 188 aa, Sinorhizobium meliloti 1021
MSRALDKAGRWIGWAFFADLANGLALTFGYMFSRPVTMQYPDKEKWLPYSRYRGHHFLKRDDEGEIKCVACELCARICPCDCIEVVPYEDEKGNRRPAKFEIDTARCLFCGLCEDACPADAIALGQQYEFSSFSSRDLVIGRDDLLAKPGKAMTGGGVVAARLNTERDVLVEASEPRGYNWWRNIRRK

SEQ ID NO: 19465 - protein, 580 aa, Oryza sativa (indica cultivar-group)
MGKSPAKWIKSVLFGKKSSRSGSTKAKDLSKGSNNKGYAAAGKDAGFESSPVISEPVLVTPHNNEAVQEVGRGENSSLQGEVVVRDVSQDLEKQNTVVSDASNDPERLREEQAAVKAQAAFRGYLHGIGPGTSGIPCVERNHKTPSPDSWASRKEASRCNSSCNMVDCEVSSSSPWLTRPHTRNMCPNLLALKPHKQPIMLYKSYKSGKRDAWKEKLSSNAFARKLLASPILVEALHFQYDERDPNSAFNWLERWTIGRVWRPISHPKRAAVTDAKPHTRKASYAMETESGKLKRNSRRSSAAPVESSQTNMAMETEKSRRNPRKFTSSTADSVPESQLTELEKVKRNLRKVTNSMAEASKVSTPATEIPERQEVQCEKPQRTAEEVPNYPEIQEPQNGNLLENAKTDILVPDLQPEPEVPSYQVETEEKVAELTVADPAVETMPLQDIHNEENALVNDMEQRSKEEPLSTESLKSSKRRSSFSTKTEYPENGSKNSPAVPSYMAATQSAKAKLRGQNLPRLSSDSAEKNGFTRRHSLPSSNGKLNSHSPRTQRPTHAGGKEGVKADKSMLSSRDASGKL

SEQ ID NO: 19466 - protein, 503 aa, Rhodococcus sp. RHA1
MSIPPDFARRTPVARHHPPMPGHTHAEPDDSPSTRCHLHPKRRERILTRGYDTSPPLRSEDVHPTFTWNVVTRSYSYLFCPIRGACRLPRMTDSGRELDLAIYGATGFVGRLLADYLARTAPGGVRIGLAGRSQAKLEATRAALGPRAADWPIILADADDPVALAELASRTRVVATTVGPYAKYGIELVTAAVAAGTDYVDLTGEVLFVRASIDAHHDKARANGVKIVHSCGYDSIPSDLGVHVLHQKVQADNAGELTDTTLVASLSGGVSGGTIDTLRTQIDLSRGDAALRRLAASPYSLSPDRTKEPDLGRQSDVAIVDGTDIAPQVRGWKAPFVMGSYNTRIVRRSNALQNWVYGRGFKYREVMSVGDSRLSRVYAAGVAALLGGLVLGLSVPPTRYVLDRLLPAPGEGPSEKTQHNGYFAMDIYTTTTTGARYASRVAAQGDPGYRATAVLLGESALSLVLDRDRLPGEAGVLTPATALGDVLVERLRGAGVEISARKL

SEQ ID NO: 19467 - protein, 443 aa, Candidatus Desulfococcus oleovorans Hxd3
MICKTADDVRKIVKEKNVSFIQFWFTDVLGALKSFAITPDELEEGIEEGMGFDGSSIQGFCRIHESDMIAKPDPTTFQFVPWRGEGDRPVARMFCDILQPDGTPYEGDPRYVLKRLLGQVAEKGYTFYVGPELEYFYFKNDQGTGILDKAGYFDARPMDMGGDLRRQTIFALQAMGIQVEYSHHEVAPSQHEIDLRYAEALNMADITMTYRMTVKEIAHRNGVYATFMPKPIFGENGSGMHVHQSLFKDGKNAFHSKDAKFNLSDIAKHYIAGILKHAPEIVSITNQWVNSYKRLVPGYEAPVYVSWANRNRSAMVRVPMYKPGKEAATRMEFRAPDPSCNPYLAFAVMLGAGMEGIENKYPLPDPIEEDIFEMTPAERHNKGITELPGNLYSAILETEKSGLVKKVLGEHIFKEFIDNKKVEWDRYRTHVSTFELENYLPKL

SEQ ID NO: 19468 - protein, 318 aa, Oryza sativa (japonica cultivar-group)
MLGTFKADVKIVDDQTISVDGKLIKVVSNRDPLKLPWAELGIDIVIEGTGVFVDGPGAGKHIQAGAKKVIITAPAKGADIPTYVLGVNEGDYSHEVANIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLSGILDVCDVPLVSVDFRCSDVSSTIDASLTMVMGDDMVKVVAWYDNEWGYSQRVVDLAHLVASKWPGAAVQGSGDPLEDFCKDNPETDECKVYEN

SEQ ID NO: 19469 - protein, 793 aa, Treponema denticola ATCC 35405
MKRKLVTSALPYVNNFPHLGNLIQVLSADVFARFCRLKEYETLYICGTDEYGTATETKALEEKKSPEELCSFYHAIHAEIYNWFNIAFDYFGRTSTPQQTEITQGIFNDLDKNGYITEHTIEQLYCPSCKRFLADRYVLGTCPSCSYDGARGDQCEHCGKLLDPTDLKEPRCSSCGAAPEVRSTTHLYINLPKIVPEYEKWMPKTAEEGRWSNNALQMSKSWLRDGLQERAITRDLKWGIPVPKKGFEDKVFYVWFDAPIGYISITKCWADLAGKDWKAWWLDQNDVELFQFIGKDNIPFHTVIFPCSLIGSGKNWTKLFHMSGTEYLNYENGKFSKSKGVGVFGNDAKESGIPADMWRFYIFYNRPEKNDTQFTWKDFQERVNSELIGNLCNLVNRTATFIHRYYDGKIPQVDGAKSGREDIKSMVKSLREAASASFKKITELSDWAELRDSFHEAFALSSVANKAFQDGEPWKRRETDPEYAEALMSELCYLIKDILILIHPYMPQYADQAAGFFGQKIWSGNIFDGKAPQFNKPEGSFLSWKNLGEREGLKTVENPVIIFKTLDNKVIDAYRERYSGSQKDRKKSEKGCSACKDSGSSKSDAAASSAKPEVKLSPAELFSKKIALKTAKIISVERHPDADKLYIEKLDDGSGEERTILSGLVPFLKEDEILGKTVIIADNLKPRKMRGIESKGMLLAASWYDEEEKEHVELLQAPWAAPGTPVILEGDADISDPEAVKAFYAQKPAAIDADTFFAAPILIEDYIPKIEGKKLLVAGKEMKLEKVKTGEAG

SEQ ID NO: 19470 - protein, 315 aa, Neisseria meningitidis
MKTNFLKLAVETLQLEANAIMEMSKRLDNEFEKAIEIILNTQGRVVVVGMGKSGIIGQKLAATMASTGTSAFFVHPGEAFHGDLGMIKPIDVALLISNSGETEEIIRILPFLKEQGNKIIAMTGNIKSTLAKHAHSLLDISVSREACSNNLAPTSSTTCTLAMGDALAMVLQSEKKFLPEDFARFHPGGSLGRRLLTRVSDVMKTKIPHCLPDASFKEIVYSINRGYMGLTLVMEHDTLHGIITDGDLRRAFDRFDNINQIKAKDIMSLSPKYVSADARFAEAEAYMHAEKIDSLVVKESNKVIGVLNIYDIDHY

SEQ ID NO: 19471 - protein, 389 aa, Glycine max
MADLGSASSKRMWCSVPERMQLHLAMLALQFGYAGFHVVSRAALNMGVSKLVFPVYRNIIALLLLLPFAYFLEKKDRPAMTLNFVCQFFLLALVGITANQGFYLLGLENTSPTFASAIQNSVPAITFLMAAILRIEQVRLNRKDGLGKVAGTVLCVVGATVITLYKGPTIYSPTTGVNINNTRVTQVFELGSVSLGDAKGKNWTLGCLYLIGHCLSWSGWLVLQAPVLKKYPARLSVTSYTCFFGLLQFLVIALLLERDAQAWLFHSGGEAFTILYAGVVASGIAFAVQIWCIDRGGPVFVAVYQPVQTFVVAIMASIALGEEFYLGGIIGAVLIVAGLYLVLWGKSEERKFAREQLAIASTEHSIIRPASHAKASLAQPLLSSSTENV

SEQ ID NO: 19472 - protein, 262 aa, Oryza sativa (japonica cultivar-group)
MEDERNTESHQGGEAAEQVEVKDRGLFDNLLGRKKDDQPEEKKHEEELVTGMEKVSVEEPKKEEHHAEGEKKESLLSKLHRSSSSSSSSSDEEEEVIDDNGEVVKRKKKKGLKEKIKEKLPGHKDHAAPAPVVTHGDHHHDTAVPVEKIEGDHAKTEATLPRAPEEEKKGFLDKIKEKLPGGHKKPEDATAVPPPAASPAAPATTPAPAHPPPATEEVSSPDGKEKKGILGKIMEKLPGYHKGSGEEDKTAAAATGEHKSSA

SEQ ID NO: 19473 - protein, 304 aa, Methanococcoides burtonii DSM 6242
MVKVEKFIPNAIDRIKEQAKGKTIIALSGGVDSSVCAVLAYQAIKDDLIPIYIDTGLMRKGETERIKEIFADMNLQTIDAKDRFLDALVGIKDPEEKRKVVGETFIRVFEEEAREINAQYLIQGTIYPDRIESDGGIKSHHNVGGLPEHIDFKGIIEPIDDLYKDEVREVAWALDLPEEICERMPFPGPGLSVRIIGEVTEEKVDVVREANAIVEEELLEQFKPWQTFAAVIGKGTGVKGDVRVHGWIIAVRAVGSRDGMTAEALELPWETLMKIESRISGEIASVARVLYDLSPKPPATIEFE

SEQ ID NO: 19474 - protein, 525 aa, Salmonella enterica subsp. enterica serovar Typhi str. CT18
MTENIHKHRILILDFGSQYTQLVARRVRELGVYCELWAWDVTEAQIRDFNPSGIILSGGPESTTEENSPRAPQYVFEAGVPVFGVCYGMQTMAMQLGGHVEGSNEREFGYAQVEVLTDSALVRGIEDSLTADGKPLLDVWMSHGDKVTAIPSDFVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVMDMFGDHFGLNIVHVPAEDRFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 19475 - protein, 425 aa, Oryza sativa (japonica cultivar-group)
MQYRTQQAMLPAVKLSPGPVAFAGTNLRSRSASVSSVSSLKPSKFVVSSLRPLYLAPLDGPRAAGQKAQRQPLEFRCAASAADDKESKTEVLNAFPYPWLTSTLSLACGSAMMLVSWATRLVEAPKTDLDFWKVLFPVAVAHTIGHVAATVSMSKVAVSFTHIIKSAEPAFSVLVSRFLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWVAAQSVFYHLYNQVSYMSLDEISPLTFSIGNTMKRISVIVSSIIIFHTPVRPVNALGAAIAILGTFLYSQTAEYFSSFFCYRRQSSEFKKMVMFRAMDEEGIQMKNVSAKPVASTEANFACATYLVDIGGLGFDMRS

SEQ ID NO: 19476 - protein, 364 aa, Coccidioides immitis RS
MAEFVRAQIFGTTFEITTRYTDLQPVGMGAFGLVCSARDQLTNQAVAVKKIMKPFSTPVLAKRTYRELKLLKHLRHENVISLSDIFISPLEDIYFVTELLGTDLHRLLTSRPLEKQFIQYFLYQILRGLKYVHSAGVVHRDLKPSNILINENCDLKICDFGLARVQDPQMTGYVSTRYYRAPEIMLTWQKYDVEVDVWSAGCIFAEMLSGRPLFPGKDHVNQFSIITELLGSPPDDVIKTICSANTLQFVQSLPKRERQPLSEKFKGAEPLAVDLLERMLVFDPKKRITAAEGLAHEYLAPYHDPTDEPVAETQFDWSFNDAELPIDSWKVMMYSEILDYHNVDQDSQGIHGTPLNTEAQRVPM

SEQ ID NO: 19477 - protein, 367 aa, Triticum aestivum
MIADPAVTPLTSSHLPSPSLSRTPNPSPVSGLPLASPNIMGSDFKAIPLIDISPLVEKIDDPAMAGDEGLLDVVRMLDDACREAGFFYVKGHGISEPLMTEVRDVTRKFFQLPREEKLKIKMTPQSGYRGYQRVGENVTKGKPDMHEAIDCYTPIEPGRYGDLAKPMEGSNLWPDYPSNFNALLENYISLLRDLSRKIMRGIALALGAPLDAFEGGVAGDAFWVLRLIGYPVSDDIPQEERTDIGCGAHTDYGLLTLVNQDDEICALEVRNQSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 19478 - protein, 201 aa, Zea mays
MSYYGDRRAESSIVEAFTLSPLPYPVILVLLMVTLLLGASWFFTYDDFIEEASQQLSWALLGVPIALVLLIRWISSVDSFEGYLGFYPRESRWKGRYERGPAEGSSPWGVALLVLLLLVLARAGCGKVVYGNPGRLGRKRRGGDKVKEQAGDEAAKFPWSGMRLATEKRRRVRRSPSKKGIVLKQKSRKVSLQHRSKKLKA

SEQ ID NO: 19479 - protein, 797 aa, Lactococcus lactis subsp. lactis Il1403
MQVSYKWLKELVPNLRATSAELEQKMSTSGIEVEGVTSPMEGLSKLVVGEILSSEDIPDTHLHITQVNVGAEESLQIVCGAPNVRVGMKVIVALVGARIADNYKIKKGKIRGVESLGMLCALDEIGIDEKINPMKHEDGIFEMPADAKVGDSIFSYLDMDDEIIELSITPNRADALSMHGAAWEVGAIYGLPVQLEKKDLVEASESAASKIAVKVETDKVPTYKIRLIEGVKIAKSPQWLQNRLMNAGVKPINNVVDVTNYVLMAFGQPLHSFDFSKFGSDEILVRQAKAGEKMTTLDHVERELDDSDIVVTANGLPVALGGVMGGADSEITDETTSVALEAALFDGTSIRKTSQKFALRSEASSRFEKGINEGTVREALDFAAAMIVELAGGKVLSGVVESNDYQPILPKVSITLSRVNSALGTDLSLETVEKIFVQLGFGVEVEGEKFTCEIPSRRWDIHIEADLVEEVARIYGYDNLPSTLPSSQNAGELTQMQKFRRTVRTGLESSGLNEVIGYSLVTPEKATEFVGQLETTTLMMPMTEDRQTLRANMIPGLLDIVNYNQNRKNADVAIYEIGNIFLPNPDDIRPIEVPNLAFAISGNVVDKSYNGQAVPVDFYYAKGIVENLLEAYKEVEFIPSNNQAAMHPGRTAVIKINGRVAGFVGQIHPATAKKYDIAETYVAGLDMQVMLEELPAQTIFTDIPKVQAVHRDIALLIDAEVTHAQIVSVIKSSRIKTLSQVELFDIYQGKNLPAGKKSMAYSLTFQPVENTMTDEEITAAVNKITKNLVEKLDIEIR

SEQ ID NO: 19480 - protein, 469 aa, Prosthecochloris vibrioformis
MQQSESSSAQFDVAVIGSGPGGYEAALHAARHGMKVCLVEKRSLGGVCVNWGCIPTKALLRSAEVYDLAKNPSEFGVNVSELSFDLAQAVKRSRKVSLKSSKGVEFMLKKAKVEVWRGEAVLTGSKGVKVTAEDGSERSLEAANIIVATGAQPRVIPGLEPDGKKIITSREALILKDVPESMIVVGGGAIGVEMAWFYAKAGAKVTIVELMPRLLPAEEAEVSEALKRSFEKVDITVQCGAKLGNVAISEFGVNADLLAEGKEPQKIEASCMLVAVGVTGVIDGLGLDAAGIETERGFIRTDELCRTSASGIYAIGDVRGGMLLAHKASAEAAIAVEAIAGKLPEPLSEPLIPRCVYAQPSVASVGLTEEAAIAAGYKVLVGRSQFAASGKANAYGQLEGFVKLVFNAETGKMLGGHLIGHDAVELIGELGLACRYGVTAEGLVGTVHAHPTLSETVREAAFSALPNKG

SEQ ID NO: 19481 - protein, 146 aa, Sinorhizobium meliloti 1021
MHICQILGSKSPEIFSVTPDQTMVEVLRLFRDKNIGFVVVGRSPGECLGTLSERDCCYAVAEYGTEAPLMRVGEIMNRTVATCSTEDFLPFVMSIMTERRTRHVLVMDGNDAVGVVSIGDVVKHRLEEALQAERDMHDYICGANYR

SEQ ID NO: 19482 - protein, 948 aa, Synechococcus sp. WH 5701
MQTAGSDAPPDPAAVAAAVKDLAVGPSEVPPLDQLFPFPLDPFQLEAIDALNQGHSVVVSAPTGSGKTLVGEYAIHRALAHGQKVFYTTPLKALSNQKLRDFREQFGAERVGLMTGDLSVNREAPIVVMTTEIFRNMLYAEVDRGDDPLADVEAVVLDECHYMNDSQRGTVWEESIIHCPPPVQLVALSATVANAGQLTDWIERVHGPTTLVVSDHRPVPLAFSFCSAKGLHPLLNDQGTGLHPNCKVWRAPKGERRKGRSPKPPQPEAAPLPFVVAQMAERDMLPAIYFIFSRRACDKAVRDLGRVCLVNEAEQALIVARLDAFVAATPEAVREGGHAEALTRGIAAHHAGVLPAWKELIEELFQQGLIKVVFATETLAAGINMPARTTVISALSKRTERGHRPLMGSEFLQMAGRAGRRGLDVQGYVVTVQSRFEGVREAGQLATSPADPLVSQFTPSYGMVLNLLQRYDLAKAKQLVERSFGRYLATLDLVEDETNIASLRAQLAQLAGPTADIPWDDFEAYEKQRERLREERRIQRILQQQAEETLAHELTLALQFASEGTLVSLKAPQLRGRVTPAVIVAKQKGSGQFPLLLCLTDENVWILVPCHGVVSLHAELSCLQVDSIAAPHLEHAGEIRHGDNASGGLALAVASMARRHDMHTPQYDLAGEVRSQAELVQQLEEELEQHPAHRWGDRRQLKKQRRRMEELGEEIEERQRLLHHRANRHWDTFLALIEILRAFGALAGADGLEPTEVGRTVAALRGDNELWLGLALMSGHLDELNPAELAAVFEAISTEVNRPDLWSGFPPPPRSEEALHDLSGLRRELLRHQERAHVVVPAWWEPELMGLVHAWARGSSWNDVIANTSLDEGDIVRILRRTVDLLAQVPYAEAISEQLRSNARKALQAINRFPVSEFIDLRAEVAPVSPPAPATPAMERPAAAPQTA

SEQ ID NO: 19483 - protein, 294 aa, uncultured proteobacterium RedeBAC7D11
MSGLFVHNIFNKFLYKLKIKEFKSKNIEKKLVRNPNSNKGDYGHVLVIAGNLGFGGAALLSSKAVLASGAGLATLATRKDHLSAALAYCPEVMSKTVESISDLENHLPNKTVICIGPGLGRNYWTDQMLYKTTNFAAKENLPILIDADGLNILSENRLKIKLPKKLILTPHPGEAARLLKTKVSTIQKNRPQALAKLCEKYNATVILKGHETLVGNKRTSFVCKKGNAGMAVGGMGDVLSGLVSGLIAQGLSSIDAACLGVDMHASAADSFVEKHDMKSLTPSDLFNFIKMKNE

SEQ ID NO: 19484 - protein, 454 aa, Rhodobacter capsulatus
MAEFDVIIIGGGPGGYVCAIRCAQLGLKTACVEGRGALGGTCLNVGCIPSKALLHATHELHEVHENFEKMGLMGAKVKVDWAKIDGNTKGIEFLFKKNKVTYLRGWGSIPAPGQVKVGDEVHTAKNIVIATGSESSGLPGIEIDEQTVVTSTGALSLAKVPKSMVVIGAGVIGLELGSVYARLGAEVTVVEYLDAITPGMDAEVAKGLQRILTRQGLKFVLGAAVQGVDKAKGKNTVRYTLRKDESAHAIEAEVVLVATGRKPFTKGLGLEALGVEMLPRGQVKADSHWATNVPGLYAIGDAIVGPMLAHKAEDEGMAVAEVIAGKHGHVNYDVIPGVIYTTPEVAAVGKTEDALKQEGRAYKVGKFSFMGNGRAKAVFQAEGFVKILADAATDRILGAHIIGPSAGDMIHEICVAMEFGASAQDLALTCHAHPTYSEAVREAALACGDGAIHA

SEQ ID NO: 19485 - protein, 482 aa, Saccharomyces cerevisiae
MSAFVRVVPRISRSSVLTRSLRLQLRCYASYPEHTIIGMPALSPTMTQGNLAAWTKKEGDQLSPGEVIAEIETDKAQMDFEFQEDGYLAKILVPEGTKDIPVNKPIAVYVEDKADVPAFKDFKLEDSGSDSKTSTKAQPAEPQAEKKQEAPAEETKTSAPEAKKSDVAAPQGRIFASPLAKTIALEKGISLKDVHGTGPRGRITKADIESYLEKSSKQSSQTSGAAAATPAAATSSTTAGSAPSPSSTASYEDVPISTMRSIIGERLLQSTQGIPSYIVSSKISISKLLKLRQSLNATANDKYKLSINDLLVKAITVAAKRVPDANAYWLPNENVIRKFKNVDVSVAVATPTGLLTPIVKNCEAKGLSQISNEIKELVKRARINKLAPEEFQGGTICISNMGMNNAVNMFTSIINPPQSTILAIATVERVAVEDAAAENGFSFDNQVTITGTFDHRTIDGAKGAEFMKELKTVIENPLEMLL

SEQ ID NO: 19486 - protein, 404 aa, Sinorhizobium meliloti 1021
MTEVTELMRPEGEALNTKEVLLNLGPQHPSTHGVLRLVLQLDGEYVERVDPHIGYLHRGTEKLAESFTYTQIFPLTDRLDYLCPPSNNLAFALAVEKLLGIEAPIRAQYIRVMMAELARISGHLLITGALPMDLGAMTALLYAMREREMIMDLLEMITGARMHTSYCRVGGVREDLPDGFLPKIREFCEIFPNRIRDYERLIENNRVFLSRTQGVGVISATDAIDLGLSGPNLRASGVDWDIRRDEPYEIYDRLDFDVITREEGDCYSRWLCRVDEMRESIRLIEQCMEQMPEGPFQVDIPTIAFPVDKERVHCSMEALIQHFDLSAYGFDVPAGEVYSVIEAPKGELGFYIISDGSPKPFRMKVRAPSFVNLQALFGVTNARYLADMIAVLGSLDPVMAEVDK

SEQ ID NO: 19487 - protein, 182 aa, Sinorhizobium meliloti 1021
MTGERPVHLTAIIGSFGGAVENLGAAHGIYAFAVPPEQIVEFCRFLKEHPALEFDFLSDICGVDHYPETPRFETVYHLYSLKNKWRVRIKCRLGEPPHVPTVTGVWRTANWHEREAWDMYGIRFEGHPDLRRIYMWEGFEGFPQRKDFPLRGYKDKLNPFGAEGPPPTQPDLATNDIPQGGR

SEQ ID NO: 19488 - protein, 131 aa, Crocosphaera watsonii WH 8501
MSNFQIIRTNNAPSPVGPYNQAIAAQGRLLFLAGQIPLHPETGELVGENDITEQTQQVMKNIAAILAAAGANWQNVVKTTVFLSNLTNFTPMNQVYGQYFNEETAPARACVEVSRLPKDVLVEIECIAIIP

SEQ ID NO: 19489 - protein, 466 aa, Oryza sativa (indica cultivar-group)
MARLTVEQAKREAGSAGTLATSLNLSHRALSDVGAVSCLSSFVNLERLDLGYNCLLTLEGLSNCANLKWLSVIENKLVSLKGVEGLSKLQVLNAGKNKLKTMDEVKSLTSLGALILNDNNISSICKLDQLHQLNTLVLSKNPIFTIGDALMKAKAMKKLSLSHCQIEKIGSSLTACVELKELRLAHNKITTIPSDLAKNVKILNLDLGNNLIERRSDLEVLSELHYLRNLNLQGNPIAEKDGLAKKVKKLVPNLRIFNSKPMEASSKSKNSREENLPINDADTPDDGPTDIYTKKKGKGKHSKQQIKSPEEPAGQSTRPDVTIAAPAKSELLDGKEMKKEKAAVEHVKNKKSKRKDDNSSVDHTDKKVSKGAKRTKSAKKEEKNADGIDDTEMPFADLVFSGEGNNPELELKGKNQEIARDGKFGGLVIDHTKKKKKAKGTVFGSSALEQLSSVPEVGSGALSGWD

SEQ ID NO: 19490 - protein, 342 aa, Oryza sativa
MWPCLSPRAAVLIALLLLPAAMAAAAAAAGGHGEEMKSIYAGPKVVPVRLGRPAFGPESLAFDHRGGGPYTGVSNGRVLRTVAECAARKKAAAAAESVCGRPLGVQFDRRTGEMYIADAYLGLMRVGRRGGMAEVVAAEAGGVALNFANGVDVDQATGDVYFTDSSTTYKRSDYLLVVLSGDATGRLLRYEPRTGNVTVLESGLAFPNGVAVSADGTHLVVAETASCRLLRHWLRGSNAGATEVLADLPGYPDNVRHAAADGGRGASYWVALNRDKAWTVNGTTPASVAAVRVVVDDGGSKVDVALRGFGGATVSEVVERNGSLWFGSVDTPYVGLLKLTSL

SEQ ID NO: 19491 - protein, 401 aa, Oryza sativa (japonica cultivar-group)
MGGVIGALFRGGGHRREMHRAPMNQPGYGGGGENHRRAMLTKKYSYIPDNYQSLDQVTAALRDQGLESSNLILGIDFTKSNEWTGKRSFSGQSLHKIGSTPNPYEQAISIIGKTLAPFDDDNLIPCFGFGDATTHDYNVFSFHPDNSPCHGFEEVLSCYKKIVPHLRLSGPTSFAPIVEAAVDIVDRSGGQYHVLVIVADGQVTRSVDTSDNDLSPQERRTVDSVVMASSYPLSIVLVGVGDGPWEDMQKFDDKIPARQFDNFQFVNFTSIMSRSTTQQQKESAFALAALMEVPIQYKATMELGILGRSTGKAKRIMPAPPPLPSAAGRQPSLRREDSAAATAAAAPPSPREDQVCPICLTNAKDLAFGCGHMCCRECGESLTKCPICRQTIRSKLRLYSG

SEQ ID NO: 19492 - protein, 448 aa, Streptococcus agalactiae A909
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYIAWAGRNRSPLIRVPASRGMGTRLELRSVDPTANPYLALSVLLGSGLEGIENKIEAPEPIETNIYAMTVEERRQAGIVDLPSTLHNALKALEEDEVVKAALGTHIYTNFLDAKRIEWASYATYVSQWEIDNYLDLY

SEQ ID NO: 19493 - protein, 392 aa, Triticum aestivum
  misc_feature (331)..(331): Xaa can be any naturally occurring amino acid
  unsure (1)..(392): unsure at all Xaa locations
MLRRLLSSPSTSTSTYAIFPLRRILSAAAPHISPNPSGFAVEEYLVDTCGLTRPQALKASKKLSHLRSPTKPDAVLAFLAGLGLSGADAAAVVVKDPKFLCAKVDKTLAPVVAGLAGLGLSRPEIARLVSVAHCYFRTRPIVSKTHYYLPLFGSLDNFLRALQRSPCLLSSDLGKVIKPNVVFLRECGLSDCDIVKVCIPVPRMLTTDPERVRAMVACAERLCVPRGAGMFRPALHAVAFLREEKIAAQVDYLKNTFRWSDAQVSIALCKAPFILKKSKESLKRRSEFLFSEVGLEPVYIAHRPIFLSLSLEGRVRPRYYVLKFLKENGLXDRDLSFHTAVDRPEKFSVEKFICPHKEAAPHLAEDYATLAKGKCQLKPKMGKEIGTAYGTT

SEQ ID NO: 19494 - protein, 418 aa, Ostreococcus tauri
MSHERSASGDKMIEAGEKLERAYSPSLRSGEHAEVGCRDSMEDAVVLDDNVRVKGAEDVVAFYGVFDGHGGRAMAEFLRDNLMKNVVENDHFISNPELALKEAFYRTDEDFYATAGPSDTSGSTGLAACVIGGKLYIANAGDCRAVLSRKGKAIDLSIDQKPSSQSEMERIKSAGGFVEDGYVNGLLGVSRAFGDWHIEGLKGRGGKPGPLTVDPEIEKTRLTEEDEFLILACDGLWDVFSSQNAVDMARASLRQHNDPTSTARELASEALRRHSSDNVSVVIVCLTPEPPKKETFIRTSPSLLRSLSIDAISQVSRAMAEDANAPPVPQAFAPKRVHSLRDLSHVRSCSGDSDDSLAAEIASQPSAEQVSQVLESIAAINVQNNVQTGALGLERMNSSSVGLEPMSELDTLDEEEAT

SEQ ID NO: 19495 - protein, 739 aa, Ostreococcus tauri
MEDLAPITAMAAKNVPARVALGFDVKEDSSPTAVVPVSSLLRDGSGSSTESGDGVESLLNADELTVPNRDIRIMLKSGSSKPMEVLRSHAVTSLTLAMKPEWVSKHRHVFARSSRLLLGDQALPENLSRDEVYNKLDNPHEYSEVVMKLADLQYIRVKAVVNINEAGDIDEREYWLPLNKSQTIGEIKRLVATADDLESSKDKLLDNVDISTGMSMVLRGKELSNESTMESEGLEHNALVHLFVKKGSDVNVSMRGSSSLEIHVNVNKTADSLRDQLHMIKPGSVDSAQYTHVRSGSVSIFPGRSSLRSGPLSSYGFCEGGSLELRPYQPRVSPRTSPLTNSMAIPLSSSAAAYGAHSFGGRMTSSWGVRAATNSYRAGSASDNSTSPPSAPITPIGSPGTLSASFDMAREGLLMGKAPQLSQGGNGGAYFLKGADGRTAAVFKPADEEPYAPNNPRGHRSSHNGEGMRKGTRVGEGATREVAAYLLDHGGFAGVPATSLVNLTDGTEEDEGKLGSLQEYVENTAEAEEYGPSMFPTEDVHKITVLDIRLANTDRNAGNILCRSDEEGNIVRLIPIDHGYALPHTLEDVCFEWEFWPQASVAYSDEIKEYIAALDADADIEYLRENDIELQASSERVLRVCTLLLKESVKRNFTAANIAAMLSRTMPNRKSDVEKIAAQAASTAIAEGRSERGLLVHKSPENGSFWNDLAGDEVAESRFMNQFAKLLDDYLENFEPEDK

SEQ ID NO: 19496 - protein, 402 aa, Oryza sativa (japonica cultivar-group)
MWEYHHQLSTHAALQPSFLFSLKSNSTTGGGYRENFLDLLASKNVTPEMFEEVPASEHYNVAPAGTTLTTTARSFDHHARSDVSPIKYEIAGSPLYLGGTNTVLQVQDMTMMSSTPACYGEHHHHHHHQLTKEGSCNHQQQEQHELAISPMASFLQQISSGSASVGVHNSSLDYSGLGDQPDKICCQDGREMEASPFGMRSLPDLGSFAGYTPAIESTSVQPYMRCANSSDSNRQEQETVPARSSSSGSGAAATDRKKRKSEERQESTVKKSKQEASKASPPKQPVPKVKLGEKITALQQIVSPFGKTDTASVLFETIKYIKFLHEQVQLLSEPYTNSSRSNKQGNSVPWGDQAEASKGETMEHDLRNRGLCLVPVSWTPEVYRDGNAMDYWTPAYRGCLYR

SEQ ID NO: 19497 - protein, 433 aa, Methanococcoides burtonii DSM 6242
MNDVSSEKSIGYLSAVSIGIGGMVGGGIFAVLGLAVEIGKGGTPIAFGLAGIVALITSYSYAKLSVRYPSEGGTVEFLNQAFGSGLVTGGLNILLWLSYVVMLSLYAYAFGSYGSTFFPDSMQAVLRHVLTSIIIVSLTVVNIVGAKVVGKLETWIVGFKVAILLIFIGVGIWSVKSQPFQPTISSNPLQLVAGGMIIFLAYEGFELIANTAKDVKNPGKTLPCAYYSAVVFVIVLYVLIAFITVETVSIDSIIQAKDYALAVAAKPFLGNFGFNLIAVAALLSTASAINATLYGASRVSFTIAKDGELPEILEEKIWNRPIEGLLITSALTLIVANTFNLASISIMGSAGFLLIFGAVNASNACLYQKTASYRWISITGIIVCSIALFTLIWYTLNNSPKDIFILAFMLCSAFAIEAIYRRFTGRYIKKIHE

SEQ ID NO: 19498 - protein, 289 aa, Helianthus annuus
  misc_feature (146)..(146): Xaa can be any naturally occurring amino acid
  unsure (1)..(289): unsure at all Xaa locations
MEHQKAVSTKSMTKILKYLPRATSSLSFQNPPLYSPVKDKKPSEKPHKSNLGIGFSGPILSTLPSDTHRKINNDSKLTLLHEPTSPRVSCVGTVKCKHYRKLTNKPTNKFSRTTSYTPVRTYKTEEDQEKVMKVDPVVVKSKKKCXIRSLFSGGRISAMQSMRSQRWRLTGQKGPCLSTMKRFSSGRDAFMSFDWATQVAPLDSGESDGEEAVMPGSAPVVVRNKGVGDDFVRVAGVKLEPKEINLWKRRSMAQPQPLQVHAINSLFFGKIFDYVGDFSSIFDDLIRKY

SEQ ID NO: 19499 - protein, 465 aa, Silicibacter pomeroyi DSS-3
MDGTFNENDLSRVVEADRAHIWHHLIQHKPFETNDPRIIVEGKGMRVWDQNGKEHLDAVSGGVWTVNVGYGRESICKAVYDQLMKLCYFANSAGSIPGALYAEKLISKMPGMSRVYYTNSGSEANEKAFKMVRQIAHKKYGGKKTKILYRDRDYHGSTLAAMSAGGQDERNAQYGPFAPDFVKVPHCMEYRKEELGLGHLSGAEFGRAAADLIEEVILREGPETVGALCLEPVTAGGGVITPPEGYWERVQEICKQYDVLLHIDEVVCGIGRTGTWFGYQQYGIKPDFVTMAKGVASGYAAIACMVTTEEVFDLFKDNTDDPLNYFRDISTFGGCTAGPAAALENMRIIEDEDLLGNCTAMGERMLGNLHALMEKHAVIGDVRGKGLFLGAELVANRETKEPVSEKQAQAVVADCMAQGVIIGVTNRSIPGRNNTLCFSPALIATAEDIDAITDAVDQALTRVFG

SEQ ID NO: 19500 - protein, 491 aa, Bacillus cereus ATCC 14579
MLNMNSATNQATSKTETTQGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFTLCIIVILGQNYGAFMGESIDWNGVLVSYIGLPLFLVLWLGYKFTKKTKVIPLDKCELK

SEQ ID NO: 19501 - protein, 865 aa, Magnaporthe grisea 70-15
MDRSRTLNIGSASRSNQLSPSLNDHQSFYDESDELDFFVDEPQDDGILGDDPLTDDLASSSRRNQKGSASQTTRYLSSLTSGPGEGASRLSPGLTPGDYTARSGTPIGGLRSPRSPGRFNGSSKDGGQDWYVEGPGRRVGYADLTAIDWIFEYTKERQRLRVLYSQASGVLGYIPQLLDASQVWIILVATGMAVGTVAAAIDITTDWMGDLKTGYCSTGSDGGAFYLNKGFCCFGYDEWSKCVGWRPWAAALGIASAGGKWIIEYFFFILFSVTFALCAHILVREYSMHAKHSGIPEIKTVLGGFVIRRLLGVWTLVTKSLGLCLAVASGMWLGKEGPLVHVACCCANIATKPFKNIRENEARKREVLSAAAASGISVAFGSPIGGVLFSLEALDPFRSGKLVMYQVKYSTGFHAFEMVPFALLGILGGIYGGLFIKLNMKVAQWKKQNHWLPGPTTQVAVVALLTALVNYPNLYMRAQNSELVSSLFMECSRVLDDQFGLCKTGAASVGTIVLLLFASLLGFLLAAITFGLQIPAGIILPSMAIGALTGRAVGIAVEIWQQSYPGFLPFSTCEPDVPCVIPGTYAIMGAAATLAGVTRMTVSIVVIMFELTGALTYVLPIMVAVMLSKWVGDAFSRRGIYESWIHFSEYPYLDNSEEMVIPDIPASQIMTRIEDLVVLTAVGHTIGSLQHILDTHQYRGFPVISDPREAVLLGYISRAELAYNLHTFTQPPQSLPPETEAFFSHQPMADPRTTLDLRPWMDQTPITLSSRSNLHLTVTYFQKLGLRYLLFTDRGVLQGLLTKKDVWYVLNGAEETRRTSGLARDAGLETGITREDGDGESRGLLRDDGGEEPTSPGADRRDSIL

SEQ ID NO: 19502 - protein, 970 aa, Crocosphaera watsonii WH 8501
MKQPLTSTELRIEELFPFELDPFQQEAIAALHQGESVVVCAPTGSGKTVIGEFAIYRALHLGQRVFYTTPLKALSNQKFRDFQDKFATTEAGVVEGMVGLITGDTVINADASIVVMTTEIFRNMLYETPIGQVGTSLENVATVILDECHYISNRGRGTVWEESIIYCSPSIQLVALSATIGNSEDLTKWINQVRKTAPNFDPDKTSISLCKLINSDFRPVPLRFYFSQKNGLYPLLNQQQTGLNNRLKPKGNRKKRRRVKRSECPTPMMVIQQLYEKDLLPAIYVIFSRRECDRAVQKLEGVVLVSPEEAHALQYNLLTFFLGENTNLQVSLLEAVATENPPLYEPLKDFLSTLSPQSNLFTYLGEDEESKVHLFEILANLCQLVRSEQLEPLTRGIAAHHAGILPLWKELVEQLFEVGLVKVVFATATLSAGINMPARTTVISALSKRIDTGHSMLNPSEFLQIAGRAGRRGMDEVGHVVTIQTPFEGATEAAYLATAESEPLKSCFTPSYGMVLNLLQKHSLREAKDLLERSFAEYLAQLKLEPEQQAIASLSTELAKLDIELGGLQEKDILAYEKLKARLKEEKRLLKVLEAQAQEKRKKEIAGQLSKLNIGDLVYLKGKRLKTSIPQLATIVAMVPGSGQGFDLLCLGDNNYWYLVKRGDIVDFYGASLPLSFADNLTLPDLRRLSLGRGPKGDENSRQITQQMSDRAFGRITPPEVIEQQQRIDHVQTLLDDHPLTQSKDFKRLFKSHHRRLELREQLHNRQIKFQKLQSNQSYYWQEFLNLIEILREFKALDNYTPTALGEAAATMRGENQLWLGMVLMSSTLEHLEAPQLAAAVSAIITETLRPDTWTNYLPSPEVLSLFQESPEDGVSIGEMRRLLNQTQRRYQVTIPVWLELELMGLVEQWALGGDWQELCENTSLDEGDLVRLLRRTVDILWQIPQTPGISGYLITTAKEAIALLKRFPI

SEQ ID NO: 19503 - protein, 194 aa, Magnaporthe grisea 70-15
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQVDLRDDPSVREKLSKQKMQPVRREDGERMAKELGAVKYVECSALTQYKLKDVFDEAIVAALEPPTPKRKSKKCLIL

SEQ ID NO: 19504 - protein, 393 aa, Pediococcus pentosaceus ATCC 25745
MPELDSALQNQTRPALSAISRSAIRQFDQQVSDIPGILKLTLGEPDLNTPEHVKQVLINAITNNASHYAPSAGLLRLRQAVSKYLLNSTNIRYNPASEILITIGATEAIFATMQTILSVGDEVIIPTPTFPLYMAIAKAIDATVIEIDTSDTDFVLTADALKQALQAHPNAKMLVLNYPTNPTGATYSKSKLTELAQVIQNSKLFVLADEIYGELSYDNKHYSIAELLPSRTILINGISKSYAMTGYRIGFLAAPATLTSNILKLHGFMVTTAPTSIMEGAIEALLHGQDDVAKMCEQYRLRRDYLVKELNQLNFQVRSPAGTFYLFAKIPINLIQNSNQLALQIAHQAKLAVIPGKVFGAGGEGYLRFSYAASMSNLHEAVRRLTKFVQEEK

SEQ ID NO: 19505 - protein, 372 aa, Cryptococcus neoformans var. neoformans JEC21
MTTPKIQREYLFKDDPRQPEVHCSTIQAACGVEYVTWFGGTKEGTSDVKIWFSKCTNGCWTPPRVIAGSGDIVHWNPVSFLPDPKGAPGHLYVFYKTGTPIPTWKTYVIETIDGGNTWTEPRELVPGDHSGGRGPQKNPPIVLSNGDWLSGASKEVTLEGGKGLWDAFADIAPTPKEGDTFKQGERWVKAEFIKLPADRGVEGGSFPGEGIIQPSLWESADKPGHVHMMCRSSIGRIVRADSEDYGRTWTPGYATDLPNNNSGQCVTRLRDGRLVAAVNDVYKNWGPRTPLVLKVSFDDGETWSPWCTLEDQAPPASFQRVIALETGIVNDGKSEFSYPTVTPTAETDEIGVWVSYTWQRRGIAVCKVTDGE

SEQ ID NO: 19506 - protein, 299 aa, Pediococcus pentosaceus ATCC 25745
MLENVDLISAIITPFDDQLKINFTALERLTNHLIETGNTGFIIGGTTGETPTLTHAEKLGLYTRFAEIVAGRVPIIAGTGSNNTQATIDFTKEVRQIDGIIAALVVTPYYNKPNQRGMVAHFKTVARQADFPIMMYNIPGRTGVQMENATIVELSQEPNIIGIKQCTNLNDIGFLVENTPNDFAVYTGNDPETLGAVALGANGVASVASHIYGYQIRALLDAVKHGDLLKAGKLQRELTPKMEALFLYPSPAPVKAVLNAQNWSVGSPRLPILPLNQKEKLNLAHQLGVNHLADVQLHY

SEQ ID NO: 19507 - protein, 602 aa, Physcomitrella patens
MQGAMQTKMWRGELISTSTHFIGGTRLQPKLNQDARKPTKSENCIVRVSMEREVKAKAAVSPPAVAADRLTPRVQERDGYYVLKEEFRQGINPQEKIKLGKEPMKFFIENEIEELAKTPFAELDSSKPGKDDIDVRLKWLGLFHRRKHQYGRFMMRFKLPNGITNSTQTRFLAETISKYGKEGCADLTTRQNWQIRGIMLEDVPSLLKGLESVGLSSLQSGMDNVRNAVGNPLAGIDPDEIVDTIPICQALNDYIINRGKGNTEITNLPRKWNVCVVGTHDLFEHPHINDLAYVPATKNGVFGFNILVGGFFSSKRCAEAIPMDAWVPTDDVVPLCKAILETYRDLGTRGNRQKTRMMWLIDEMGVEEFRAEVERRMPSGTIRRAGQDLIDPSWKRRSFFGVNPQKQAGLNYVGLHVPVGRLHAPEMFELARIADEYGNGEIRITVEQNLILPNIPTEKIDKLMQEPLLQKYSPNPTPLLANLVACTGSQFCGQAIAETKALSLQLTQQLEDTMETTRPIRLHFTGCPNTCAQIQVADIGFMGTMARDENRKPVEGFDIYLGGRIGSDSHLGELVVPGVPATKLLPVVQELMIQHFGAKRKP

SEQ ID NO: 19508 - protein, 629 aa, Thermotoga maritima MSB8
MKFYITTPIYYVNSEPHIGSAYTTIVADIIARYKRFMGYDVFFLTGTDEHGQKVLQAAQQAGKDPQEFCDELAEKFKRLWKELKITNDYFIRTTDEMHMKTVQEFVAKMKENGDVYKGIYKGWYCVPCETFWNEDEVIKEGEERFCPECKRPVKWVEEENYFFRLSKYRDSLLKYYEEHPDFVEPDFRRNEMLKILEGGLKDLSITRTTFKWGVPMKDDPEHVIYVWVDALINYISAIGYGWNDEMFNKWWPADLHLIGKEINRFHSIIWPAMLMSVGLPLPKKVFAHGWLTVNGQKISKSLGNAIDPRFFVKRYGNDVVRYYLIRDIMFGKDGDFSEERLVHRLNSDLANDYGNLLHRITAMIKKYFNGRLPSPSAQEGFDSWLKERFFETKDAYHELMDSYRLTEALDKIWEFIADVNKYFNDTKPWILGKEGNMERLGTVLYNSLEAVFKVALMTLPVMPDTSEEVFRRVSFEEKPSKEHLENWGVLKPGSTVIHGEPLFKKIDAKDFKKVVETVSAEQNAITIDDFSKVDLRIAKVLEAEKVPNSRKLLRLIIDLGTEKRQIVAGIAEHYRPEELVGKLIVVVANLKPAKLMGIESQGMLLAAKSGDTLRLLTVDGEITPGAKVS

SEQ ID NO: 19509 - protein, 503 aa, Triticum aestivum
  misc_feature (472)..(472): Xaa can be any naturally occurring amino acid
  unsure (1)..(503): unsure at all Xaa locations
NKFVQKSRLVPVRNSRDIVDPRVRAPEKWRLVKAHGTAVGLPSDDDVGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTXLQPVPVAIGGPGLHPGVRFRSDIQTPRPRPR

SEQ ID NO: 19510 - protein, 285 aa, Streptococcus suis 89/1591
MTHFSVGEEAAAVGPIAGLTDEDIIFSHHRGHGHVIAKGIDINGMMAELAGKATGTSKGRGGSMHLANVEKGNFGSNGIVGGGYALAVGAALTQQYLGTDNIVIAFSGDSATNEGSFHESMNLAAVWNLPVIFFITNNRYGISTDISYSTKIPHLYQRAAAYGIPGHYVEDGNDVIAVYEKMQEVIEYVRAGNGPAMVEVESYRWFGHSTADAGVYRTKEEVNEWKAKDPLKKYRKYLTENKIATDEELDAIEAQVAEQVEASVKFAQESPDPDISVAYEDVFVD

SEQ ID NO: 19511 - protein, 143 aa, Salmonella enterica subsp. enterica serovar Typhi str. CT18
MAIERTFSIIKPNAVAKNVIGSIFARFEAAGFKIVGTKMLHLTVEQARGFYAEHDGKPFFDGLVEFMTSGPIVVSVLESENAVQRHRDLLGATNPANALAGTLRADYADSLTENGTHGSDSLESAQREIAFFFGEGEVCPRTR

SEQ ID NO: 19512 - protein, 331 aa, Streptococcus suis 89/1591
MAETKVMALREAINLAQSEEMRKDEKVFLMGEDVGIYGGDFGTSVGMLDEFGPKRVRDTPISEAAIAGSAVGAAQTGLRPIVDLTFMDFVTIALDAIVNQAAKTNYMFGGGLKTPVTFRVASGSGIGSAAQHSQSLEAWLTHIPGIKVVAPGTANDAKGLLKSSILDNNPVIFLEPKALYGKKEEVNLDSDFYIPLGKGEIKREGTDVTIISYGRMLERALKAAEEVAAEGISVEVVDPRTLIPLDKELIIESVKKTGKVILVNDAYKTGGFIGEIASIITESEAFDYLDAPIIRIASDDVPVPYANILENAVLPNVEKIKAAIYKQVNKG

SEQ ID NO: 19513 - protein, 462 aa, Streptococcus suis 89/1591
MAIEIIMPKLGVDMQEGEIIEWKKQEGDFVNEGDVILEMMSDKTSMELEAEESGVLLKIVHGNGATVPVTEVIAYIGAEGETVEAGASSAPAVEPAAAIEEVPAGRTPVIVAPATAAKPQGSGKVRATPAARKLARELGIDLGLVPGTGANGRVHKVDVEDFKGAAPKATPLAARIAADQGVDLSTLTGSGVNGKIVKNDVLAVLAPVAVETAAPVPKAEEKPAKELPEGVEIIKMSPMRKAISKGMVNSYLTAPTFTLNYDIDMTNLMALRKQVLEPIMNKTGLKVTFTDLIGLAVVRTLMKEEHRYMNASLINDAQEIELHKFVNLGIAVGLDDGLVVPVVHGADKMSLSDFVVASKDVIKKAQSGKLKGAEMSGSTFSITNLGMFGTKTFNPIINQPNSAILGVASTVQTPVVIDGEIKIRPIMALCLTIDHRIIDGMNGAKFMVDLKNLLENPLELLI

SEQ ID NO: 19514 - protein, 586 aa, Streptococcus suis 89/1591
MAIEIIMPKLGVDMQEGEIIEWKKQEGDFVNEGDVILEMMSDKTSMELEAEESGVLLKIVHGNGATVPVTEVIAYLGAEGESVEVGSAPAPAEVAQATADLKAAGLEVPAAPAAAPQAPKAELAADEYDMVVVGGGPAGYYAAIRGAQLGGKIAIVEKSEFGGTCLNKGCIPTKTYLKNAEILDGLKIAAERGINLASTNYTVDMDKTVDFKNKVVKTLTGGVQGLLKANKVTIFNGLGQVNPDKTVVIGDKVIKGRSIILATGSKVSRINIPGIDSKLVLTSDDILDLREIPKSLTVMGGGVVGVELGLVYASYGTEVTVVEMADRIIPGMDREVSVELQKVLSKKGMKFLTSVGVSEIVEANNQLTIKLNDGSEIISEKALLSIGRVPQLAGLENLHLELDRGRIKVNAYQETSIPGIYAPGDVNGTKMLAHAAYRMGEVAAENAIHGNHHKAKLDFTPAAVYTHPEIAMVGLTEDQAIEKYGKENILIGRNSFTGNGRAIASNEAHGFVKVIAEKKYHEILGVHIIGPVAAEMINEAATIMESELTVDDVAASIHGHPTFSEVMYEAFLDVLGVAIHNPPKRK

SEQ ID NO: 19515 - protein, 99 aa, Glycine max
  misc_feature (51)..(51): Xaa can be any naturally occurring amino acid
  unsure (1)..(99): unsure at all Xaa locations
ASSMISSPAVTTVNLAGAGMVAPFTGLKSLAGLPTKKTYYDITSLAYTGGXLHCMHVWPPVGRKKFDTLFYLPDLDYAQLAYVLKYLLANGWIPCYEFE

SEQ ID NO: 19516 - protein, 423 aa, Rhodococcus sp. RHA1
MTTTTDVISIDAGPLDDALAQLTGAVEKLGYGPGMHQLLAKPRREMSVSIPLRRDNGDVEVLSGYRVQHNFSRGPAKGGLRFSPHVSLDEVRALAMWMTWKCALLDVPYGGAKGGITIDPTQYSMGELSRVTRRYTSEILPIIGPEKDIPAPDIGTDEQTMAWMMDTFSANVGYTVPSVVTGKPVSLGGSLGRSSATSKGVVHVALAALEYRGLTPSFATAAVQGFGKVGAGSAQFLAEAGVKVVAVGDQYGSIHNGNGLDIPALQAHVAATGTVRGFADSEPIDAAALLELEVDLLVPAAVEGVINSDNASNIRASIVVEGANGPTTAAADKILAARNVLVVPDILANAGGVIVSYFEWVQGNQAYWWTANEVDERLETRMIQGWRCVLETSIRRGLSLREAATVTAVERVADAHLTRGLYP

SEQ ID NO: 19517 - protein, 424 aa, Rhodococcus sp. RHA1
MANLSPALKQATPVVVDHALGSWIYGTDGVDYLDFTTGIGVTSTGHCHPKVVEAAREQVGKIIHAQYTTVMHKPLLALTDKLGEVLPTGLDSVFYANSGSEAVEAAIRLARMATGRPNIVVFQGGFHGRTVAAASLTTAGTKFSAGFSPLMSGVHMAPFPYAYRYGLDEEAAVEFALRELDYLFKTRTAPNDTAAFLIEPALGDGGYLPTPPAFMEGLRERADQFGIKLIFDEVQAGVGRTGKFWGHQHSTATPDILITAKGIASGFPISAIAASTETMSKAWPGSQGGTYGGNAVAAAAGVATLQVVEEEGLVENAHVRGEQLQAGLKSVQERFPIIGDVRGLGLMQGIEFTTADGTPDADTAAAVQQETTRQQLLTLTCGPAGNVVRLIPALVVTEDEITLGVERFEAAVAAVVGAVAVGAS

SEQ ID NO: 19518 - protein, 131 aa, Bordetella pertussis Tohama I
MPASTAPARYLAPDTLARPGGHYSHACVANGMVYVSGQLPIGPDGTKLADAPFEAQARQVLDNVAAALAAAGSGIDRLVQVRVYVDSVENWPAFDAIYAEWAGAARPARAVVPTGPLHYGFKVEVEAVALA

SEQ ID NO: 19519 - protein, 252 aa, Gnetum parvifolium
MGRGRVQLRRIENKINRQVTFSKRRNGLLKKAYELSVLCDAEVALIIFSTRGKLYEFASSSMSKTLERYEKCSYSMQENASTDRDAQNWHHEVTKLKAKLESLHKAQRNLMGEDLGPLNIKELQSLEQQLEVALGHVRNRKTQLLIQTIDELRDKERTLQEVNKSLQKKLSETEGRNVIPALPHATTGSGEWESSTLTTTYALQTQQPSGIHHVDCEPTLHIGPYHQAVHHEAIPGPPATHSEPHNQYIWWV

SEQ ID NO: 19520 - protein, 509 aa, Robiginitalea biformata HTCC2501
MQNNVLILDFGSQYTQLIARRVRELNIFCEIKPYNNLPGDLDGYKAVILSGSPFSTRSDDAPHPDLSRIKGHKPILAICYGAQYIAHFNGGNVAPSKTREYGRAKLAHVAQDPFLKDVPVGSQVWMSHSDTIQQLPDGAVLLASTHDVPNAAFKMPDERIYGIQFHPEVYHTTAGSLILRNFLVDIAGLEQTWTPAAFVETTVAELKEKIGTEKVILGLSGGVDSTVAAMLLHRAIGKHLHCIFVNNGLLRKNEFEEVLHQYKDMGLNIKGVDASARFLDALEGESDPEKKRKIIGRVFIEVFDDEAHLVEDAKWLGQGTIYPDVIESVSATGGPSATIKSHHNVGGLPDFMKLKVVEPLKMLFKDEVRRVGASLDIPAERLGRHPFPGPGLAIRILGDITREKVAILQEVDHIFINGLREWGLYDKIWQAGAMLLPVNSVGVMGDERTYEKCVALRAVESTDGMTADWVNLPYEFLQKTSNDIINKVPGVNRVVYDISSKPPATIEWE

SEQ ID NO: 19521 - protein, 245 aa, Bacillus cereus ATCC 14579
MIFVQQFEEVRSILEKAKKITVLTGAGASTESGIPDFRSANGLYADANVEMYLSRGYYNRSPKEFWKHYKEIFQINTFHQYKPNRGHRFLAELEEQGKDITILTQNIDGLHQLGGSKHVIDLHGTLQTAHCPKCKSGYDLQYMIDHEVPRCEKCNFILNPDVVLYGDTLPQYQNAIKRLYETDVLIVMGTSLKVQPVASFPQIAKREVGATTILVNEELTGQEYNFDFVFQNKIGEFVEGLSSMK

SEQ ID NO: 19522 - protein, 475 aa, Streptococcus agalactiae
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGQRIGKLAGMRPIMLELGGKDAGIVLADADLDNAAKQIVAGAYDYSGQRCTAIKRVLVVEEVADELAEKISENVAKLSVGDPFDNATVTPVIDDNSADFIESLVVDARQKGAKELNEFKRDGRLLTPGLFDHVTLDMKLAWEEPFGPILPIIRVKDAEEAVAIANKSDFGLQSSVFTRDFQKAFDIANKLEVGTVHINNKTGRGPDNFPFLGLKGSGAGVQGIRYSIEAMTNVKSIVLDMK

SEQ ID NO: 19523 - protein, 362 aa, Synechococcus sp. WH 5701
MIFAAPSPQAVPLLGLGLGELEAWAVSQGQPAFRGRQLHDWIYAKGARRLADISVLPKAWRESLTAEADPAGSDALGRSRELQRSVASDGTTKLLLGTADGLSLETVGIPSRDRLTVCVSSQVGCPMACRFCATGKGGLQRSLAVHEIVDQVLCVREVMERRPSHVVFMGMGEPLLTIDSVLGAIHCLCTDLGMAQRQITVSTVGVPSTLPSLAELALERLGRAQFTLAVSLHAPDQGLREQLIPTAHAYPLEALLDDCRRYVEITGRRVSFEYILLGGLNDHPRQAAALAALLRGFQSHVNLIPYNPIEEEDFQRPSPERVEAFRRALLERHVAVSVRASRGLDEDAACGQLRRRAAAASL

SEQ ID NO: 19524 - protein, 397 aa, Mesorhizobium sp. BNC1
MRALVWHGKHDVRVETVDDPKIVNPRDAIIKITSTAICGSDLHLYDGVIPAIRPGDILGHEFMGEVVEVGKGNSRLSKGDRVVVPFVIACGKCFFCQKQQYSACDNSNPAEKADMSEMLYGHHMAGLFGYSHLTGGYAGGQAEYVRVPYSDIGPIVVPDDLDDDEVLFLSDILPTGWMAAENCEIEEGDTVAVWGCGPVGLFAIQSALIMGAAQVIAIDHYPHRLELASRIGAKVINYKNSRVYEALMDMTGGIGPDAVIDAVGMESHGFAPDNLYDYAKQTLKLETDRPHVLRQAIYACRKGGRVSVPGVYGGFVDKFPVGAFMQKGLTLRTGQTHVQKYLSSLLDMIRERKIDTTFLISHRLSLEAGPEGYRKFAFEQNETTKVVLKPGWENANG

SEQ ID NO: 19525 - protein, 398 aa, Streptococcus agalactiae
MAKLTVKDVDLKVKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 19526 - protein, 608 aa, Mycobacterium avium subsp. paratuberculosis K-10
MKESFGCDGQPGSYTDVDHADVIALFGHNVAETQTVLWARMLDRLAGSDPPAIVCVDPRLTPVARHATVHLAPLPGTNVALMNGLLHEIIGNGWIDRDYIDAHTVGIDELQCRIGEFTPERVAEICGVAATDLRRAARLIGTARRLLSTVLQGFYQSHQASAAAVQVNNIHLVRGMLGRPGCGVLQMNGQPTAENTRECGADGDLAGFRNWSNDSHVAELAELWNLEPLQIPHYGPPTHAMQMFRFTEEGTLRMLWVTATNPAVSLPELPRIRDILSQQRLFLVVQDIFLTETAALADVVLPAAAWAEKTGTFTNADRTVHLSEKAVEPPGSARSDLEIFLDYARRMDFRDKDGRPFPPWTDPESAFEAWKKCSAGRPCDYTGLSYAKLRGGSGIQWPCNTDHPDGTERLYEDGRFPAAPDYCEAYGKDLITGAPLQPDEYRSLNPSGKAIIKAAQYLPPHERPGPDYPFALITGRTVYHFHTRTKTARAQQLQDAAPEVWVEVSERDARRLDIEAGDLVHVSTPRGRITCAARVGGIRDGVLFVPFHYGYWDRDGGDHQRAGNELTATDWDPASKQPSFKTAAARLDKAPSHRAAPVSEAVAAGSPS

SEQ ID NO: 19527 - protein, 438 aa, Streptococcus agalactiae
MAIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLDKCGR

SEQ ID NO: 19528 - protein, 1536 aa, Magnaporthe grisea 70-15
MSNSIKQAAEAVRSRTSEVMGGAGKGSGGETAAVANDFLHTPFMRAALPFLNGGAAGMVATTVIQPVDMIKVRLQLAGEGMAGGVKPTPLSVTRDILASGRALDLYTGLSAGLLRQAVYTTARLGFFDTFMGTLTAKAKENGSAIGFKERAAAGLSAGGLAAMIGNPADLALIRMQSDGLKPKESRQNYKSVIDALARITKNEGIAALWSGATPTVVRAMALNFGQLAFFSEAKAQLKSRTDLNPRVQTLTASAVAGFFASFFSLPFDFVKTRLQKQQRGPDGKLPYRNMIDCFGQVAKQEGALRFYRGFWTYYVRIAPHALLHSCMCRNLEMYANVQPVHEFAIKVDLRQTDISGRGHDLVERRIGQIGLNATCAYLRPRNFTTCSAQKRSSSKPPPLLSFLRRDSLLQGGTRPLTAPSKKKRDLRPASIHGQSRRAFTNMDADWGEGRVAAYVYFLNNGIMEFQRHIAFLSHPRQQGPVHQFLFNETGVISLGSHNVHMAQRGGMCLANIGHVNMTNLRCMTFTSRGTSEILVAGDQDTMFVIDLNKKQITKEVPAPNHYFLMKKSKYICAASRNGCVDILDPITLKVINTWNTRSAQLNDMDVQHDFIVTCGASLKQGTYMADPYVNVFDLKNMRSFPPISFPPLVTYARMHPKMVTTSIVVSKTGQMHVVDIANPHNPIVRQVLGHTHLALFDVSPSGQAMVFTDTEGYIHVWGPTSKAVSFVDQGLPVEFETEQPNFASIPWSEDFPVNMVGLPHYSDALLSAWPADLSSDVGAPPAQFDQAYVDAMMPNGNVGLYGKAVAGTRRNQVVDTRSADKPQSSLQAPKFLSEKARDGFKGLTMDTSDIETSEDIVPSPIRTDIESLKSVVPNMYHLFEIKFSKFGVDDFDFGYYNKTHHSGLENHITNSYANSLLQLLRFTPILRNLALQHAATSCLDQHCLLCELGYLCDSMEKARGASCQATNMLKMLSQHPAAANLHLLDGDRIASSSAMKIQGLLRFLLDFMSRDYGKTSPGINDLENATATSSQSLIRCDQCKSETSRPQTNYVQDLAYSPVTSNGNKGVDVADSYLAAQQGVARGRMAPAKLPSFSQILKKSIEREQVTRGWCTTCRGYQPLSMRKIIKSIPQVLAANTCISSVEEKKLWATPGWLPEEVGFIIDKEHIFCYEGAELDWLIKNGKYKLYVYSLMGLVVNIEPAAHSEPQKPAKSQWHLFNDFHVKPISAREALTFNTSWKTPLVVMFQLKAANNHIDSTWLQRLDTSILYQDQSPEAEDKSYTLLDRNKEAPTPGTVIAIDAEFVLAKDFEYAVNSDGEKETIRPRIHSLGRVSVVRASGDRRGVPFIDDYINIKEPIVNYFTEFSGLTETDLDPKTSRHNLVPLKLAFKKLWLLLNLGCIFVGHGLRSDFRVINLQVPREQVHDTQELFWVEAQRRKLSLAFLAKSVLNLEIQGHMHDSIEDANTAQLLYWKYKELLESGRLHEELKKIYAFGVKHGFRPVKVAGQSAQRTETPPMVDDAQPGALLPYQPPELLQGS

SEQ ID NO: 19529 - protein, 237 aa, Synechococcus sp. WH 5701
MAELQDRMKLAVATAAVDQIRDGMVLGLGSGSTAALMIRELGARLRRGELSAITGVTTSFQGEVLAAELGIPLQSLNAVSRIDLAIDGADEVDPAFQLIKGGGACHVQEKLVARRADRFVVVVDSSKLVKRLNLEFLLPVEVLPGAWRQVKAELEAMGATADLRMAVKKAGPVVTDQGNLVLDLKFAGGITDPAALEQAINNLPGVLENGLFVGLTDQVLVGEIVDGEPRVRDLERI

SEQ ID NO: 19530 - protein, 430 aa, Pediococcus pentosaceus ATCC 25745
MSLYTVNNVNQVTIGGLSATQLARQYGTPLQVFDVTMIRNQIQAFQKEFEDRGIRGIVSYASKAFSCKAIYQVVKQEHAHSDVVSGGEIATALAAGFPSTSLSFHGNNKSLAELNFAVQKGVGTIILDNFHELELLDQVLNENNTQIDVLLRVTPGVSAHTHSYIQTGQTDSKFGFDIDSGQALKAMRLSQNNPRIHLRGIHAHIGSQIFEVTGFKLEVKKLVNLLTNWSQKYQFTADILNIGGGFGIKYTHADDPLAPELLLGEILDELQVQYSKLGQPIPTIWIEPGRSIVGPAGFSLYTIGSRKDVPGLSPYVAVDGGMGDNIRPALYQADYEAVLAENPNQPPIETVRLAGKFCESGDILINHLPLPTTKTGDVLVMLATGAYGYSMASNYNRNPRPAVVFAENSQAQLVIQRETYADMIQNDLDY

SEQ ID NO: 19531 - protein, 467 aa, Bacillus halodurans C-125
MTTNNHRVAVIGGGMTGLAAAWALQKARKQMPIEYELIEASAQLGGKIQTDVTEGFVIERGPDSYLARKESMTRLAREVGLEGELVRNDTGQAYILKDDQLYPIPGGAIMGIPTEIGPFIRSRLFSSIGKLRAAQDLVIPSFTHENEDVSLGYFFRKRLGDEVVDQLIEPLLSGIYAGDLDTLSLQATFPQFQQLEAKYGSLIRGIKASKGKQSQSQVGKKQGMFLTFRRGLQSFIETIEQHLDEKAIRKKTEVRFCEREGKRYRLTFNDGTVQTYDHVILTTPPYVTGRLLEPYVDVDYMREMKATTVATVAMAFKSEDLHIPYEGTGFVVPRKSRYEITACTWTHKKWRHTTPEGHALVRCYVGKPGSESIVHETDEAIVEQVQKDLDQIMTVKREPLFYKVTRWKKAMPQYEVGHRYKLEKVRQELKKAMPGIILAGAGFDGIGLPDCIDQGEAAVATVLEEIL

SEQ ID NO: 19532 - protein, 1123 aa, Solanum tuberosum
MSSSRPSQSSATSSRSKHSARIIAQTSIDAKLHADFEESGDSFDYSSSVRVTSVAGDEERPKSDKVTTAYLHQIQKGKFIQPFGSLLALDEKTLKVIAFSENAPEMLTMVSHAVPSVGEHPVLGIGTDIRTIFTGPSGAALQKALGFGEVSLLNPVLVHCKNSGKPFYAIVHRVTGSLIIDFEPVKPYEVPMTAAGALQSYKLAAKAITRLQSLPSGSMERLCDTMVQEVFELTGYDRVMGYKFHDDDHGEVVSEITKPGLEPYLGLHYPATDIPQAARFLFMKNKVRMICDCRAKHVKVVQDEKLPFDLTLCGSTLRAPHYCHLQYMENMNSVASLVMAVVVNDGDEEGESSDSSQSQKRKRLWGLVVCHNTTPRFVPFPLRYACEFLAQVFAIHVNKELELENQFLEKNILRTQTLLCDMLMRDAPLGIVSQSPNIMDLVKCDGAALLYKNKIHRLGMNPSDFQLHDIVSWLCEYHTDSTGLSTDSLYDAGFPGALALGDAVCGMAAVRISDKDWLFWYRSHTAAEVRWGGAKHEPGEKDDGRKMHPRSSFKAFLEVVKTRSIPWKDYEMDAIHSLQLILRNAFKDADAVNSNTNSIHTKLNDLRIDGMQELEAVTAEMIRLIETASVPIFAVDVDGQVNGWNTKVAELTGLPVDEAIGKHLLTLVEDSSVDTVNKMLELALQGKEERNVEFEIKAHGPSRDSSPISLIVNACASKDVRDSVVGVCFIAQDITGQKSIMDKFTRIEGDYRAIIQNPHPLIPPIFGTDQFGWCSEWNSAMTKLTGWRRDDVMDKMLLGEVFGTQAACCRLKNQEAFVNFGVILNNAITGQESEKIPFGFFGRYGKYVECLLCVSKRLDKEGAVTGLFCFLQLASHELQQALHVQRLSEQTALKRLKVLAYIRRQIKNPLSGIIFSWKMLEGTSLGEEQKNILHTSAQCQRQLNKILDDTDLDSIIEGYLDLEMLEFKLHEVLVASISQVMMKSNGKNIMISNDMVEDLLNETLYGDSPRLQQVLANFLLVSVNSTPSGGQLSISGRLTKDRIGESVQLALLEFRIRHTGGGVPEELLSQMLGSEVDASEEGIFLLVSRKLVKLMNGEVQYLREAGRSTFIISVELAVATKSC

SEQ ID NO: 19533 - protein, 596 aa, Oryza sativa (japonica cultivar-group)
MLDTKYREEIDGSRRNVAFPWMHRSRLGLGGIAAAATAAGNGGATAGNVHRAAYIRKQRDHRSGLYRPWRGHHRKQVNLHDEEDREDAEVTGRHGLDQQSTGAMTTASAKCPRRKHKFWLLPDSGKDENGTETDGNHLYRFRFYIFFLNQKPRIRKRNQIYRNRNRTGANTEMIRCSQSQILSLSPKKSSLSLLPALHDCTQLLPMASVAATTFPSMARPAARGIVAGAAASTVPLPRAGVASPCPTARSLGFAARGTDPRLAIHVSSRRRAASASAGSRLARAVATMAKKSVGDLAAADLEGKRVLLRADLNVPLDASQNITDDTRVIAAIPTIKHLIGNGAKVILCSHLVQKADDVIGPEVEKSVSVLPNGSVLLLENVRFYKEEEKNDPEFAKKLASLADLYELDYLVGAVSNPKRPFAAIVGGSKVSSKIGVIESLLEKCDILLLGGGMIFTFYKAQGFPVGASLVEDDKLELATSLLAKAKEKGVSLMLPTDVIVADKFAPEANCQTVIWNGPMGVFEFEKFAVGTEAIAKKLAELSGKGVTTIIGGKDSVAAVEKVGVANVMSHISTGGGASLELLEGKELPGVVALDEA

SEQ ID NO: 19534 - protein, 370 aa, Erysipelothrix rhusiopathiae
MADKRDFYEILGVSKSATDAEIKKAYRQLAKKYHPDINKEDGAEAKFKEVQEAYEVLSDSQKRANYDQFGHAAFDQGAGGFGGGFSGGFDDFGDIFSSFFGGGGGGQRRNPNGPMKGQDRFMSMRIDFMEAVFGANKSVTLNVDEECTSCHGSGAHSKDDIKTCSRCGGTGQTVTQQRTPFGVFQSQATCPDCGGSGKTITKRCGECHGKGFNTKRVEVDIKIPAGIVTGQQLRVSGKGERGANGGPNGDLFIEIVVGTHKHFRREGNDIHINIPLSVIDATLGTEIEVPTVHGDVKLTIPAGTQPNTKFRLREKGVQDLRSGRMGDQYVEVKLEVPTKLSRQQREHLEALKETEVKGDSVFDRFKKAFK

SEQ ID NO: 19535 - protein, 705 aa, Burkholderia thailandensis
MTSESRRRFLHAVAQSAGAAAALTVFPESIRRALAIPAASRTGTIRDVEHIVVFMQENRSFDHYFGHLRGVRGYNDRFPITLPNGKPVWYQPSKANPGKPVLPFRLNTLTTSAQCIGDLDHSWYKTHAAIDGGRYDQWPANKTDMTMGYHVREDIPFHYALADAFTVCDNYFCSLPGPTHPNRSYLMTGTVDPTGKYGGPLLDNSDYVDGDAPPKYDLLTWTTYPERLEANGISWQIYQQGTTGADPLNGNYGTNILQNFANFIDAKPGSSLYRRAQTARTLDDLKADVLANRLPQVSWLLPPAAFSEHPKYTPAYGANYTSQILDALTSNPDVWRKTVLFIMYDENDGFFDHVVPPQPATTRAQGLSTVPVDGEIHDVVNPGRGGSYTADGLPYGLGPRVPMTVVSPWTKGGFVCSQVFDHTSVIRFIAARFGVDEPNITPWRRAVCGDLTSAFDFRTPDATLPPLPDTSNYRSIADQLCSTKPAPSVPAAPSPVDPQEPGVRPARALPYELHVNATVHGGARLRIEFANRGEQGAHFYVYASNRSDGPWRYTVGAHRSLHDEFDLAATNGAYAFAVYGPNGFVRVFEGLAAAGGHGRQAAARPEVKAGYDVANGNLYLKLANHGAQSVQLTLADNAYGAPARRITLRGRDEQIESWALASSHQWYDVTVSDGATGQFVRRFAGHVENGKPSYSDPAAIAPVTG

SEQ ID NO: 19536 - protein, 422 aa, Triticum aestivum
  misc_feature (279)..(279): Xaa can be any naturally occurring amino acid
  misc_feature (303)..(303): Xaa can be any naturally occurring amino acid
  unsure (1)..(422): unsure at all Xaa locations
MASSSSSPPARRSVFDAAYIRAEFDAAGISPTFIPTIWKYVLQNPRCSDLDGVPSLSAAAYALLRNKFRPTTSTLTAAAESKDRTTTKLLIRLQNGESVEAVIMRYDSRLGKYDGKTRPGGVRSTLCVSSQVGCKMGCRFCATGTMGFKSNLSSGEIVEQLVHATRYSQIRNIVFMGMGEPLNNYTALVEAIQVLTGFPFQISPKRVTVSTVGIIHSINKFTNDLPNINLAVSLHAPDQDIRCHIMPAARAFPLAKLMNALQRYQNASQQTIFIEYIMXLDGVNEQEEHAHKLGKLLENFKGXVTLIPFHPIGSGSPFKEKRAPELQRVSKGPERAFTGLNDRSPREMAKKIASALGAIGRFPSPHKELVGGWRLAWPTKDRQAGPPFCQISKISGSDLYPACCSIYHEKSNYITNQRHDLI

SEQ ID NO: 19537 - protein, 494 aa, Rhodococcus sp. RHA1
MTTATAFAPTTGTQAVPTGLLIDGTWQGAADGRTFEVENPATGEVLSVIADGGPADADAALAAAVAAQESWARTAPRARSEILRRAYDLVMARQDWLAEIMTSEMGKPLAEAKGEVAYAAEFLRWFSEEAVRIGGDHTTTGDGANRIIVTREPVGPCVLITPWNFPLAMGTRKIAPAVAAGCTMVLKPAAQTPLTSLALAAIMQEAGLPDGVLNVVNTTNAGSVVEPWMSSGKARKISFTGSTAVGKLLLKQAADAVMRSSMELGGNAPFIVCADADIDTAVDGAIAAKMRNMGEACTAANRLYVHRSIADVFSERLAARMADMQVGNGLDEGVQVGPLIDAAGRDKVQTLVDDALGRGAKALTGGAVPAGAGYFYPPTVLTDVSTDSDLMTTEIFGPVAPVVPFDDENEVIRIANDTDWGLVGYVFSQDIDRAFDLSERLEVGMVGVNTGIVSNPAAPFGGVKQSGLGREGGKLGIDEFLEYKYLAVPRRRGA

SEQ ID NO: 19538 - protein, 339 aa, Pisum sativum
MVQEKKLVDEVSGWLRIYDDGSVDRTWTGPPEVNFMIEPVAPHEEFIDGVATRDVTMSTTTNDNFIHRARLYLPEKTPTENEKLPILIHFHGGGFCITEPDCFMYYKVYTRFVKSTRSICVSPFLRRAPEHRLPAAIEDGFATLRWLQSVAKGDAHDPWLEKHGDFNRVFLIGDSSGGNLVHEVSARASSTDLRPVRLAGAIPIHPGYVRSERSRSENEMPQSPFLTLDMLDKFLSLSLPIGSNKDHPITCPMGEAAPPLAGFKLPPFLLCVAEKDLLRDPQMEYYEAMKKDNKEVDLFVSKNMTHSFYLNKIAVDMDPTVSAELNALMARVKDFIEKH

SEQ ID NO: 19539 - protein, 470 aa, Rhodococcus sp. RHA1
MRSARNDGEKNPQGTTAGRPGHTLHKGGLRQRHLTMIALGGIIGASLFVGSGSVIHTAGPAAVLSYALGGVLVIFVMRMLGEMATAKPTLGSFMEYAREALGERAGFIVGWLYWYFWVGVVAFEAVVGGKLLGGWFNAPDWVFALVLMFILTATNLLSARSFGETEFWLASIKVATIIVFLSVGALFVLGLWPGSQLSVANIGQHGFIVNGGFSILQGVVVVIFSYFGAEIVTMAAAESEQPAKAVAKATNTVLWRILLFYVGSVALLLMITPWTEIPSNSSPFAAAFDKFGLPAAGQIMNVVVLTAALSVLNSGLYTASRMLFALANRGWAPGWARDCNSRGVPWKAILLSTIVGYVAVAMNYVSPDQVFSFIMNSAGAVALFVYVIIALSQLSLRSRMTDDEKAALGLKMWLHPWLGIITVVGIVVIIFSMSLIESTRTQLWLSLISLGVLLVAYSITQRVRHRRARK

SEQ ID NO: 19540 - protein, 871 aa, Ostreococcus tauri
  misc_feature (680)..(686): Xaa can be any naturally occurring amino acid
  misc_feature (870)..(871): Xaa can be any naturally occurring amino acid
  unsure (1)..(871): unsure at all Xaa locations
MFRLVTQIMIRHTNVTKSEAPPSLSRFPGRTLRHEFTAEHFNCVAAPDERLFLKSMKIIIPACGKGERFRAAGYDVAKPLIKVCGQPMIDCVVQALHTNDALDEYVVIINFDANDINHPVIKLDRETAGAAETVLLALQAHESGDVPMLLVDCDAIYHGDILERFRALEAQNVVRAAVLSFREDASALSSKPKYSYVKVDEKSDVMQIAEKLRVGPLANTGAYWFASSAEFVRLARIVIEEGRFQHGEAYVSCVIDEYLRQNKTVRAVIINEDEYSNIGTPDCLEHYLSTQGRAFLFDLDGTLVDTTTAYVRAWHSLLAPKGAFVDTDFFNTHISGLADGQVIEKFKVTISSEQKDEEFLKHLACVETIAGSADFVRKCQDIGPVYVVTNSNRRAAEALLDCIDLGDIPLLTASDVKHGKPNPEPYAKAMRRLGVSPRNCVVFEDSKSGTTSARAAGVGFVIAISNNVSGCDAFYENYADIEPNEIIQHLESVAQLSDELTEMFGQRSIVHPVRASGGYISEVLSASCGARKLVVKQENSDHGVLQDVSEQLALHMTECEFYRTFSSVAPVRIPTYYGVLSDSKAIVMEDLRKYNRAPEFTLVSGLKVVQAIATLHSHFQGMNLGKLSEHSAYMKQHVHRNYQRFKARWSGTLSGETMELFDHAAKFYEDAEAQLLRKPXXXXXXXIIPIMLKFAADKSWRVRYAVAQQIYEMCEVVGAEHAATGLFDAFISLLADTEGEVRISAAGKISEFCALAGPEYASEKILPQVNKLATDQSQHVRAALAAAILGLAPTMGRELTVEKLLPVFFILLKDEFPDVRLNIISKLDQVNTVIGVEMLAKELLPAIKELAEDKHWRVRLAIIEYIPVFXX

SEQ ID NO: 19541 - protein, 147 aa, Triticum aestivum
MASKGLVVFAVLLAAAFLVATAEQTQAKKEETKAGVQGYHGGGGGGGGYHGGGGGGGYPGHGGGGGGGYPGHGGGGGGGYPGHGGGGGGGYPGHGGGGGGGYPGHGGGGGGGSGCRYQCCGHGRGGCRCCASPNEIPEPMYRAEVRN

SEQ ID NO: 19542 - protein, 156 aa, Brassica napus
KSTSSTVFRTNIPPSFPFLGNVNPNIVAVLDVKSFSYLFDMDFVDKRDVLIGDFRPSLDFYGGIRVGVYLDTTEPKHAKVKSFAMEILKRSSEVWLRELLSNLDTFWETVESDISKNDDGASYLIGLQRCIFNFLSTALTGANPSVSPDIAENGWK

SEQ ID NO: 19543 - protein, 328 aa, Vibrio vulnificus YJ016
MSRGFVAVIIAAITLRRHPMNHINRVAIIGECMVELKKVNGELQQGFGGDTLNTAVYLSRLTQQSGVSTSYVTGLGQDPFSREMLAAWQDEGINTDMVYLSQDKLPGIYAIETADNGERSFFYWRNDSAAKYWLRDRAILTLAKELCQHQMIYLSGISLAILSQDCREALIKLLALCRSDGVKIAFDNNFRPALWSNVADAQAFYQQILQVTDMAFLTFDDEMLLWGDTHEDQAIERTKGFGVSEIVIKRGGDECFVVTEAGRHAVAPLKIDHVVDTTAAGDSFSAGYLAKRILGGDCQQAAVAGHTVAGHVIQHRGAIIPREAMPTI

SEQ ID NO: 19544 - protein, 424 aa, Magnetospirillum magnetotacticum MS-1
MNHFHYSNGTLFAEDVAIARIAREVGTPFYCYSTATLERHYTVFAEALKSAGLDATICFAAKANPNMAVIRTFAQLGAGADVVSEGELRQALAAGVPAARIVFSGVGKTRHELEFAVAKGIFQINVESEPELEMLSEVAAARGLVMPIAIRVNPDVDAGTHAKITTGKKENKFGIEWTRAREVYARAKALPGVEPVSIACHIGSQLTELDPFREAFLRVRDLVAMLRADGIDIRRLDLGGGLGVPYDDETPPEPKAYAEVIKASLGDLGCRFIFEPGRLLVGNAGILVSSIIRVKEGSTRTFLIVDAAMNDLARPSLYDAYHSIFPVAEPKAGAPLAEVDVVGPVCETGDTFARQRRLPPMRAGDLLALGTAGAYGAAMSSTYNTRPLIPEVLVKGADYAVIRARPSYEDMRSLESLPGWLSDD

SEQ ID NO: 19545 - protein, 195 aa, Sulfitobacter sp. EE-36
MRQTTINRSTAETEISVEINLDGTGSYANHTGIGFFDHMLDQLARHSLIDMKISANGDLHIDDHHTVEDVGITLGQALSTALGDKRGIRRYGACLLPMDDALVRTALDLSARPFLIWNVDLPTAKIGNFDSELVREFFQALSTHGGITLHIDMLHGLNSHHIAEAVFKSVARALREAVETDPRKSSDIPSTKGAL

SEQ ID NO: 19546 - protein, 297 aa, Pediococcus pentosaceus ATCC 25745
MSKPDLKDPRKLYHTEEFPKQQQDTPALQSEMRPKPDCGEETYEGHGLLLDRKALVTGGDSGIGRATAIAFAREGADVAIQYFPGEDSDAKEVAEYIEKAGRKAVLLPYDFRDEKAPQEVVDRVVEELGGLDTMVLNAGQQIAHKKIDDLPVQQIRDSFEVNVVAMLALVKAAKPHIPAGGAIVTTTSVQAFNPSSQLLDYAATKAAIANFTINLAQQLIEDGIRVNGVAPGPIWTPIQLDHGQPEEAIPEFGQKSLMGRAGQPAELAPTYVLLASNLASYTTAQIYGVTGGEHINL

SEQ ID NO: 19547 - protein, 289 aa, Zea mays
MNVKGGSRIPVPPPGASALVKVAVFGGAAVYAAVNSLYNVEGGHRAIVFNRIQGIKDKVYPEGTHFMIPWFERPIIYDVRARPNLVESTSGSRDLQMVKIGLRVLTRPMPERLPHIYRTLGENFNERVLPSIIHETLKAVVAQYNASQLITQRETVSREIRKILTERARFFNIALDDVSITSLSFGKEFTHAIEAKQVAAQEAERAKFIVEKAEQDKRSAIIRAQGEAKSAELIGQAIANNPAFLALRQIEAAREISHTISASANKVFLDSNDLLLNLQQLNVSSKQKK

SEQ ID NO: 19548 - protein, 420 aa, Oryza sativa (indica cultivar-group)
MGASGKWIKSLVSLKAEPEGTTKGRRWTRLWRSSSSASASASTAGDASESASSEADAFSSVVAAVVRAPPRDFRVIRQEWAAVRVQAAFRAFLARRALKALRGIVRLQALVRGRLVRRQLAVTLKCMNALLRVQERARERRARCSADGRDSQDAVGERDGRADPIKQAEALILQLLPPFHNEQWCDSQGSVSEVRSKIHMRHDAVAKRERAIAYALSHQPRSSKQSARPSSPARSLRNHESNRCNHDWSYIEGWMATKPWESRLMEQSHAELKCSKNSGELNLAGAQLSNASSVKMRGNRVAAKPPSVLSASSSDFPCDVSSASTSSATPARSDGGHGEGPSYMSLTKSAKARQSCNSPFQIQRQRSGGMSSYKRVALSPLDVQSNACSEFSVTSRKLNSLSLKGRSMTRSLDKENDNLF

SEQ ID NO: 19549 - protein, 545 aa, Zea mays
PQPLAVVQLCYNQLTGSIPTQLGNLSRLTVLALQSNRLNGAIPASLGDLPLLARLDLSFNRLFGSIPVRLAQLPSLVALDVRNNSLTGSVPAELAAKLQAGFQYGNNSDLCGAGLPALRPCTPADLIDPDRPQPFSAGIAPQVRPSDGRAPSTRALAAVVVVAVALLAATGVGLLALSWRRWRRQRVAGGSPSTVSGGRCSTEAAPSAAKASSARKSASSALASLEYSNAWDPLADARGGLGLFSQDALAQSLRISTEEVESATRYFSELNLLGRRGKKAGGLAGTYRGTLRDGTSVAVKRLGKTCCRQEEADFLSGLRLLAELRHDNVVALRGFCCSRARGECFLVYDFVPNGSLSQFLDVDADNAGGGSGRVLQWSTRISIIKGIAKGIEYLHSTRTNKPALVHQNISADKVLLDYAYRPLISGCGLHKLLVDDLVFSTLKASAAMGYLAPEYTTVGRFSEKSDVYAFGVIVFQVLTGKSKVTTTHAQLPDNDVDELVDGNLQGDNYSAAEAAQLAKIGSACTSENPDQRPTMAELLQELSTV

SEQ ID NO: 19550 - protein, 73 aa, Escherichia coli
CGERFAYVDILQNPDIRAELPKYANWPTFPQLWVDGELVGGCDIVIEMYQRGELQQLIKETAAKYKSEEPDAE

SEQ ID NO: 19551 - protein, 452 aa, Arabidopsis thaliana
  misc_feature (334)..(334): Xaa can be any naturally occurring amino acid
  unsure (1)..(452): unsure at all Xaa locations
MAKSFEKPKFSLRLLIDEEKNRVILAEAGKDFVDVLCSLLTLPMGTIVRLLEKHQNPQSSVVGCLHNLYKSVADMDVDNFESQACKHFLLHPRSAKGSHGRDLKLNIDDTEATKFFVCPNFVSTEACRKLFSNVSTMKCRCGSSMHREIPVEEQQADGVFPSCRTSFVITDDLKVALNSMGLVLNVLNDFGYSGFDKLQEMLIDVGFEEILTLLGCLFTSEAPLTDTFLRKHCMSRKRKMLTPLVQESSVAGAADNLLTLKVYVRKTDRAVLYAECREEFVDFLFTFLAIPIEFAWELSIDIGNMGCVGNLCRSVKDLSFEKQKAATESPEYEXLVTHYGHNMLCKKINKAVLSNGEIIAKFTSASASIGLVKGETNFIVSDDLMNIGDIEEQVISIGKAEATSLLRASLITTSALTNGLSNFLSKMDPDEVTQSTPKIQKSDKPNEAWQLL

SEQ ID NO: 19552 - protein, 409 aa, Rhodococcus sp. RHA1
MLPRNREFATETTTLPIVNWSVHQMARKTPQADVTHCITVIPGDGIGREVVPAAITVLDAVSAQYGFGLFWDEKNWGSGFYKRYRRMMPIDALDQIARTDAVLLGAVGDPDISDSETLWGMLIPIRRQFDQYVNLRPIRSLPGARSPWSSGADIDFVVVRENVEGEYSEVGGRSYRGTDHESAYQQAIFTRHGIGRLTHYACRLASQRRGRVTSATKSDGLIHTMTFWDEIVQEVAAQHPELQLNSAHIDALAASILTDPEQFDVIVASNLFGDILSGIAAAVVGSVGVSPSANLNPERRYPSMFEPVHGSAPDLVGRGIANPTGAIWAGSMMLEHLGHRQAAEAVVDALTAVIAAGTCTPDLGGTATTSDFTAAVVAELQDGRQSLIIAPSKRAAEFGRVCPRRFADT

SEQ ID NO: 19553 - protein, 348 aa, Pyrus communis
GTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPEGQVITIGAERFRCPEVLFQPSLIGMEAAGIHETTYNSIMKCDVDIRKDLYGNIVLSGGSTMFPGIADRMSREITALAPSSMKIKVVAPPERKYSVWIGGSTLASAQYIPTDVYFTT

SEQ ID NO: 19554 - protein, 322 aa, Spinacia oleracea
MAVVSTSLASQITNPNSAVSTQFSGLRRSFLKLENSVSTQSSFFQNVDSHLRLSSSSRRCPRGVVAMAGSGKFFVGGNWKCNGTKESITKLVSDLNSATLEADVDVVVAPPFVYIDQVKSSLTGRVEISAQNCWIGKGGAFTGEISVEQLKDLGCQWVILGHSERRHVIGEQNEFIGKKAAYALNQGVGVIACIGELLEEREAGKTFDVCYQQLKAFADALPSWDNVVVAYEPVWAIGTGKVASPDQAQEVHVAVRDWLKKNVSEEVASKTRIIYGGSVNGGNCAELAKQEDIDGFLVGGASLKGPEFATIVNSVTAKKVAA

SEQ ID NO: 19555 - protein, 250 aa, Gracilaria gracilis
NWKCNLSKADIAELVSAFNAAPPIDAAHVQVVVAPPAVYLDSTRQALRADFDTSAQNAWISKGGAFTGELDAAMVKDVGAEWVILGHSERRHIAQLKESDHTIAMKAAYALQHASLGVIYCIGELLEERESGQTIAVCERQLQALSDAISDWSDVVIAYEPVWAIGTGKVATPEQAEQVHEAVRAWLANNVSPQVAASTRILYGGSVSPANCESLAKQPNIDGFLVGGASMKPTFLEIVDSYKATLAEAV

SEQ ID NO: 19556 - protein, 195 aa, Lactuca sativa
IQVAAQNCWVKKGGAFTGEVSAEMLANLGVPWVILGHSERRALLNETNEFVGDKVAYALSQGLKVIACVGETLEQREAGTTMEVVAAQTKAIADKISSWDNVVLAYEPVWAIGTGKVASPAQAQEVHAGLRKWFCDNVSAEVSASTRIIYGGSVSGSNCKELGGQTDVDGFLVGGASLKPEFIDIIKAAEVKKSA

SEQ ID NO: 19557 - protein, 433 aa, Haemophilus influenzae R2846
MKSGDLNKYDLVKNTLVLVLAGGRGSRLHELTDKRAKPALYFGGNRRIIDFALSNCINSDLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDIEEDKKRFRISSTGKVILVTPKMLKKLEGHEIEEDGHLD

SEQ ID NO: 19558 - protein, 658 aa, Haemophilus influenzae R2846
MFKIYNNGNPIPMGYSQAVENNVQITNFALFSAAATGVELCLFAEQNQETRLPMVRTENMWHLAVTGVKTGTEYGFRIHGEFANPQKLILDPYAKAVNGKPDLTTEESRSWFLMNDHRDNAHIAPRAVIISEDFDWENDTSPNTPWAETIVYELHAKGFSQLNEKIPAALRGTYTGLAHPVNLAYLKELGVTAVELLPVNFHINEPNLQARGLQNYWGYNPLAMFAVEPKYAATNNPLAEFKAMVKAFHNAGIEVILDVVFNHSAESEQTYPTFSQRGIDDQTYYWRNDQGRYINWTGCGNMLNLSSDVGRKWVVDCLRYWVEQCHIDGFRFDLASVLGRNTPDFNSSAQLFTDIKNEPSLQNIKLIAEPWDIGHYGYQVGNFPSYFAEWNDRFRDDLCRFWLWKSGEIGAFAERFAGSSDLFKKNDRLPHTTLNFITAHDGFTLKDLVSYNQKHNEANGEENHDGRNENYSYNHGIEGSTENLAEPQKSAVENNRTFAQSGLLMSLLLANGTPMLLAGDEFGNTQYGNNNAYCQDNEITWLKWANFNEELFELTKQTIALRKQIGSLNRDQWWSDENVQWLNIAGEPMTVEDWQNQQTKALQVVLDNRWLLLINAKAEGQVFHLPNGKWKPQIGTHNVTLEEQAELSSMGFCMLNDE

SEQ ID NO: 19559 - protein, 64 aa, Ustilago maydis 521
MTKCIYCGFCQEACPVDAIVETQNTEYSTETREELLYNKEKLLANGDRAEAEIAANIYADHLQR

SEQ ID NO: 19560 - protein, 242 aa, Mycoplasma flocculare
MKKIIIGNWKMNKTVHETRDFIQKFDIFYSKNLGKIKDNLDFAIAPSFTSLALISTSKIDKLKVAAQNLSQFDSGAFTGEISAKMLQDLAVHYVIIGHSERREIFKEIGEDLTNKILQAQKYNLIPVFCVGESLSEFEANETEKVIIGQINEVKSVLNFEKAIIAYEPIWAIGTGKTATAQIAEQVCKLIKNNFGKNIRVIYGGSVNSKNINELLLQKNIDGALVGKASLDPEEFVKILANI

SEQ ID NO: 19561 - protein, 254 aa, Petunia x hybrida
MGRKFFVGGNWKCNGTAEEVKKILATLNAADVPSQDVVEVVVSPPYVFLPLVKNELRPDFHVAAQNCWVKKGGAFTGEVSAEMLVNLSIPWVILGHSERRALLGESNEFVGDKVAYALSQGLKVIACVGETLEERESGSTMDVVAAQTKAIADRVKDWTNVVVAYEPVWAIGTGKVASPAQAQEVHAELRKWLAANVSPEVAASTRIIYGGSVNGANCKELGGQPDVDGFLVGGASLKPEFIDIIKAAEVKRNA

SEQ ID NO: 19562 - protein, 630 aa, Mesorhizobium sp. BNC1
MQFDVAALGRIAVDLYGEQKGTSLEDTATFRRYVGGSSGNLAIGCARLGLKTAMISSTGEDPMGRYIRAELAKAGVDNTCVTANPQRRTALAFLGMQRADAIALDFYRDRAADMAVGFGDREAEKVRQSRLLALTGTHMSEPGTADALRKAVETAREAAGKVVLDIDFRKALWEQSPGGIEGVVSSINDLLDKINIVVGNEEEFLRLGGSNDIVEALKKVRGNTSALLVLKLGAEGSIAFAGEIPPRSEWRPVPGFKVYVLNVVGAGDAFLAGFLSLWLQGEPVNACLRRGNLNGALVVSRHACSDAMPFLAEIETIEDESAVDLIAKGSELERLHAVLKRPRVERGLTALAFDHRVPFAQLIAETGRSKADAIAFKKLIARAAKEVAGERGLANPGVLIDQHYGTDVMEALTEDGWWVGRPVEETGSRPLRFEAEDSLEETISAWNPKHVAKVLVWYHPGDDIALKNEQQASLKRLQACCRGRGQEWMLEVILPLDLERSDALLIAAVGELYAAGLKPDWLKLSGFETADAWDQLESMVKSFDPYCRGVILLGLSQPIEDLRIPIELAAQQPFCQGFAVGRSIFMDPARKWFAGISTDEETVNEIKGNYAKVVDMWSSTKQSTSIAEVA

SEQ ID NO: 19563 - protein, 152 aa, Zea mays
MAAAMMISGGRAAALVMAAVVLCSVAAMAAAQQASNVRATYHYYNPQQNNWNLNAVSAYCSTWDAGKPLAWRQKYGWTAFCGPAGQKGQAACGKCIRVTNRATGAAITARIVDQCSNGGLDLDYETVFKKIDTNGQGYQMGHLNVNYQFVAC

SEQ ID NO: 19564 - protein, 280 aa, Triticum aestivum
  misc_feature (223)..(223): Xaa can be any naturally occurring amino acid
  unsure (1)..(280): unsure at all Xaa locations
RHPREPSLQSAPAAVLLRCCHRTPAPASPTPLRPTLNPGPATAREHRLGIGGAMLRLGLHPCPHFSPPPSHPTLPRRLAASPLPRPPFPSAVTAPRARNPPLQAAVSGAASGEERRGADGDEEGADLHEALTKTRRLVECAMFASVAGLAYFLSNSLAIENYFSCFFPLPIVISSLRWGLEAGRKTMVATVLLLFTLSGPVKASTYLLMHGVVGLAMGTMWRXKRLETDWIASIIICSIVNISSQLVFHIYRCIAGDIWITHSLIALDRNSTTLPCERST

SEQ ID NO: 19565 - protein, 161 aa, Musa balbisiana
SSMMVSSAATVSRASPAQSSMVAPFTGLKSTSAFPITRKANADLSHLPSNGGRVQCMKVWPIEGKKKFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 19566 - protein, 466 aa, Pseudomonas fluorescens PfO-1
MSNYDVVILGGGPGGYNAAIRAGQLGLKAACVEGRATLGGTCLNVGCMPSKALLHASELYEAALGAEFANLGIEVKPTLNLAQMMKQKDESVSGLTKGIEFLFRKNKVDWIKGWGHIDGPGKVSVTGDQGSRIELTAKDIVIATGSEPTPLPGVEIDNKRILDSTGALSLSEVPKHLVVIGAGVIGLELGSVWRRLGAQVTVVEYLDRICPGVDGEAGKTLQRSLSKQGISFKLSSKVTSATSSANGVQLSVEPAAGGSAEILEADYVLVAIGRRPYTQGLGLENVGLSTDKRGMLANKQHRTEAPGVWVIGDVTSGPMLAHKAEDEAMACIEQIVGKAGEVNYDLIPNVIYTRPELASVGKTEEQLKAEGRAYKVGKFPFTANSRAKINHETEGFAKVIADERTDEVLGVHLVGPSVSEMIGEFCVAMEFSASAEDIALTCHPHPTRSEALRQAAMNVEGMATQM

SEQ ID NO: 19567 - protein, 191 aa, Zea mays
MSKRAGPPKHQNTYAWKPNLGRKINETEPGGRFRPLSEITGVCQRCRDQIDWKRKYGKYKPIVEPAKCQKCSKRNVRQAYHNVCTGCSKELGICAKCCTSVKQLVGRDAEEANSERKELEEAIRYARERERRTLLRLMNKNKDESGPSVPKIADRDREGDLFPVASLDEYAEQAVQKDESDEEDARDFVKD

SEQ ID NO: 19568 - protein, 456 aa, Pediococcus pentosaceus ATCC 25745
MSKEKKIPSGFIYFFGSFGGILFGYDIGVMTGALPFLQTDWNLQNNAGVIGWITSAVMFGAIFGGALAGNLSDKLGRRKMILISSLVFAIGSLLSALSPHDGQIYLIAVRIFLGLAVGAASALVPAYMSEMAPARLRGRLSGINQTMIVSGMLLSYIVDFLLKDLPEQMAWRLMLGLAAVPAVILYFGVLKLPESPRFLVKSNDIDGARRTLSYIRPENEVDAELKTIRETAAEEESANTSSTFLDLLSGKYRYLVIAGVGVAAFQQFQGANAIFYYIPLIVEKATGNAASSALMWPIIQGVILVLGSLVFLWIADKFKRRTLLTMGGTVMGLSFILPAVLNMFIKDMNPMMIVVFLCIYVAFYSFTWAPLTWVIVGEIFPLAIRGKASGVASSFNWIGSFLVGLLFPIMTANMPQEAVFAIFGIICLLGVLFIRTRVPETKGHTLEEIEEQGLGK

SEQ ID NO: 19569 - protein, 414 aa, Thermus thermophilus HB27
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDTALASMGNYIFRTEALFELLEADARDETSAHDFGKDVIPRALREGYRVYAYDFHRNPIPGQEGPNLYWRDVGTLDAYYEASMDLVKVVPEFDLFNPEWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 19570 - protein, 208 aa, Nicotiana tabacum
MAPVSALAKYKLVFLGDQSVGKTSIITRFMYDKFDNTYQATIGIDFLSKTMYLEDRTVALQLWDTAGQERFRSLIPSYIRDSSVAVIVYDVASRQSFLNTSKWIEEVRTERGSDVIIVLVGNKTDLVEKRQVSIEEAEAKARELNVMFIETSAKAGFNIKPLFRKIAAALPGMETLSSAKQEDMVDVNLKSSNANASQSQAQSGGCAC

SEQ ID NO: 19571 - protein, 586 aa, Zea mays
MERILKSARESGSLNLSNRSLREIPKEVYNNLDTGSQDEKWWEGVDLQKLILAHNNLEVLREDLRNLSSLVVLNISHNKISSLPAAIGDLPLLKSLDMSFNQINTLPEEIGLATALVKVDFSNNCLTELPPNLATCPDLSELKASNNNISRVPDVLAGCSKLSKLDLEGNKLVALSENMFVSWTMLTELNLAKNLLTAIPGSIGALPKLIRLDMHQNKITSIPPSIKGCSSLAELYMGNNLLSSIPADIGTLSKLGILDLHSNQLKEYPVGACNLKLSFLDLSNNSLSGLPAELGKMTTLRKLLLTGNPMRTLRSSLVSGPTTTLLKYLRSRLSSDEEASGSRSTPTKDDQIAAARRLSLSSKELDLSGLGVTSVPAAAWETSDVVKLDLSKNSIEDLPNELSLCSSLQSLVLSNNKIKRWPHTVVSSLPCLSSLKLDNNPLVEISSTDLVPLSKLEVLDLSGNASALPEPSAVSALPQLQELYLRRMKLHEFPNGLLGLKLLRILDLSQNHLTTVPEGIKNFTALIELDLSDNNITALPAELGLLEANLQVLKLDGNPLRSIRRTLLERGTKAVLKYLKEKLPSE

SEQ ID NO: 19572 - protein, 234 aa, Zea mays
  misc_feature (82)..(82): Xaa can be any naturally occurring amino acid
  unsure (1)..(234): unsure at all Xaa locations
GPIASRKFFVGGNWKCNGTGEDVKKIVTVLNEAEVPSEDVVEVVVSPPFVFLQQVKGLLRLDFAVAAQNCWVRKGGAFTGEXQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKP

SEQ ID NO: 19573 - protein, 204 aa, Zea mays
MDLPPNPESPGGGGDGGGGGGAGGSSGGASSSAPGGGTPQTPSRYEAQKRRDWNTFGQYLRNHRPPLSLAQCSGAHVLEFLRYLDQFGKTKVHTAACPFFGHPSPPAPCPCPLRQAWGSLDALVGRLRAAFEENGGRPESNPFAARAVRLYLREVREHQARARGVSYEKKKRKKPQPADHASGSGGQGPHHPPPPAPPPAGAAC

SEQ ID NO: 19574 - protein, 257 aa, Stellaria longipes
MGRKFFVGGNWKCNGTQESVSKIVDTLNEPTIAANDVVTVVVSPPYVFLPDENAELKHEIQVAAQNCWVKKGGAFTGEVSAQMLANLGITWVILGHSERRTLLGESNEFVGKKAAYAQSEGLGVIACIGELLEEREAGKTFDVCFKQLKSFARFPAKPWDNVVVAYEPVWAIGTGKVASPEQAQEVHVAVRDWLKTNVSEEVASKTRIIYGGSVNGGNSLALAAQEDVDGFLVGGASLKGPEFATIINSVTAKKVAA

SEQ ID NO: 19575 - protein, 463 aa, Robiginitalea biformata HTCC2501
MSSFDVLVLGSGPGGYVTAIRASQLGFKTAIVEKESLGGVCLNWGCIPTKALLKSAQVFEYLQHAGDYGLSVEGADKDFGAVVKRSRSVADGMSKGVQFLMKKNKIEVLQGYGTLKPGKKVSVKDADGKETTYEASHIIIATGARSRELPSLPQDGKKIIGYREAMTLEKQPKKMIVVGSGAIGIEFAYFYNAMGTEVTVVEFLPNIVPVEDEEVSKQLERSFKKAGVKVMTSSEVTKVDTSGDGVKATVKTSKGEQTLEADIVLSAVGIKTNIENIGLEDVGIATDRDKIMVNDYYQTNIPGYYAIGDVTPGPALAHVASAEGILCVEKIAGMHVEPLDYGNIPGCTYCMPEVASVGMTEAQAREAGYDVKVGKFPFSASGKAKASGNPDGFVKVIFDAKYGEWLGCHMIGAGVTDMIAEAVVGRKLETTGHEILKAVHPHPTMSEAVMEAVADAYDEVIHL

SEQ ID NO: 19576 - protein, 206 aa, Leptospira interrogans serovar Lai str. 56601
MTDKLIGFYDPVRMKAERKTSETEIKLEMNLRGTGQYQFDTEIPFFEHMLSHISKHGLIDLNLWLRGDIEIDCHHSVEDTAILMGTTIHKQLGDKAGIFRYGHFTLTMDEVLTTVAVDLGGRYFFKYTGPELTGKFGIYDAELSLEFLQKLALNAKMNLHVVVHYGDNKHHVHESIFKALGKALRMAIAQDSAAAGAIPSTKGVLE

SEQ ID NO: 19577 - protein, 670 aa, Debaryomyces hansenii CBS767
MGDSKSKKTMTKIGKLFGVSQTNLHQLSSPAVEDPKQAANGSDGKDNMAGGLTKASPLSSKEDIITAGQEDDRGSPLQKNNMLYGINSNNSKNSTNEHNSNIKNDGNINTGIGPNTQSINGNINMSNNKGKAATSRVSPRSGSKTNVSTINNPHRIASPVESVNSQEDNILFHPQPQVIRSMGSEFNLQTGSNNNLQAMSSSSPMNIRSPTLSVSSANTNQPTKKASISAGAKSTGSNPVSRTSSLKTKSVALKDKDVNASVLSPSPTPAKPRFRMLENGSHEHNLRSAKRQEKLSNMLKGLLGSKKLRDEAKSALPNILQTPQQSQSQLAQPNDKPPTLFAGLVHQVKNDTSPYHGLVNGTGEQPDCRSFVEKYGRCQEVIGKGSFGVVRISHKKVIGQNSDAEEKLYAVKEFKRRPNESDQKYNRRLTSEFCISSSLKNMNIINTLDLLKDAKGDYCEVMEFCSGGDLYTLIIAAGKLEYAEADCLFKQLIRGVNYMHEMGVSHRDLKPENLLLTQNGILKITDFGNGECFKMAWENEIQYSEGVCGSSPYIAPEEFCQHSFDPRGVDIWACGVIYLAMRTGRQLWKLADPKKDEFFAEYLMKRKDASGYEPIESLKRARCRNVIYSILDPKPERRINGKQILNSEWGREIKVCDAGEGKSVLPIPEI

SEQ ID NO: 19578 - protein, 475 aa, Oryza sativa (japonica cultivar-group)
MASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGVVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSG

SEQ ID NO: 19579 - protein, 181 aa, Oryza sativa
TRLMLTSRIRNTNADGKPFSFTFAYHTYFSISDISEVRVEGLETLDYLDNLQERNRYTEQGDAIVFESELDRIYLGTPSKIAIIDHEKKRTFVVRKGGLPDAVVWNPWDKKAKAMSDFGDDEYKRMVCVEAAAIEKPITLKPGEEWTGKLELSAVPSSYYSGQLDPDRVLQDSSVPEDSIS

SEQ ID NO: 19580 - protein, 161 aa, Musa balbisiana
SSMMVSSAATVSRASPAQSSMVAPFTGLKSTSAFPITRKANADLSHLPSNGGRVQCMKVWPIEGKKRFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 19581 - protein, 161 aa, Musa balbisiana
SSMMVSSAATFTRVSPAQSSMVAPFTGLKSASAFPVTRKPNADLSHLPSNGGRVQCMKVWPIEGLKKFETLSYLPTLKDEALLKQIEYLLRSRWIPCLEFSHEGFVWRENHRSPGYYDGRYWTMWKLPMFGCTDAVQVVKELEECKKEYPKAFIRIIGFDN

SEQ ID NO: 19582 - protein, 161 aa, Musa balbisiana
SSMMVSSAATFTRVSPAQSSMVAPFTGLKSASAFPVTRKPNADLSHLPSNGGRVQCMKVWPIEGLKKFETLSYLPTLKDEALLKQIEYLLRSKWIPCLEFCPKGFVWRENHRSPGYYDGRYWTMWKLPMFGCTDAVQVAKELEECKKEYPDAFIRIIGFDN

SEQ ID NO: 19583 - protein, 403 aa, Mycobacterium smegmatis str. MC2 155
MAKPLLTASAEVLNAVNAVKPFGRKGYSTVVAFAFGWPTSENGPLITTVSALDALRRAVRGDYRTTPGRISLLLKAVAWALLYIVHRRNRTSRRFFEEPLRSALGADYAVARRARRPGGVIRTSWARHRYATTTVRYGPHRANLADIWMRPDLPRDGKAPVLLQVPGGAWMIGMRRPQSYPLMSHLAEQGWICVSIGYRISPKHSWPDHIVDVKQALAWVKANIADFGGDPESVCITGGSAGGHLTALAALTPNDPKWQPGFEDADTSVVAAVPVYGRYDWYSTTGPGRTEFMEILERLIVKRPLDGNAELYRDASPIMLVRPDAPPFFVLHGTNDSLIPVVEGRDFVAALREVSNSPVVYAEIPHAQHAFDFFGSPHGHFTADAVEKFLNWVLAKRGVAQNR

SEQ ID NO: 19584 - protein, 171 aa, Mycobacterium sp. MCS
MAAPIVVMGVSGSGKSTVGAALAQRLRVPFADADDFHPPENIAKMTAGHPLDDDDRLPWLESIGEWLAAHHDGGVMSCSALKRKYRDQLRRHCADVEFLHLAGSVETIGRRQASRPGHFMPATLLASQFETLEPLEPDENGVALDIDQSIDSIIESYVNTTHSHGAEKEDR

SEQ ID NO: 19585 - protein, 252 aa, Rickettsia sp. DmS1
LLCLRLSSLSAFYPDLLNFKEADYEHIAIRMIAEIPTIAAMSYKYSIGQPFIYPDNSLDFTKNFLHMMFAMPCTKYKVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRTAVLKEMCKVLKELGQLDNNPLLQIAIELEAIALKDEYFIERKLYPNVDFYSGIIYKAMGIPSQMFTVLFA

SEQ ID NO: 19586 - protein, 183 aa, Ostreococcus tauri
MAKFGEGDPRWIVTERQDGTNINGWHWEVRLARANANSNERNMMKWAKEKLETLLIGSDLAVPVAEGRATIVEMTKFEGDASVSTRKGGKKFGCFDLSFTLRWEARRETRADDLDDDDAVKGEIKVKEFCSTNDEDEYTFEVTTKDGSAEAKELFKSRVETSLKERGILLAKLRQFCDELKAQ

SEQ ID NO: 19587 - protein, 253 aa, Rickettsia slovaca
YMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFA

SEQ ID NO: 19588 - protein, 445 aa, Mortierella alpina
MATPLPPSFVVPATQTETRRDPLQHEELPPLFPEKITIYNIWRYLDYKHVFGLGLTPLIALYGLLTTEIQTKTLIWSIIYYYATGLGITAGYHRLWAHRAYNAGPAMSFVLALLGAGAVEGSIKWWSRGHRAHHRWTDTEKDPYSAHRGLFFSHIGWMLIKRPGWKIGHADVDDLNKSKLVQWQHKNYLPLVLIMGLVFPTVVAGLGWGDWRGGYFYAAILRLVFVHHATFCVNSLAHWLGDGPFDDRHSPRDHFITAFVTLGEGYHNFHHQFPQDYRNAIRFYQYDPTKWVIAICAFFGLATHLKTFPENEVRKGQLQMIEKRVLEKKTKLQWGTPIADLPILSFEDFQHACKNDNKKWILLEGVVYDVADFMTEHPGGEKYLKMGVGKDMTAAFNGGMYDHSNAARNLLSLMRVAVVEYGGEVEAQKKNPSMPIYGTDHVKAE

SEQ ID NO: 19589 - protein, 309 aa, Debaryomyces hansenii CBS767
MVELTDYQRQEKVGEGTYGVVYKALDTKHNNRVVALKKIRLESEDEGVPSTAIREISLLKEMKDDNIVRLYDIIHSDSHKLYLVFEFLDLDLKKYMESIPQGVGLGADMVKRFLNQLVKGIKHCHSHRVLHRDLKPQNLLIDKEGNLKLADFGLARAFGVPLRAYTHEVVTLWYRAPEILLGGKQYSTGVDMWSVGCIFAEMCNRKPLFPGDSEIDEIFRIFRILGTPSEETWPDVSYLPDFKSTFPKWSKKNLAEFVPTLDEDGIDLLEQMLVYDPSGRISAKRALIHPYFQEDGENYDSYPRSVNMG

SEQ ID NO: 19590 - protein, 361 aa, Zea mays
  misc_feature (180)..(180): Xaa can be any naturally occurring amino acid
  misc_feature (226)..(226): Xaa can be any naturally occurring amino acid
  misc_feature (242)..(242): Xaa can be any naturally occurring amino acid
  unsure (1)..(361): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVXPIVEPEILVDGPHDIDRCAYVTEIVLAACYKAPQRTSMSSLRGTLXLKPNMVTPGSDAKKVXPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDATLGEGASESLHVKDYKY

SEQ ID NO: 19591 - protein, 150 aa, Zea mays
  misc_feature (46)..(46): Xaa can be any naturally occurring amino acid
  misc_feature (61)..(61): Xaa can be any naturally occurring amino acid
  misc_feature (102)..(102): Xaa can be any naturally occurring amino acid
  unsure (1)..(150): unsure at all Xaa locations
MSEFRGHECLRQAAPYSGRKLRVARPCFRSMRRPRTSCWVDKNGDXSAYFDLYDIRNTTGXSDHYRSDAPPPYNPLQRKVYETLADPYTKRGLLLKFLLQGXAHFMVYVNVSVLLDLLSIKKGPQEQPQPVLARKDLSSASPFAWASSWL

SEQ ID NO: 19592 - protein, 450 aa, Oryza sativa (japonica cultivar-group)
MDELGIIEQGVDWRTRLGQDIRDCMINDILFSLQTKLQSTTTALIDLQKVAVRIEERIHTIASDYGDYLRRICLTRGDLDSYDVFLNDCQRQQASIRSSILLHQENKQGVLSNQVALNDHKEHSHPYEKDMISKLPNDLVQHIMSFLSMREAVRTSVLSHWWVNQWTFLKSIQLNIYWFHMDREKFSSFLDKLLLSRVQADAPMDTFELKSFAIDRANYWINHAIKHNAKVLKFAEYGKWEPFYLDPNLVELSSRYLETLELTNVALDATIFNQLANACPALQNMLLTDCLLEVEEISSSSLKNLDIIDCYILKDLSICTPSLVSLCIKNERTDNSSFRNSYLIFATAIIIDASNVSSMELLAMDRQFTFVEKDGGEPMFKNLRNLSLGLWCINNMFSPLRRFVRHSPMLRMVTLRISPLDWKSHLTKEHQEMLISIRDRRGLILYIDWY

SEQ ID NO: 19593 - protein, 1054 aa, Oryza sativa (japonica cultivar-group)
MHQGAARQAGQSGGGGGGGGGADRLSALPDAALFRIVSHLTARQAVRTSVLSKRWRHVWASVPRVDIRHPCACDERADQERFGDFVTTMLLNRRPFAPIKALRLWWSHDGDAETWIAHAVRRGAEEIDFSARHHQDDPKPELEYTSFISPKIKILKLTTFGMDIKAITHICSRCTSLEELELKDFRRLDGQIRSASLKQLSIINCFISVAFLVDAPNLISLCFIRPLSFERTKESICSSDNRRWPSPVWKDDNDGFDHGDIFAIASGEHFDDKRENESDQDYGFDDGSDDNIASESDHDDDGPPSPYSVSYDGDNECESYEPGNKEESDRTVAYGEIADEYSSNGDPGDEYRGNYVNHDSANYGRANKFGNLNFPVKSIVDASAHEGELLLRRLLENFPMFNNLDTLSLGEWCMVPDFSALSTILTKSPNVKRLYLHLDVIHRRRRCIDPSGGSFSCNNLEKVKITCCKDDVMVHMLAPFLQDNGVSPEKIFVRRTSSPHNGKEGRGELFDGMHQGAAGPGPSGGGGDRLSALPDAVLFRIVSHLKAREAVRTSGLSRRWRHVWASAPRVDVRYPCACDGRAVDQKSFRDFVTILLLRRRPLAPFKALRLSWSHDEDDVSAWIAHAVRRGAEEIDLSARRHHGYPVPDYKHFISPKIKILKLTHLGTTRFTADNTLDLLCSGCTSLEELELKDIKSLWGGIQSDSLKRLSIINCHVTSDGFLVEAPNLISLCCIRPARAVPWFSHMVSLVEATVVLDDSRLSDDYQQPVLEDDNDGSDYDDNFFAPKAEGPDDKRDNEADNDSGDKRNRDGSKSDLDDHDGEYDHEDGSESGDKEVDDLEGGDDRTVTYGEIADESSSYGIPIPSDEYGGNYGNHDYTIFGGDHMLDHLSDVRTLGLLGHQGEMLLRRQLENCPIFNNLNTLTLGEWCMAPDFSALSTILENSPHVERLYLNLDMDIHRSRGGINPTGGSFACNNLKKVKITCRKDDVMVHMLAKFLQRNGISLQKIFVRRTSSTHNGEEGTGKDSSAKRKAQDEAARRAVKQLRRARNSRSPE

SEQ ID NO: 19594 - protein, 294 aa, Triticum aestivum
  misc_feature (135)..(135): Xaa can be any naturally occurring amino acid
  misc_feature (156)..(156): Xaa can be any naturally occurring amino acid
  unsure (1)..(294): unsure at all Xaa locations
MFRKKQASHFDSDDAEQRQAKIKELKAALGPFSARGKKYCDEACLVRYLEARNWNVDKSRKMLEESIKWRAAKRPEDIRWPDVSVEAETGKMYRATFTDREGRTVVVMRPAKQNTSSHEGQLQYLVYTLENAVLXLPEGHDKMVWLIDFTGWTLGXMAPPFKTARDWYENVLQNHYPERLSIAFLFNPPKVFEASFKVLKVLVDPKSAQKLNFVYKENEESMKTMYSHIDPEVLPVEFGGKNNVVYNHEDYSKLMIKDDIKRASFWAADVSHVVNVDSVPEVKPQSSLIVAKAS

SEQ ID NO: 19595 - protein, 428 aa, Carboxydothermus hydrogenoformans Z-2901
MSEIREVIAREILDSRGNPTVEVDVILEDGTWGRAAVPSGASTGAFEAVELRDNDPQRYLGKGVTQAVENVNSIIGPEILGFDALDQVGIDEYLIELDGTPNKGKLGANAILGVSMAVAKAAANYLGLPLYRYLGGTNARVLPAPMMNILNGGKHADNNVDIQEFMIMPLGASSFSEALRMGAEVFHNLKKVLKGKGYNTAVGDEGGFAPNLKSNEEAIEVIVEAIEKAGYTPGKDIYIALDVAATELYKDGFYVLEGEGVKKSAAEMVEYYEKLCAKYPIISIEDGMSEEDWDGWKLLTERLGKKIQLVGDDLFVTNVERLQKGIDLGVANSILIKLNQIGTITETLNTIELARQNGYTTIISHRSGETEDTTLADLAVAVNAGMIKTGAPSRTDRVAKYNQLLRIEEELDYTAIYKGLKAFYNIKA

SEQ ID NO: 19596 - protein, 550 aa, Oryza sativa (japonica cultivar-group)
MRRGKAALWRPRHGEGETSRRGGDGDGEAADRLSALPDGVLHHVMSFLKAWEVVRTCVLSRRWRNLWASAPCVDLRIRYFRLDSEPPEEPRDFVNRLFRRREASAPVDTLRLQLSDPDNLFDNDDANAWIRTAIKRNARFIHLTGHRKEIGVLKHRALVSTHLKILKLSYVLIDDKILKQLSSGCKSLEELDLKDCVMTGHQISSASLKTLKMDRCKINVDLSITAPNLVFLNIVTPYIRVPSFKNLESLVTCSIILDDLFLGDDYQHISDEDDIDETTDDDDFGYQKNDKAGYRINYAKKGFVFGGNEDGYGYGSDIESDDNTYEYSEIANECGELQYGNNGDGHNSSKDGEYDNAETFGGQNVIHSLSNVRSLELLAGAGEVVLSRELKSCPIFINLKTLSLGEWCMDAEFDALVFLLQRSPNLERLFLEPQLISLFCKKNFNTRKALESGVKPTGRSFTCKDLQMVKIRCSKDDARVHMLAHLFRANGIPFDKIYVHRSGSSRLRSEKVMRDLAKQELEFWGSDEFWGSDYEYCGPDPEFGDSDLEF

SEQ ID NO: 19597 - protein, 520 aa, Mycobacterium smegmatis str. MC2 155
MTMYLTQGLHRAVQQTPGATMTVFGERRRTFLEVADRVARLAGALRALGVRAGDRVAMLAQNSDRYHEYLLAVPWANGVLNPVNIRWTPAEIAYSLEDSGTKVMFVDDSFARMLPAIKDAWAELSTVIYAGEASPPAGTLAYEELIDKSDPVDDARRGGDELAGLFYTGGTTGFPKGVMLSHANLLTSTYGLLTPGFAFRPGGICLHAAPMFHLADLMSWSAGLLQGGRHVFIPSFEPVTVMQAIAQHQVTDALLVPTMIQKLIDHPDINRYDLTSFRALFYAASAIPQALLERAMKVFPNAEFVQGYGMTELSPLATLLSPDDHQKPRLLRSAGRAAPSAEVRIVDPDGNEVPRRTVGEVAVRGGNVMLGYWNKPQETAAAIRDGWMHTGDAAYMDDDGYIYVVDRIKDMIITGGENVYSAEVENAVVQHPSVAACAVIGVPDADWGERVHAVVVLQPGAELAACQIREHAKRLIAGYKCPRSIEFVNALPLSGAGKVLKRELRERHLGARERDRGSLP

SEQ ID NO: 19598 - protein, 271 aa, Glycine max
MAAPRNVTATRDEEKGEEDDSPSAKKPKSERFPLNTWEFAVAVAVFFVFSTGLFCVYLSLPSAAYTNLKLPRTLSDLRLLKEHLSAYASNHPAQFILGYCSTYIFMQTFMIPGTIFMSLLAGALFGVVRGILLVVFNATAGASSCFFLSKLIGRPLVSWLWPEKLRFFQAEIAKRRDRLLNYMLFLRITPTLPNLFINLASPIVDVPFHIFFSATLIGLVPASYITVRAGLALGDLKSIKDLYDFKTLSVLFLIGFVSIAPTLLKRKRVYE

SEQ ID NO: 19599 - protein, 705 aa, Gossypium hirsutum
MRTSPSNTAMMEIQANKPAGTGMVVGGLSPLSETLWREKTDTELMGDVSARLTWEDLTVMVTLSNGATQKVLEGLTGYAEPGTLTALMGPSGSGKSTLLDALSSRLAANAFLSGTILLNGRKTKLSFGTAAYVTQDDNLIGTLTVRETISYSARLRLPDTMPWSAKRDLVEGTIIEMGLQDCADTVIGNWHLRGISGGEKRRVSIALEILMRPRLLFLDEPTSGLDSASAFFVTQTLRGLSRDGRTVIASVHQPSSEVFELFDQLYLLSEGKTIYFGQASEAYEFFAQAGFPCPALRNPSDHFLRCINSDFDKVKATLKGSMKLRFEASDDPLEKITTTEAIRTLINFYRTSHQCYAAKEKVDEISKVRGTVLDSGGSQASFLMQSYTLTKRSFVNMSRDFGYYWLRLLIYVVVTVCIGTIYLNIGTSYNSILARGACASFVFGFVTFMSIGGFPSFVEDMKVFQRERLNGHYGVTAFVIGNTLSAMPFLIMITFISGTICYFMVRLHPGFEHYMFFVLCLYASVTVVESLMMAIASIVPNFLMGIITGAGIQGIFMLVSGYFRLPNDIPKPVWRYPMSYISFHFWALQGQYQNDLKGLLFDNQPPELPKIPGEYILENVFQIDVGRSKWIDLSVIFSMIIIYRIIFFLMIKISEDVTPWIRGLVARRRMQQKNGTQNTMVAPSLSQSPSLRNYVANRANGRGKR

SEQ ID NO: 19600 - protein, 546 aa, Mycobacterium sp. MCS
MYSTMQDVPLTVAAILRYAATVHGDRTVTTATGNGGYRHATYREVGQQAARLAHALRRFGIEGDDRVGTFMWNNQEHLEAYVAVPSMGAVLHTLNIRLFPEQIEFVAYEAEDRVLIADLSLAPVLAPVLRSLETVHTVIAVGEGDLAPFEESGKRVVRYHEVTAAESDEYDWPDIDENSAAAMCYTSGTTGHPKGVVYGHRSSYLHSMAVCGGNGLGMSFSDKALPIVPMFHANAWGLPYAALMAGADLVLPDRFMDATSLVDLIETQRPTVAGAVPTIWNDVMHHLDQNPGHDISSLRLVGCGGSAVPVSLMKAFEEKFGVQIRQLWGMTETSPVATIAWPPPDTPAEKHWQIRSTQGRPLCGVEARIVDDDGAVLPNDGESVGELEVRGPWITGSYYRNTDDSKFQSGWLRTGDVGRIDPQGYITLTDRAKDVIKSGGEWISSVELENHLIAHPAVREAAVVGVPDERWQERPLAAVVVQEGAQVDADELRNFLADKVVRWWLPERWTFVDEIPRTSVGKYDKKVIRARYADNAYQVADLREHT

SEQ ID NO: 19601 - protein, 245 aa, Oryza sativa (japonica cultivar-group)
MIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTAICEQMYEYGRNLGLSFQVVDDILDFTQSAEQLGKPAGSDLAKGNLTAPVIFALQDEPQLREIIDSEFSETNSLATAIELVHRSGGIKRAHELAREKGEIAIQSLQCLPRSEFRSTLENMVKYNLERID

SEQ ID NO: 19602 - protein, 305 aa, Triticum aestivum
FLFCVESPRSVTPCAIWFGLQACVESGFFYVTNHGIQDGLLGAPGAESKRFFELPLEEKMLLQRNSSHRGYTPPYAEKLDESSEFQGDLKESFYIGAVRDVDMPNDPNQWPPKERFPSWKDTMKLYHEAALAAGKRILSLIALSLDLEAEFFQKIGAVDCSSEVIRLLHYPGEVNESDNGNYGASAHSDYGMITLLATDGTPGLQICREKDRHPQLWEDVRHVDGTLIVNIGDLLERWTNCVFRSTLHRVVAVGRERYSAAYFLDPRPDLVVQCLESCCCDAYPPRFPPITAGDYLKERLSATYK

SEQ ID NO: 19603 - protein, 213 aa, Triticum aestivum
MAGSRRALRFVLLLPAILGALLPPAAAGPPKVSLALYYESLCPYCSRFIVTRLAGIFDSGLIHAVDLLLVPYGNAHVHGANNTISCQHGPDECLLNNVEACAIDAWPDLNVHFGFINCVEDLVMNRKREEWESCFQKQGLDPKPVMECYNSDQGHKLSLKYGKQTDALVPPHKYVPWVVVDGQPLYEDYENFEAYVCKAYKGHPPKICQGLGP

SEQ ID NO: 19604 - protein, 430 aa, Clostridium difficile 630
MKLHGTMTVNNDELYIGGVSCLELSKKYQTPLYVFDEALVRQNCREYIEYFKAREGKNKVAYAGKAFLPLYMCNLINEEQMCLDVVSGGELYTAYKSNFPMEKVFFHGNNKTKKEINMGLDLGVGKFVVDNFYELDLLEALCEDKGKTQEIYFRITPGIEAHTHDYIKTGQIDSKFGFALVNGDLFRAIEKLSEYKNIKLVGLHAHIGSQIFDVEPYIDTVDIMMNLVKEIKEKFNIQLTEIDLGGGVGVYYSEGDKPKTIKEFCETIITKAETSCKELGIEVPTLVIEPGRSIVANAGSTLYTVGSIKDIKDVRVYVSVDGGMTDNVRPSLYQASYECSIVNKINHEAMNHVTIAGKCCESGDILIGDINIMDIKSGDILITTSTGAYGYSMSSNYNKIPRAAVVSVFDGNDKIICKRQSYEDLLALEI

SEQ ID NO: 19605 - protein, 259 aa, Legionella pneumophila str. Lens
MMTLITGATRGIGLALAYEFASHGHDLILIGRDSEQLEHISKQLNTQYQINVEYKVHDLSKPGSAFKLYTDLKEQGVEVNCLVNNAGIGYMGSFVEMGMNKLDDLMNINMISLSELTLCFLHDFVARNEGSILQVSSTAAFQPGPFMAAYYASKAYVATLSHAIAYELKGTKVSMSILCPGATKTNFFHASGMESSMLERGYIGMMTPEKVAKIAYKGLKKGKLYIIPGLRNKILAYAAAISPKAIALRIASYLHHKIL

SEQ ID NO: 19606 - protein, 221 aa, Oryza sativa (japonica cultivar-group)
MAEEKGKAVMPMEVDQVEDEREAETVVEAVQKAVYDALEKVEMMEEEGEAAVAEAADKLLEEAVEKAVTEALEEAGWDAAEKALSDDLEKVSLEAESARMITLESSDGEVVKVKEASARLSKTIGNIIDDGRGDEAIPLPDVSYKTLKKVVEYCDKHADEKSDTDEQKEELKNWDKAFIDELAEDDDSLVKVIMASNYLKIDGLHNLASQCKTTREQIGKA

SEQ ID NO: 19607 - protein, 215 aa, Thermotoga maritima MSB8
MLVKDFMTRNPITIAPETSFSEALKLMKQNKIKRLIVMKNEKIVGIVTEKDLLYASPSKATTLNIWELHYLLSKLKIEEIMTKDVVTVNENTPIEDAARIMEEKDISGLPVVDDAGRLVGIITQTDIFKVFVEIFGTKREGTIRYTMEMPDKPGELLEVAKRIYEAGGNIISIATLFEEGKDSYLATLRVENIDHEKFVKSLDEIDVKLLYYHSN

SEQ ID NO: 19608 - protein, 322 aa, Debaryomyces hansenii CBS767
MSVILASAGYDHTIRFWDALTGVCSRTIQHTDSQVNRLEITSDKRYLAAAGNLYVRLYDIRQTGNSGNTSEANAGGNNSNNNNSNPVMTFEGHTNNVTSLAFQVDNKWMVSSLEDGMVKVWDVRSPSVQRNYKHHCPVNEVVIHPNQGELISCDQDGNIRIWDLGENQCTHHLIPEDDVPINSISVASEGSMLVAGNNKGNCYVWLMQNQKDITSLTPVTKFRSHLKYITRVVLLTDMRHLATCSADHTARIWSTEQNFSLETTLHGHQRWVWDCAFSADSAYLVTACSDHYVRLWDLSNCETVRQYNGHHKGAVCVALNDV

SEQ ID NO: 19609 - protein, 217 aa, Leptospira interrogans serovar Lai str. 56601
MNEDPQKKDEPFFKDVEFKASYGKADQIPSQGTPQIAFAGRSNAGKSSLLNAILERKSLAKVSSTPGKTKLLNFFFVNHSIYLVDLPGFGYSANSHKDHEAMMGLLMDYLNLAKDLKCLFLVCDSQRELPEEELELIGTCFERNIKPVLVRTKIDKLNQSDLSKLRKKMKNIHELYPMLETVLVSNKSGKGLPELRKIVYSLIETVKNRLERIEEIS

SEQ ID NO: 19610 - protein, 303 aa, Arabidopsis thaliana
MPTLYKKAGCLGIREFMDSSMSTKKKTKLSVRNQTCFKKSSLSSSSTAKKTTNLSMREQTMFKKALELSTLCNIDVCVIYYGRDGKLIKTWPEDQSKVRDMAERFSRLHERERCKKRTNLSLFLRKKILDDTKLSEKVLEMEDSLESGLRVLQDKLLLLQPEKNQTEFGQTRAVSSTTNPLSPPPSLIEDHRHQQWTEPLMSGVSNTEQDLSTSSLSQNQSRISVFLYNHDNRSFYQVPDSVSSFDQSALLGEQGSGLGSNFDLPPMVFPPQMQTQTPLVPFDQFAAWNQAPSFADPMMFPYN

SEQ ID NO: 19611 - protein, 148 aa, Oryza sativa (japonica cultivar-group)
MAPSVMASSATTVAPFQGLKSTAGMPVARRSGNSSFGNVSNGGRIRCMQVWPIEGIKKFETLSYLPPLTVEDLLKQIEYLLRSKWVPCLERPRRRTLMHSSVSSASTTSGRCSSSASSPTSPRAARSLVATKPSSSYIALFNCSSLIR

SEQ ID NO: 19612 - protein, 458 aa, Mycobacterium smegmatis str. MC2 155
MPHIPAVRSFEESCELQTKLHHVVPGGAHTYSRGSDQYPEFMTPVLTHGHGCHVWDADGNEYIEYGMGLRSVTLGHGFRPVIEAVCSAIADGVNFSRPTTLELDAAEEFLDLIPAAEMVKFAKNGSDVTTAAVRLARAVTGRATVAACHQPFFSTDDWFIGTTEMSGGIPQSNRSTVLFEYNDLDSLASVLTTHDIACVILEAATSTTEPAAGFLEGVRRLCDKHGALLVIDEMITGFRWSEHGAQTVYGIEPDLSCWGKAMGNGFPISALAGKREFMELGGLRTDRERVFLLSTTHGPERGSLAAFRAVVREYIENDPISRMEQAGRLLAAGVKAAVDEAGLADFVQVAGRPSCLTFITRDAGRVPSQAYRTLFLQELLKRGVLGQSFVTSAAHTDRDIEQTITAVSGALPAYKLAVERGSVDGLLEGRPVAPAIRQYAAPRRIESTAGLTQTSASQ

SEQ ID NO: 19613 - protein, 834 aa, Oryza sativa
MSLHCCPAAGDPPAPAGTAEELLERARSLVPAALDAARAATGFGGRWKVIAARLERVPPCLSDLSSHPCFSKNSLCRELLQSVAATLAEAAELGARCREPPRAGKLQMQSDLDALAGKLDLNLRDCALLIKTGVLSDATVPPVAPAAEAAAQTDVRELLARLQIGHAEAKHRAVDGLLDALREDEKSVLSALGRGNVAALVQLLTATAPKIREKAATVLCLLAESGSCECLLVSEGALPPLIRLVESGSLVGREKAVITLQRLSMSPDIARAIVGHSGVRPLIDICQTGDSISHSAAAGALKNLSAVPDVRQALAEEGIVRVMVNLLDCGVVLGCKEYAAECLQSLTSSNDRLPSSNHFSRPPPPPPRPRSPARPPPPPPMATSTRALLLLPLLLLFLLSRSLSLRADPGAAVSRIAFGSCANQSAPQPVWEAVVGFDPQVFIWLGDNVYGDNKRPFRVFGRERTVGPWRNVPRFYPSTEAELRRRYEMAKAKPGYAKLRERAQVIGTWDDHDYGLNDAGKEFGGKVTSQRLLLDFLDEAEDSSRRQQAGVYASYMFGPEGKRVKVILLDTRYHRDPLSSDGAVLGDPQWQWLERELHGPRSEITIIGSSIQVISNLSATTGPLFYVESWARFPRERERLFRLIDSSKRNGVFFISGDVHFGEISRYDCGAQYPLYDITSSGLTQSVENSVPSVFQPLMRLVALLTPTTLRVFSPNCRYKSCTYGQPNFGAIEIDWNAVPPQIKLELRDVEGNSVGGVEFPISELDPSKAHAITKQGHSYQRHCALETELPWLVWHRLALLLFGTIAVLVIAVVLLGITCLSAANIFTKKSKME

SEQ ID NO: 19614 - protein, 256 aa, Wigglesworthia glossinidia endosymbiont of Glossina brevipalpis
MKLKPLILSNWKLNGNCLLVKKILLKLNEKLKNKNNLKVVIAPPVIYLSEFKKYVLKKNIFLAAQNVDVNLTGSFTGEISPIMLYEFGVKYVIIGHSERRLYHNESIEDVTKKFLILKKFNLIPVLCIGETKKNKDDKCIENEIVKQIDFILKKIGIEGFINTVIAYEPTWAIGKKDSASPKYIQKIHKFIRNYLSKYDNDISKKIILQYGGSVNSKNVKKIISQKDVNGVLLGRSSTNIEEFLYILDIIEKTKKS

SEQ ID NO: 19615 - protein, 571 aa, Bacillus subtilis subsp. subtilis str. 168
MVTKILKAPDGSPSDVERIKKESDYLRGTLKEVMLDRISAGIPDDDNRLMKHHGSYLQDDRDLRNERQKQKLEPAYQFMLRVRMPGGVSTPEQWLVMDDLSQKYGNGTLKLTTRETFQMHGILKWNMKKTIQTIHSALLDTIAACGDVNRNVMCASNPYQSEIHSEVYEWSKKLSDDLLPRTRAYHEIWLDEERVAGTPEEEVEPMYGPLYLPRKFKIGIAVPPSNDIDVFSQDLGFIAIVEDGKLIGFNVAIGGGMGMTHGDTATYPQLAKVIGFCRPEQMYDVAEKTITIQRDYGNRSVRKNARFKYTVDRLGLENVKEELENRLGWSLEEAKPYHFDHNGDRYGWVEGIEDKWHFTLFVEGGRITDYDDYKLMTGLREIAKVHTGEFRLTANQNLMIANVSSDKKEEISALIEQYGLTDGKHYSALRRSSMACVALPTCGLAMAEAERYLPTLLDKIEEIIDENGLRDQEITIRMTGCPNGCARHALGEIGFIGKAPGKYNMYLGAAFDGSRLSKMYRENIGEADILSELRILLSRYAKEREEGEHFGDFVIRAGIIKATTDGTNFHD

SEQ ID NO: 19616 - protein, 178 aa, Oryza sativa (japonica cultivar-group)
MVETLAFCEEKGEEREEETDRRIPGGTASGGGGTAGRYTDIAADLIDSDSDESRDRSRKRSRSQKGPKERSSRKKKSRRDGSTRKKEASEGARFALEDGNGGTGYVMSGSRHARITAVRLRKENQVYSAEEKRALAAFNSEQRARRESKVRDDLRCLVDRTLGKLAGSDHDDDPSSAR

SEQ ID NO: 19617 - protein, 420 aa, Bordetella pertussis Tohama I
MDEIQSIVIVGAGQAGAVAAASLRQLGYRGGLTLVGQEAHPPYERPPLSKAVLQGTATHAEAAVHPAGFYAENDIALLTETAVAALDPAARTVRLADGRTLPYDRCLLATGGHARELPALPRGRAGVHYIRTLDDALDLRAALRPGVRAAVIGGGFLGLEVASTARELGAKVTVIENGSRLLERALPAIVSDWLAERVRASGVDLRLGGAIAAIGDGPPYAITLADGTQVNADLIVVSIGLAPEVTLARQAGLPLDDNGGICVDSQARTADPQVYAAGDCASQPRACLGTAARFESWQNANEQARAAAAAMLGLAPAAEPYPWFWTDQYGCNIQILGLPQPGLRYVCRPQTDPQAAPRVLWIGLRDGVPCHGIAVNAGGDLRQLRVLFERGIPVDPHRLADPAEALKPLVKAWQAAIAVA

SEQ ID NO: 19618 - protein, 327 aa, Kineococcus radiotolerans SRS30216
MVTMAIGKAINAGLRAAMDRDPRVLLMGEDIGALGGVFRVTDGLQKDFGEDRVIDTPLAEAGIVGTAIGMALRGYRPVCEIQFNGFVFPAFNQITTQLAKLRARSRGRLSVPVVLRIPSGGGIGSVEHHSESPEVLFAHTAGLRVVMPSSAHDAYWMVQQSIASADPVVFLEPERRYWEKSEVDVDLGPGQVTPLHRARVLRPGTDATLVCYGPTVKLALDAAVAAAADGTDLEVVDLRSISPLDVDTVAESVRRTGRLVVVTEAPVFHGPGAELAARIQESCFYSLEAPVKRVGGYHLPYPVARVEEHYLPTVDRVLDAVEQTLSA

SEQ ID NO: 19619 - protein, 536 aa, Glomus mosseae
MASTPPTDYGKEAVLDVSETRDVETGEVKNGGLKQDLKNRHMQMIAIGGAIGAGLFVGSGGALQKGGPAALLIGYLIIGIMLLCTCLALAEMAVLYPVNGAFFTYIVRFVDPSWGFAMGWQYALAWLTVLPFELIAASITIRFWREDINMAVWVSVFLVVLMGIQIFGVRGYGEVEFVLSIIKICACVGFIILGIVINCGGVGDQGYIGVKYWRDPGAFTSFKGFCAVFVVAAFSFGGTEMVGLAAAESANPRKSIPMASKQVFWRIAIFYILNLFIVGLILPANDPRLMGASGANTKASPFVLAIQDAGIKVLPSIMNAVITVAVLSVANSCTFGSTRTIQAMAERNMAPNFFKYIDSKGRPLYCVILQIAFGLLAYIGAAPQGMEIFGWLLALTGLGFLFVWGSICLAHIRMRAGMKAQGINLGLIPYKTPFGVAGSYLGLGLNILALIASFYTALFPASGASPTAEAFFSSYLAFFSVTLLYLGYKACTRKRQMYVRPAEMDLASGAVWLEEVEPKEPFVWADTPKKVLRSFY

SEQ ID NO: 19620 - protein, 690 aa, Nicotiana tabacum
MQDFIGSVRRSLVFKQSGDFDTGAAGVGSGFGGFVEKLGSSIRKSSIGIFSKAHVPALPSISKAELPAKARKDDTPPIRWRKGEMIGCGAFGRVYMGMNVDSGELLAIKEVSIAMNGASRERAQAHVRELEEEVNLLKNLSHPNIVRYLGTAREAGSLNILLEFVPGGSISSLLGKFGSFPESVIRMYTKQLLLGLEYLHKNGIMHRDIKGANILVDNKGCIKLADFGASKKVVELATMTGAKSMKGTPYWMAPEVILQTGHSFSADIWSVGCTIIEMATGKPPWSQQYQEVAALFHIGTTKSHPPIPEHLSAESKDFLLKCLQKEPHLRHSASNLLQHPFVTAEHQEARPFLRSSFMGNPENMAAQRMDVRTSIIPDMRASCNGLKDVCGVSAVRCSTVYPENSLGKESLWKLGNSDDDMCQMDNDDFMFGASVKCSSDLHSPANYKSFNPMCEPDNDWPCKFDESPELTKSQANLHYDQATIKPTNNPIMSYKEDLAFTFPSGQSAAEDDDELTESKIRAFLDEKAMDLKKLQTPLYEGFYNSLNVSSTPSPVGTGNKENVPSNINLPPKSRSPKRMLSRRLSTAIEGACAPSPVTHSKRISNIGGLNGEAIQEAQLPRHNEWKDLLGSQREAVNSSFSERQRRWKEELDEELQRKREIMRQAVNLSPPKDPILNRCRSKSRFASPGR

SEQ ID NO: 19621 - protein, 400 aa, Sulfitobacter sp. EE-36
MELLSKTLARVKPSPTIAVTQKAAELKAAGKDVIGLGAGEPDFDTPQNIKDAGIAAITAGKTKYTAVDGILELKQAICAKFKRDNGLDYTPSQVSVGTGGKQILYNALMATMNPGEEVVIPAPYWVSYPDMVLLAGGTPVIAPATLENDFKLTPEALEEAITPNTKWFIFNSPSNPTGAGYSWDELKALTDVLVRHAHVWVMTDDMYEHLAYDDFKFCTPAQVEPALYDRTLTVNGVSKAYAMTGWRIGYAAGPEKLIGAMRKVQSQSTSNPCTVSQWAAVEALNGTQDYIAENNKMFTRRRNLVVDMLSEIDGIVCPKPEGAFYVYPSIAGLIGKTTPSGVTITDDEVFATALLEDTGVAVVFGAAFGLSPNFRISYATSDEALKEACTRLQQFCAALS

SEQ ID NO: 19622 - protein, 1024 aa, Ralstonia solanacearum
MPRDTPQAVPGHSPFWPLFFFTHNNKREARHDLARLSLTLMPILPRLFHRTSRTSSADTQRDARTPPNASPLHGEPGRTPRSRGELGRNLRLRSNAQTSGTPGTPARPQIRASASRTAPSTPQHPQGTEGTRTVPNSPLHNDARVFRERADHTGLSAWRTEMLTRFIEHSRKHGLANDFEQVRVYDRLSRAVDHLKSVLRMSGDSVHLKSLPVPELPDVTFEIAHLKNLETVDCDLHALPATLENLFLLETLSLKGAKNLKALPDAVWRLPALQELKLSETGLKSLPPVGGGSALQRLTIEDSPLEQLPAGFADLDQLASLSLSNTKLEKLSSGIGQLPALKSLSLQDNPKLERLPKSLGQVEELTLIGGRIHALPSASGMSSLQKLTVDNSSLAKLPADFGTLGNLAHVSLSNTKLRDLPASIGNLFTLKTLSLQDNPKLGSLPASFGQLSGLQELTLNGNRIHELPSMGGASSLQTLTVDDTALAGLPADFGALRNLAHLSLSNTQLRELPANTGNLHALKTLSLQGNQQLATLPSSLGYLSGLEELTLKNSSVSELPPMGPGSALKTLTVENSPPTSIPADIGIQCERLTQLSLSNTQLRALPSSIGKLSNLKGLTLKNNARLELLSESGVRKLESVRKIDLSGCVRLTGLLSSIGKLPKPRTLDLSGCTGLSMASLPRSLVLPRDGLNVIFPEHLKTDVGNARIQQNPRARLLEGHLERQNEAMNHAMFGDDESVGSMTSVPDNEAGVVSMAFHAKHAYKRLERLRQEAGSSMAAPMRNNDAESMRRALAYAFRSMSDLPTFKKLDNAARSLSYEVQEQLADLVAAPVGQKLVKAIAEGAYGAGRDARAIEQMLPELATRIANHPEIQQLREQAKRYPSSLPPEKLAAKLTPLIQPLWDGTRAVAPMPGRLRQALQVLLVTAEGRQLASEIDRAAHSHRAGDEGKALRGLLPVLAAKIGSDPRVVRVREFVSRHTFGSPQQRAESLAQTLTPVVQELWAQTQAEVAKQGQTPAASPSRQR

SEQ ID NO: 19623 - protein, 328 aa, Oryza sativa (japonica cultivar-group)
ISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 19624 - protein, 134 aa, Mesembryanthemum crystallinum
MKRNGGNYASLCYLRNVMAVIMVGMIWMNEAMASNSASAFVNNVIYSNRIAVFSKSYCPYSVRAKRVFSDLQERPFVVELDLRDDGSEIQDVLLELVGRRTVPQVFVNGKHIGGSDDLHSAVMSGLLQKHLSTS

SEQ ID NO: 19625 - protein, 525 aa, Burkholderia pseudomallei K96243
MRIFRFVKIVFTVIRFGLDEVMLSRIENPRVKLLLRITTIGRRFADPPAVRLRRALESLGPIFVKFGQVLSTRRDLLPVDFANELAKLQDQVPPFDSAVAIAIVEKSLGARIDVLFDEFERVPVASASIAQVHFAKLKQGEHKGKAVAVKVLRPNMLPVIDSDLALMRDIATWAERLWADGRRLKPREVVAEFDKYLHDELDLMREAANGSQLRRNFAGLDLLLVPEMFWDYSTPAVLVMERMTGVPISQVDTLRAAGVDIPKLAREGVEIFFTQVFRDGFFHADMHPGNIQVSLDPKHFGRYIALDFGIVGALSDFDKNYLAQNFLAFFKRDYHRVATLHLESGWVPPDTRVEELESAIRAVCEPYFDRALKDISLGQVLMRLFSTSRRFNVEIQPQLVLLQKTMLNVEGLGRSLDPELDLWKTAKPYLERWMTEQIGLRGWYERFKVEAPQWSKTLPQLPRLVHQALISHHEAPRAISDDLIRQILVEQRRTNRLLQALLVFGLAVGAGAVIARVLIVLAYGG

SEQ ID NO: 19626 - protein, 512 aa, Zea mays
MDKGAALASSDGVHHDRPGAIAGSAVGTGTGSSSFASWRAYGRALAQTPRRVARRALAATAPGEEMSRVRARSGADMARALRWWDLVGLGLGGMVGAGVFVTTGRAARLYAGPGVVASYAIAGLCALLSAFCYTEFAVDMPVAGGAFSYLRVTFGELAAFLTGANLIMEYVFSNAAVARSFTAYLGTAVGVDAPREWRIAVRGLPEGFNQVDLVAVAVILLVSVCICYSTKESSAVNLALTAVHVAFILFVIGMGFRHGDARNLTRPADPARSPGGFFPHGAAGVFNGAAMVYLSYIGYDAVSTMAEEVQRPARDIPAGVSGSVVVVTVLYCLMAASMSMLLPYDAIDPEAPFSGAFKGRERCAWVSNVVGAGASLGILTSLMVAMLGQARYLCVIGRSGVMPAWLARVNPRTATPVNASAFLGLFTAALALFTELDILLNLVCIGTLFVFYMVANAVVYRRYAGAGATWPTLAFLLVFSLAALAFTLAWKLAPPEPRGLRAGLLAACAALA

SEQ ID NO: 19627 - protein, 302 aa, Oryza sativa
MDLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKIADLGLSRSFTVPLKKYTHEILTLWYRAPEVLLGAAHYSTPVDIWSVGCIFAELATNQPLFAGDSEVQQLLHIFKLLGTPNEQVWPGVSKLPNWHEYPQWNPSKVSDLVHGLDADALDLLEKMLQYEPSKRISAKKAMEHPYFNDVNKELY

SEQ ID NO: 19628 - protein, 535 aa, Oryza sativa (japonica cultivar-group)
MAVSLKSSGSFCSTPPQWLHSTRDRILYGYSHSNAKECTCKKTKRPAPLCVKATSTKVELDFNDPSWKQKFQEDWDKRFNLPRITDIYDLKPRPTTFSLKKNRSPAGDENGTPMDKWNGYVNSDDRALLKVIKYSSPNSAGAECIDPDCSWVEQWVHRAGPRKEIYYEPEEVKAAIVTCGGLCPGLNDVIRQIVFTLETYGVKNIVGIPFGYRGFFEKGLKEMPLSRHLVENINLAGGSFLGVSRGGAKTSEIVDSIQARRIDMLFVLGGNGTHAGANAIHEECRKRKLKVSVVAVPKTIDNDILLMDKTFGFDTAVEEAQRAINSAYIEARSAYHGIGLVKLMGRSSGFIAMHASLSSGQVDVCLIPEVPFTLDGEYGVLRHLEHLLKTKGFCVVCVAEAAGQLFYVHYRSLQKSGATDASGNVILSDIGVHMQQKIKMHFKDIGVPADVKYIDPTYMVRACRANASDAILCTVLGQNAVHGAFAGFSGITSCICNTHYVYLPITEVITVPKRVNPNSRMWHRCLTSTGQPDFH

SEQ ID NO: 19629 - protein, 466 aa, Azorhizobium caulinodans
MPVDILMPALSPTMEKGNLTKWVKKEGDTVKAGDVIAEIETDKATMEVEAVDEGILGKILIPEGTQDVAVNTPIAVILGEGEDASAASTPAPQQKVAESAAPASPVAAAAPAPQASVPSAVANPPVVTSQPDPEVPAGTEMVTMTVREALRDAMAEEMRRDGDVFVMGEEVAEYQGAYKITQGLLQEFGAKRVVDTPITEHGFAGMGVGAAMAGLKPIIEFMTFNFAMQAIDQIINSAAKTLYMSGGQVQCSVVFRGPNGAAARVAAQHSQDYAAWYSHIPGLKVVAPYTAADAKGLLKAAIRDPNPVIFLENEILYGHSFEVPKLDDYVLPIGKARIARAGKDVTLVSWSIGMTYTLKAAEELAKQGIEAEVIDLRTIRPMDVPTIIESVKKTGRCVTVEEGWPQSGVGSEIAAQLMEKAFVYLDAPSAARTGKDVPMPYAANLEKLALPNVAEVIEAVRAVTYR

SEQ ID NO: 19630 - protein, 444 aa, Oryza sativa
MRYSNIQSGPGPINPTKTHAHSSPLLGVLFSPSLSSPLTSQSHPLPFSCPSHLPPSVQGGGVKMASSTQGQVITCKAAVAWEANKPMTIEDVQVAPPQAGEVRVKILFTAFCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 19631 - protein, 175 aa, Leptospira interrogans serovar Lai str. 56601
MGTVNVVRVASRHKLSWYEKFYFYSIGKGLWITLKHFIKAAILRKAVTIEFPEKKRKYSTRFRGMHTMKRDEQGRERCTSCFCCMWICPADAIYIEAAEVTPEIQHLHPEDKYAKKFEIDLLRCIFCGMCEEACPKGAIYLDGPGEMATDNREDLILTKERMMQLVGGPIIGERQ

SEQ ID NO: 19632 - protein, 111 aa, Brassica juncea
SGVTKLSSSAQWQLHFNGMKDSNQLLVIDFSASWCGPCKSFEPAVRHMAVKFTDVSFVKVDVDELPEVAKEFDVTAMPTFVLMKNGKEVDRIVGAKQDELENKVTKHRGGQ

SEQ ID NO: 19633 - protein, 335 aa, Triticum aestivum
  misc_feature (234)..(234): Xaa can be any naturally occurring amino acid
  misc_feature (265)..(265): Xaa can be any naturally occurring amino acid
  misc_feature (293)..(293): Xaa can be any naturally occurring amino acid
  misc_feature (300)..(300): Xaa can be any naturally occurring amino acid
  unsure (1)..(335): unsure at all Xaa locations
MATLRPLTVEDVLRVNGSRRFAAALAAASPFDSLANTLLTARRIWLNEVDVTGWLEAFAAHPPIGTTSSSVSKWSKEEQSAALSTATDSTAQELSEWNAKYREKFGFVFMICASGRTAPEVLAELKRRYANRPIVELEAAAEEELKITELRLAKLFSAETAAPPTSGENHISQPDKAADRMRIIGAHLGALSQHSANKAPEITGSSNRTRPPITTHVLDTALGSPAAGIEVHLXEMWKDASSPPAFDNKEFKGWTTLGTSVTNNXDGRSGQLMDIVDNVAPGFYRISFNTSKXAPSGFFXPYVSIIFEIKRSQTTEHFHVPLLHSPFSFTTYRGS

SEQ ID NO: 19634 - protein, 747 aa, Bacteroides fragilis NCTC 9343
MDTENQKEIAEEQMIEQAFQELLNDYLATKHRKRIEIITKAFNFANQAHKGIKRRSGEPYIMHPIAVAKIVCNEIGLGSTSICAALLHDVVEDTDYTVEDIENIFGAKIAQIVDGLTKISGGIFGDRASAQAENFKKLLLTMSDDIRVILIKIADRLHNMRTLGSMLPNKQYKIAGETLYIYAPLANRLGLYKIKTELENLSFKYEHPEEYQEIEEKLNATAAERDMVFNEFTAPIREQLDKMGLKYRILARVKSIYSIWNKMQTKHVPFEEIYDLLAVRIIFEPRNIDEELNDCFDIYVSISKIYKPHPDRLRDWVSHPKANGYQALHVTLMGNNGQWIEVQIRSERMNDVAEQGFAAHWKYKEGGGSEDEGELEKWLRTIKEILDDPQPDAIDFLDTIKLNLFASEIFVFTPKGELKTMPQNSTALDFAFSLHTDIGSHCIGAKVNHKLVPLSHKLQSGDQVEILTSKSQRVQPQWEVFATTARARAKIAAILRKERKTFQKEGEELLNEFFKKEEIRPEAAVIEKLCKLHNMKNEEEFLVAIGNKTIVLGDADKNELKEKQSSNWMKYLTFSFGNNKDKQQEEKEPQEKEKINTKQILKLTEDALQKKYIMAECCHPIPGDDVLGYMDENDRIIIHKRQCPVAAKLKSSYGNRIIATEWDTHKKLSFLVYIYIKGIDNVGLLNEITQVISRQLNVNIRKLDMETDDGIFEGKVQLYVHDVEDVKAICNNLRKIPNIKSVTRVEN

SEQ ID NO: 19635 - protein, 186 aa, Glycine max
MSAYRDEDPRLHGIKTKIRVVPNFPKPGIMFQDITTLLLDPRVFKDTIDLFVERYKGKNISVVAGIEARGFIFGSPIALAIGAKFVPLRKPKKLPGKVISQEYILEYGRDCLEMHVGAVEPGERALVVDDLIATGGTLCAAMDLLERVGAEVVECGCVIELPELKGRERLNGKPLHVLVECFECCE

SEQ ID NO: 19636 - protein, 150 aa, Thermosynechococcus elongatus BP-1
MERTFLAIKPDGVQRGLVGTIIQRFEQKGYTLVGLKLMRVSRELAEQHYGEHKDKPFFPGLVNFITSGPVVAMVWEGRGVIANARKLIGATNPLNAEPGTLRGDFAVDVGRNVIHGSDSPENAEREINLWFQTQELVPWEPALTSWVYEM

SEQ ID NO: 19637 - protein, 458 aa, Mortierella alpina
MTTSDPSVRAFTRSEVLHADALNEGKKNAEAPFLMIIDNKVYDVREFIPDHPGGSVILTHVGKDGTDVFETFHPEAAWETLANFYVGDIVESDRAIENDEFAAEVRKLRTLFYSLGYYDSSKVYYAFKVSFNLCIWGLSAFIVAKWGQTSTLANVISASLLGVFWQQCGWLAHDFLHHQVFHDRFWGDLFGAFLGGVCQGFSSSWWKDKHNTHHAAPNVHGEDPDIDTHPLLTWSEHALEMFSDVPDEELTQMWSRFMVLNQAWFYFPILSFARLSWCIQSILFVLPNGQAHKPAGARVPISLVEQLSLAMHWTWYLATMFLFIKDPVNMMVYFLVSQAVCGNLLAIVFSLNHNGMPVISQEEAVEMDFFTKQIITGRDVYPGWFADWFTGGLNYQIEHHLFPSMPRHHFSKIQPAVESLCKKYGVRYHTTGMIAGTAEVFSRLNEVSQAASKLGKSA

SEQ ID NO: 19638 - protein, 329 aa, Acinetobacter sp. ADP1
MTQSALDQLKKLTTVVADSSDIEAIRKFLPLDATTNPSLITAAASIPENKALIEDAFNQAHQEGYENDLLIERTIDILTVKFGVEILKLIQGRVSTEVDASLSYNTEATIEKARELSKLYKEYGIDQSRILIKIASTWQGIQAAKVLEAEGIPCNLTLLFGLHQAQACADAKVTLISPFVGRILDWYKKAENVDHYPIEKDPGVVSVKKIFTYYKQQGTPTQVMGASFRSIDQVLGLAGSDLLTISPALLSELEQDHRTVEATLTIEEAKQAEIIHRAAQTEQSFKDELEHDLMAFQLLQSGIDGFIKAREQLSTLLRQSYGIDAEIQP

SEQ ID NO: 19639 - protein, 284 aa, Bradyrhizobium japonicum USDA 110
MHPKSSFLVGLIGSGIAASRTPPMHEAAADAAGIRYLYKKIDLTELKLGAEALPDLLTAARRMGFDGLNVTHPCKQAILPLLDELSPDAEALGAVNTVVIRNGRMTGHNTDWFGFAENFRRNMQGAPLGRVVQFGAGGAGAAVAFALMKLGLQELTIIDVDLAKAQSLVDSLSPRFAEGRLRAGRDIAADVAAADGIVNATPIGMDKYPGTPLSTALLRPDLWVAEIVYFPLETALLRAARALGCRTVDGGGMAIFQGTEAFRLFTGISPDPDVFFATFASLGG

SEQ ID NO: 19640 - protein, 275 aa, Bradyrhizobium japonicum USDA 110
MSDRYAVIGNPIGFSKSPLIHGTFAKMTGQDLVYEAIEAPLDGFNARVDQFRREGAKGLNITAPFKLDAFAYANELSESADRAGAANCLKFDGDRIIAENFDGIGLVRDITVNLGVKMAGRRVLMLGAGGAARGALLPFLRQEPSELVLVNRTLSKAVALAEEFAGCGPLIVSGYTELADLAEGYDVVINATSASLRGEMPPLPGNVFRGAELAYELAYGKGLTPFLQAARAEGVAKLADGVGMLVEQAAEAFAWWRGVRPSTAQVIAELTVPLS

SEQ ID NO: 19641 - protein, 139 aa, Mycobacterium smegmatis str. MC2 155
MTERTLVLIKPDGVKRQLVGEILSRIERKGLTLAALELKNVSDDLARQHYAEHADKPFFGSLLEFITSGPLVAAIVEGPRAVAAFRQIAGGTDPVEKAVPGTIRGDFALITQDNLVHGSDSPESAAREIALWFPGEATA

SEQ ID NO: 19642 - protein, 308 aa, Mycobacterium smegmatis str. MC2 155
MTLDEPTRAFLERATATPPLPPGSLPLKEFRAAVESLRPSTFDRIELAEVRDLTCPGPGATTVSARFYRPEAGTSAPLVVWAHGGQWVRTTVDLLDTFFRHVAHRSGCAVLAVDYEHAPESRFPAQIEQIYAAALWAQEQNGQLDCDTGRLAIAGDSSGANLAAAVALLARERGRLQFQHQLLLVPLLDTLFDSASWRELGQDYLLSVEQLTWALRNYAPGVDRRHPLLSPLHAEDLSALPPTTIIVGEFDPLRDDGLAYARRLEADGVAVKTIDVESLLHHAMVIPKALPQGRVAVEAAADALANCW

SEQ ID NO: 19643 - protein, 118 aa, Spiroplasma citri
MKMNLTEEITKPQLRSDLPQFSSGDTIKVHYKIQEGNKFRIQAFEGVVIKLQGSGIVKSVTIRKISNGAGVERKFPLHSPLIDKIEIVKYGRVCRARIYYMRNRTGKAARIKEIIKTK

SEQ ID NO: 19644 - protein, 201 aa, Zea mays
MALRLPISSTHGLASSPAPISSTTTCRPAAASGSLIPPAALVAVAIRWASASASQKRGLLLTTARGGGVLAPVRSSGIETTSTSVGAEAVTGQVTEVNKDTFWPIVEAAGDKVVVLDMYTEWCGPCKVMAPKFQEMSEKNLDVVFLKLDCNQDNKPLAKELGIKVVPTFKILKGGKVVKEVTGAKIDELAEAIEIANKKSG

SEQ ID NO: 19645 - protein, 374 aa, Wigglesworthia glossinidia endosymbiont of Glossina brevipalpis
MAKSDYYDILGISKNASDREIKTAYKRLAVKFHPDRNPGNLEAESKFKEIKEAYEVLLDPKKRAAYNQYGHTAFDQGSSNTEFTSNADFSDIFGDVFGDIFGNNRRKRSNRGSDLQYNINLSLEEAVKGISKEITIPKLERCNICSGKGMQPGTSAQNCSTCNGQGQIQMRQGFFSVQQTCPSCRGKCKIIRFPCRNCSGQGRVERSKNISIRIPAGVDNGDKIRLSGEGEAGKLGGSSGDLYVKISVKEHPIFKREEHNLYCEVPINFAMAALGGDIEVPALDGRVKLRIPAETQTGRLFRMRGKGVKSIRSGHQGDLLCRVVVETPVRLSEKQKSLLKELGISFVGRTGMYNSPRSKSFFDGVKKFFDGLTN

SEQ ID NO: 19646 - protein, 242 aa, Oryza sativa (japonica cultivar-group)
MGRSFRDSLKVLEADIQHANSLAAEFRREYDGACLQMRMSYCPAAHFFLFLVQWTDCNLAGALGLLRILIYKVYADGTTTMSAHERKASIREFYAVIFPSLMQLHEGINEVEDKKQKAICIERYRRRDEDQKMVISEIDDNIEEECGICMEINGKVVLPTCSHAMCIKCYRDWRSRSQSCPFCRDSLKRVNSADLWIYTDNRDIVDIATVRKENLRRLFMYIDKLPTVIPETVFDVYDSHVK

SEQ ID NO: 19647 - protein, 136 aa, Salmonella enterica subsp. enterica serovar Paratyphi A str.
MKRYILATAIASLVAAPAMALAAGNNILSVHILDQQTGKPAPGVEVVLEQKKDNGWTQLNTGHTDQDGRIKALWPEKAAAPGDYRVIFKTGQYFESKKLDTFFPEIPVEFHISKTNEHYHVPLLLSQYGYSTYRGS

SEQ ID NO: 19648 - protein, 279 aa, Triticum aestivum
  misc_feature (94)..(94): Xaa can be any naturally occurring amino acid
  unsure (1)..(279): unsure at all Xaa locations
MERKPTKKHARTRSGALASFLRSTAASFSSSTATTFGSRPAGGGKASFNHRNAFSGPMVSIVPPEARGGGGGRRRGGSKQGGGSGYRTPEASSXPKVSCIGQIKRSKSKTSKARKAAKNVAPAAACGMDGGACPMPPRPPVHSRPKRSLVRRMFSRRSRSRPSSSSSSHKSSGAADLFKGRPGSSAAVAAAPVSGPGMAGLGQMKRFTSGRGAFQDFDWREAERRGSDVDVDDDYVDDGFVAFSAPLVLGGGVVASEPRKEVNLWRRRPMSPPTPLELP

SEQ ID NO: 19649 - protein, 146 aa, Brassica napus
MAWDLFLWILSFFVSLALVASVFYQVICLTDLEADYLNPFETSTRINRLILPEFILQGSLCVLFLITWHWVFFLAALPVTCYHAMLYKERRHLIDVTEVFRGISFEKKLRFTKLGFYIFLFIMVVFRLTLSAGYSFTEDDDLLHLF

SEQ ID NO: 19650 - protein, 361 aa, Zea mays
MSVAAALGRADELRALDDTLAGVRGLVASGAKQVPRIFRVPYPEELLHHEQPPAAATVPVIDLSGDRAAVIDAVRGAAAGWGFFQVTGHAVPEQVMSAAVAAMRAFHEADGGEGSDKARLYSREPGRAVKYHCNFDLYQSPVANWRDTVYLRMAPDPPAADDLPEICRDALFEYAKQVKDLGQRLFGLLSESLGLKPSYLTDIECDQGQIILGHYYPPCPQPELAIGTSRHSDSGFLTILLQDKVGGLQILHDGQWVDVAPTPGAFIVNIGDLLQLVSNDKFSSVEHRVVAKNAEPRVSIACFFSTHFHPASTRTYGPIKELLSEENPPLYRETLVREYVARYYSVGLDGKKKTALADFRL

SEQ ID NO: 19651 - protein, 409 aa, Methanopyrus kandleri AV19
MKRRRREIQSNVQVVDVETGEIEPISHRVPVGPNHPILKEPLRIKLAVRGEEVVDCKVEMGYCHRGIEKIMEGMPWQKAAFLAERVCGICSHAHNMCFIGGVEKLAEGDPAPRGLFLRVLVQELDRIQSHLIANAAYFYSIEHETMFVWNMNTRERVLDCIEEITGNRILTGWNVVGGVRMDVTEDQLNNVLETLDAIRDDVITYRRIAKNDPFIKLRSRGVGVITKDHIRKYRVVGPQARASGVPESDMRLQEPVYPELGFKPVYRKEGDNLARILVRYDECLQSIELIERIVDELPEGRHRRELEVNAGHVDNRVEAPRGELVYDMELAPGGVVKRVTIRTPSVPNIRVLEAIAPGSPSIADAVATYASLDPCVACNERFVVIDEREGKVLLEGKAREVIRACSRTS

SEQ ID NO: 19652 - protein, 459 aa, Magnetospirillum magnetotacticum MS-1
MPTRASNRTITEKDVDSVLHPYTNLKRHPEVGPLVITRGKGVRVYDEAGKDYIEGLAGLWCTSLGWGEERLVEAAARQMRTLPFYHLFSHKTHDVGVELCARLLEMAPVPMSKVFLAGSGSEANDTAIKLIHYRSNALGLPHKKKIIAREKAYHGVTVATASLTGLVNNQRSFDLPIPGVLRAGCPHHYRFARQGESEEDFSSRLAAELEALILAEGPDTVAAFFAEPVMGAGGVIVPPAGYFPKIQAVLDRYDILLVVDEVICGFGRTGKMFGTETFGIRPDMMTLAKGLSSGYAPISALMVNERVYGPVAEESGRIGVFGHGYTYGGHPVSAAVALETLNIYAERDILAHIAKVGPVLQEGLGSFRDHPLVGEARGIGLIGALELVADKTSRAPFPPERTMGAKVVARAQDKGVILRAMGDAIAFAPPLIITEAEIGDMLRRFKAALDEAHGALGLG

SEQ ID NO: 19653 - protein, 457 aa, Umbelopsis isabellina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSILLVLPNGQAHKPSGARVSISLVEQLSLAMHWTWYLATMFLFIKDPVNMMVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 19654 - protein, 515 aa, Nocardioides sp. JS614
MSGMRDIAELVSVAAAEHPDRLAVVEAGGRSLTWAGLEDEVGRIATGLGAAGILGGTRVLLAVGNRLEFVTTYLGVLRAQAVAVPVNPRSTVSELSRMVADSGARMVVGEPDTVEALREAVAGLDPAPLLVVIEAEPLPGERAHDELRALPARPVPPLQDPEKLAVLLYTSGTSGLPRAAMLTHRALLANLDQVAQVEPPMIHGDDVVLGVLPLFHVYGLNAVLGGILRHRAKLVLVERFDPHETLSLIDDEACSVVPVAPPVFAYWLGEEHLAEHLGPVRLVLSGSAPLAAELIDKFTARAGVPVHQGYGLTEAAPVVTSTLCSVTPQVGSVGAALPGVELRLVDESGRSPDGDDPGEIQIRGANLFSGYWPDGEGGPDDDGWWSTGDVGFLDPSGDLFLVDRIKDLVIVSGFNVYPVEVEEVLTEVDGVVEAAVIGVDDPVTGEAVVAYVRAPDADPAAIEEAVRVHCEQRLARFKRPSRIEVVDALPKTGTGKVQKGRLRGIERRRTLGLLE

SEQ ID NO: 19655 - protein, 950 aa, Acinetobacter sp. ADP1
MLVLEPQHVHMHQHAGDKAEALQCLINILVEDQLVTPEYLSGLEAREQQSATYLGQGIAIPHGTPQSREYILKTGVRLAHFPEGVVWDGENTIYLAVVIAAKSDEHLQVLQILTRALSKDVNEQVKSAQSSEQIIEILQAQPHSLVLHENLIQTDTFVEDIEDFFWNASKLLKQQKLVDPGFISQLDPQNTIQIQDDLWSISGTGYVKQPAVSIVKAQQPLTFQGSTIKTLICIAANEQLDTDQFNRLMDVLFQPQVQQQLETEQSSNEIAKLVGAETIPDWPSRSIVLANAHGLHARPATQMVNLTKTFNGDIQVSVDGGSFVSAKSLTKLLSLGCQRGQMLTFIAEPNTDATDALEQIILAVRQGLGEEVEAIEDQLTSNSSLNGSQLIEETDSVEISHCGIAASAGLAFGPAHIIKPKKFNYDRFGQSLKTEKEKLEIAIHTVKNTIHQFIAKSTSKDIKQIFLAHLEMLDDPDLIKQVHQGLNHNLSAAAAWHEHIEKAAKAQEGLKDKLLAERAADLRDIGDKVLAVLCNEPEVEEPEQSYILIMHDVGPGDVARLNKDRVAGILTAVGGSSAHSAIVARALGIPAVVGAGDGVLNIDPHAVVLINGDNGEFEVNPSAELIENAIREREYQRLRREEAERHAHEPAITVDQHQIEIAANVGKILDTAKAVSHGAEAIGLLRTELVFMSHNSAPDEKVQEKDYRHVLDALAGRPLVVRTLDVGGDKPLPYLPIATEENPFLGLRGIRLTLRRPNLLRQQLIALLKAADNRPLRIMFPMVGRVEEWRAARAILDEVLQQYPCSNLEVGIMIEVPSAALLAPILAKEVDFFSIGTNDLTQYTMAIDRGHPILSAEADGLHPSILLLIDQTVRAAHANNKWVGICGELAADPKAVPVLMGLGVDELSMSITSIPLVKAQIRTLNYAACQELAQKALLCDSATAVRTLVE

SEQ ID NO: 19656 - protein, 345 aa, Gossypium hirsutum
MENSTQESHLRSDNSVTYESAYTVYAMALSSTPSSTNINHQRIALGSFLEDYTNRVDIISFDPETLSFKTHPKLAFDHPYPPTKLMFQPNRKSASSSSSCSDLLASTGDFLRLWEVRESSIEPVTVLNNSKTSEFCAPLTSFDWNDVEPKRIGTSSIDTTCTIWDIEKCVVETQLIAHDKEVYDIAWGEARVFASVSADGSVRIFDLRDKEHSTIIYESPQPDTPLLRLAWNKQDLKYMATIQMDSNKVVILDIRSPTTPVAELERHHASVNAIAWAPQSCKHICSAGDDTQALIWELPTVAGPNGIDPLCVYSAGYEINQLQWSRAQPDWIAIAFSNKLQLLKV

SEQ ID NO: 19657 - protein, 232 aa, Brassica napus
  misc_feature (123)..(123): Xaa can be any naturally occurring amino acid
  misc_feature (201)..(201): Xaa can be any naturally occurring amino acid
  unsure (1)..(232): unsure at all Xaa locations
MAFRRALSIRSTLISRRNQLAFHIIPRDNDHDHDHEEGSFTSQRSYHSFLHQKTAVSSDLSHFPGGGLRVPLAPSSASAFAFYRYMSSAHGVGSEKIGVINDIAEVITDSTTLQDVPAQAAAXLRFGEVALAANDSFLPIAALQHCIDMVHCYTGLEWWASIVLATVLIRSSTVPLLIKQMKDTMKLSLMKPRLEAIREEXMQNKGMDQVTMAEGQKKMKNFFKEYGVTPFT

SEQ ID NO: 19658 - protein, 512 aa, Spiroplasma citri
MKTANKIIILDFGSQYTQLIARRIRHLEVYCEVWPYNTTLEKIKTTPMKGIILSGGPASVYAEDAFLIDKKLFELEVPILGICYGMQLISHLHGGTVQRATKQEFGFSELIIDNQEDLFAKVPIKSQVWMSHADHIEIMPTDFIQIAHSENSISAIKHLEKKIYGLQFHPEVTHTLIGEQLLSNFVFNICGCEPTWKITEFISTATTEIKGKVGSDNVVLALSGGVDSSVCAVLLHKAIGKQLTCIFVDTGLLRQDSGWNDLQKFQEKFKLNIIKIAAQERFLTALKGVTNPEQKRKIIGNLFIEIFNEEAIKIKNVKWLGQGTIYPDVIESISVKGPSATIKSHHNVGGLPKNLPFQLIEPLRELFKDEVRRTGEALGIDSKFVYKHPFPGPGLAVRIIGEITAEKVALLQAADQIFIDELYQTNLYDQVAQAFVVLLPVQSVGVMGDVRTYGYTAVVRSVDTTDFMTANWSRLPFELLEKVSTRIVSEVHGINRVTYDITSKPPGTIEWE

SEQ ID NO: 19659 - protein, 380 aa, Glycine max
MGKRQSLRNKATHLVSVLLNPISDSDTLNPKTSKHPQPTPTPAPPSGEVGVGGSETNDEEGNRGLVDGPDTSSFTAFLYSLLSSSDTGDNANSSRVLSDDNKAAAPDHNPLPDSSTLKENGGRKSLISRSKQSLGKAIRKIGGFRHQDRWDNLEMKLDDGNGSKVSGAVEMRRIEPVTVPLVDLPEISEPSVLLSDSIRNVVYVSLPPLIHGRKWLLLYSTWRHGISLSTLYRRSMLWPGLSLLVVGDKKGAVFGCLVEAPLRSSSKKKYQGTNNTFVFTNISGHPVIYRPTGVNRFFTLCNTDYIAIGGGGHFALYLDAPQTPPLNGSSSVSETYGNPCLANSQDFEVKEVELWGFVYASKYEEVLAMSKTEAPGICRF

SEQ ID NO: 19660 - protein, 163 aa, Methanococcus maripaludis
MIIGIISDTHIPERAKKLPKEIFEHFSDVDLIIHCGDVTSESVLNELKKISEILVVSGNMDYMNYPKEHELNIENFKIGIIHGNQIHPRGDTLKMKYLCLEKNWDVLISGHTHVPMIKELHAENKKILLLNPGSPTVPRYPLKTIMKLKIEERKIDAELISIK

SEQ ID NO: 19661 - protein, 273 aa, Deinococcus radiodurans R1
MLPAPRFDRDTRLCMSLAAGPGNFGTRFHNYLYELLGLNYMYKAFTTQDLPAAIGGIRALGIRGCAVSMPFKEAVIPLLDELMPSAAAIESVNTIVNDDGVLRAYNTDYEAVRLLIREKELDPSWRVGVRGSGGMGKAVASALRDAGFENGVLVARNEAAGRELAGRLGWRWTPEPEAADLLVNVTPIGMAGGPEEHDLSFAPELIAQARAVFDVVALPAETPLIAEARRQGKPVVTGEEVAALQALEQFVLYTGVRPTPEQVQAAAAWARQG

SEQ ID NO: 19662 - protein, 394 aa, Wigglesworthia glossinidia endosymbiont of Glossina brevipalpis
MKIIKVTDLNLKDKKVLIRSDLNVPIKNGKIMCNMRIIKSLETINFVIKNEAKCVIVASHLGNPIEEKYDYNFSLTHIVNHMKKIIKYPIRLIQNYLNGFEAKEKEIIVLENVRFNPGERKNDKNLSKKYANLCDILVMDSFGSSHRSESSTTGIIKFAPISCIGLLFLKEIKYLKKALFNSKRPIVTIFGGSKISTKLGVIEKLSNISENVLVGGGIANTILFSKGHNIGKSLHDKNNISKIKKFLYKKNIIIPKDFIVTDNINKFSSYKEKSIKEIKNEDYIVDIGKKSCECFIKIIKKAKTIFWNGPLGLIEIKQFRNGTKEIANSVIHSSAKSIIGGGETVLAMRMFNFIDRFSYISTGGGAFLSFIEKQELPVLSELKKFKKYTNFKQN

SEQ ID NO: 19663 - protein, 300 aa, Triticum aestivum
MRAIAAAKGPHGNDPMSSSRRHFRWPVLGKSGSRGAGAASGDEGYVRGSEAEEEEEEDERAMAFSSACPSFHSEDFVSPPKKPVTGTAAPAQEKQQQRRKVRTAVARLRSALSAAVSGRRRQVGLGARLTGTLYGHRRGHVHLAFQTDPRACPALLLELAAPTGALVREMASGLVRIALECERAKAATGGGDGGGRKLVEETVWRAYVNGKSCGYAVRRECGAADWRVLRALEPVSMGAGVIPAASCGGGEGDVMYMRARFERVVGSRDSEAFYMMNPDSSSSGSGINGGPELSVYLLRV

SEQ ID NO: 19664 - protein, 413 aa, Rhodococcus sp. DK17
MPESTTVIVGASIGGVRTAQALRSEGYPGAIVLIGAEGELPYDKPPLSKSILAGDSTMAEITLLTTEQARELDLELRLGQPAIRLSTANQDVELADGTRVAFDNLVLATGARARPSPWGTPNGLHVIRTAADARALRRHLGTTDHLVIIGGGFIGAETAATAVELGIRVTLVDPEPVPMARVMGAEIGELFIDLHRCRGVDTRFGVGVESVHGEHRSFAIGLSDGSTLAADTVVVGIGAIPNDDWLESSGLEVSNGVVCDVYCRAIGHDNIYAVGDVCRFDNTRRGGSTRLEHWTNAVEQAVVVARNIARPDEKIRHEPVEYVWSDQYDWKIQTVGLAGSSTHTVIGEVTNKARFAVCYPDENGKLTGVVVVNWPKALVTARKAIALGVEYAEFAARLEAMTVSARTTVKETT

SEQ ID NO: 19665 - protein, 327 aa, Chlamydia muridarum Nigg
MSSQFDQLKLWSVLVGDSGDPDLIKTLDVQDATTNPSLILKVAQEPKYQSMLTEAISWGIRQNGDDVQTLTFVLDKIQVNLGLEILKYVPGRVSLEIDARLSFNTEAMVQRAIFLSQLFEKMGGDKKRLLIKIPGTWEGIRAAEVLENQGIACNVTLIFSLVQAIAAAKAKVTLVSPFVGRIYDWWIAAYGAEGYSIEADPGVASVANIYSYYKKFDIPTQIMAASFRTKEQVLALAGCDFLTISPKILEELKKEQQPVERKLSVEEAKKLDIQPVELSESVFRFLMNEDAMATEKLAEGIRIFSGDTQILESAVTEFIRQIAAQEA

SEQ ID NO: 19666 - protein, 1115 aa, Magnetospirillum magnetotacticum MS-1
MRRFNDDLLLSSGDLTTFLGCRHASALDYRALDENLETAAPDATLEFLQQKGIAHEQAYLAKLKNEGRLVAIISDHAKLPERVQMTLEAMRRGDEVIYQAALHDGCWHGFADFLERSPVPSALGGWSYDVADTKLSTSMSAKYAVQLSIYSNLIAAVQGRAPTRMSICLGNGNIETLRPGDYVHYIGHAQRRLEAFLADNADRGATLAEPCAHCGMCQWRDRCKAEWVATDHLSLVANIRSTQREKLLVAGVNTVTELAEFPDDQCVPGMNPDILRRLRAQARLQVAVRGNDQHLYELLPAPAGRGFARMPRPAEVDLFFDMEGDPLYPGGLEYLFGVHVGHPETGKFLAFWGHDRAGEKKALEDFLDFVTEHLAQHPDAHIYHYNHYEITAVRRLAMAHATREAVVDDLLRHQKFVDLLKVVREGLLVSEPRYSLKNIEHFYMGKRDGDVATAADSIVAYEKWRATPDQQTLDDIEHYNAIDCRSTALLRDWLLSIRPAETTWFDPADVAPDEETLARQAEAETERLAIEARLLTDVSEVERPFRQLVADLVEFHRREAKPGWWALFDRQDREENELIDDTECLGGLRLQDEPVKEKQSLVHTYHFPPQETKLRKGGKPLAVDTLERVGTVERLDMDRGVLVLKRAVRKGPLPQTLNIGPESPIANKVLRGAIRRFADSVADGSGKFLAVERILRRAPPYLTDYAPGQPLVVEGQGLVDAAITAVGAMDNSHLFIQGPPGTGKTYTSSHVIVEMMRRGKTIGVASNSHKAINNLLAGIEKAAKERGFIFSGIKKSTDEENAFGGSMIRDVYDNAEVLTGTQLIAGTAWMFAREEFEQTIDYLFIDEAGQVALGHLVAMGTAARNIVLVGDQQQLGQPVQGVHPGESGANALDHLLQGAATVPPDRGIFLDVSWRMHPAVCRWISDAIYEGRLHSHPSTAQQALLLDNSAHAVLASAGLRFLPIDHVGRSQRCPEEAETIKAIWHNLLGQRWRDRHGVERSITPEDVLVVAPYNVQVNTIRDALPDGARVGTVDKFQGQEAVVAIVSMTTSSGDDLPRDIEFLFSRNRLNVAVSRAQCLAIVVASPRLLEVTCGSVRDMRLVDTLCHAYQWGIGQ

SEQ ID NO: 19667 - protein, 429 aa, Mycobacterium bovis AF2122/97
MPIIEQVGAREILDSRGNPTVEVEVALIDGTFARAAVPSGASTGEHEAVELRDGGDRYGGKGVQKAVQAVLDEIGPAVIGLNADDQRLVDQALVDLDGTPDKSRLGGNAILGVSLAVAKAAADSAELPLFRYVGGPNAHILPVPMMNILNGGAHADTAVDIQEFMVAPIGAPSFVEALRWGAEVYHALKSVLKKEGLSTGLGDEGGFAPDVAGTTAALDLISRAIESAGLRPGADVALALDAAATEFFTDGTGYVFEGTTRTADQMTEFYAGLLGAYPLVSIEDPLSEDDWDGWAALTASIGDRVQIVGDDIFVTNPERLEEGIERGVANALLVKVNQIGTLTETLDAVTLAHHGGYRTMISHRSGETEDTMIADLAVAIGSGQIKTGAPARSERVAKYNQLLRIEEALGDAARYAGDLAFPRFACETK

SEQ ID NO: 19668 - protein, 483 aa, Mesorhizobium sp. BNC1
MSGRKYPNPSLFINGRSVTGRGAKEEMVIDPSNEEVLGSYRSAAPEDLQELLDSAAAGFEKWRRTSAYERCEILHKVAAALRENAQEIGSLLTLETGKILSESITEVRGAADHFDWSGEEGRRLYGYTVPARRAESRLRVELEPLGIVFALIPWNFPLGTSARKVAPALAAGCSVILRPPEEAPATVEAFVRCCQEAGLPPGVLNMVLGSPKDVVEPLMASFSVRAVTFTGSTRVGKILIQQAADTVKHLVLELGGHAPAIVLPDADPKKVGVAAARAKFRNAGQVCVSPSRFIVHEKIVEPFTQAMVEETRSIKLGSGFDAGAQMGPLTTARQRERVERLVEDARSKGARILAGGQRPSGFNRGFFFEPTVLGDVPDTALIFEEEPFGPVAPIIPVRSVQEAVEKANAVKWGLAGYLFTSSLADATKVSEAMQVGMVGLNTFAAAAPEAPFGGVKESGYGRECGLEGIREFVSSKLIHTDIG

SEQ ID NO: 19669 - protein, 437 aa, Leptospira interrogans serovar Lai str. 56601
MKFYRRKVEFEKHGKNRMREKSLQYHALHPKGKIEVVPTKPTEDSYDLSLAYSPGVAYPCLEIKDSPELVYEYTNKGNLVGIITNGTAILGLGDIGALAGKPVMEGKAVLFKKFAGIDVFDIEINTKDPDEFIRAVKLLEPTFGGINLEDIKAPESFYIEEQLIEKMNIPVFHDDQHGTAIITVAGLLNSFKLTGKNPDDVKVVICGAGAAGIAIAELIQHIGIKKEQIFLVDTKGVIHHNRNDLNDSKKKYIQKTDSTTLRDVMKGSDIFIGVSVENMVDEDMVRSMSKNPVIFALANPDPEIPYRVAKAVRSDLIMGTGRSDNPNQVNNVLGFPFIFRGALDVRARHITLEMKLAAARSLAELARLEVPEVVSKAYGGEKFTFGPEYLIPKPFDKRVLFHVAPAVAEAAVASGSARIPYLGREKYLGFLEGIIKS

SEQ ID NO: 19670 - protein, 797 aa, Xanthomonas oryzae pv. oryzae KACC10331
MNENILWLHELRLADLARVGGKNSSLGEMIGNLAGLGVSVPGGYATTAEAFKDFIAHNDLSKRIFDKLATLDVEDVNALTLAGKEIRGWVIDAPLQPELDRDIRTAYEQLCAENGGGDVAVAVRSSATAEDLPDASFAGQQETFLNVTGADDVVHKVKEVFASLYNDRAIAYRVHHGFKHEDVFLSAGVQLMVRSGVGAAGVLFTLDTESGFRDVVFVTSSFGLGEMVVQGAVNPDEFYVYKPTLTAGKPAILRRSLGSKAIRMVYSDVPGERVRTEDTPVELRSTFSISDEDVQELSKQALVIEKHYGRPMDIEWAKDGVSGKLFIVQARPETVKSRSHATQIERFSLEAKDAKILVEGRAVGAKIGGGVARVVRSLDDMNRVQAGDVLIADMTDPDWEPVMKRASAIVTNRGGRTCHAAIIARELGVPAVVGSGNATDVLSDGQEVTVSCAEGDTGFIYEGLLPFERTTTDLGNMPPAPLKIMMNVANPERAFDFGQLPNAGIGLARLEMIIAAHIGIHPNALLEYDKQDADVRKKIDAKIAGYGDPVSFYVNRLAEGIATLTASVAPNTVIVRLSDFKSNEYANLIGGSRYEPHEENPMIGFRGASRYVDPSFTKAFALECKAVLKVRNEMGLDNLWVMIPFVRTLEEGRKVIEVLEQNGLKQGDGADGKPGLKIIMMCELPSNALLADEFLDIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSES

SEQ ID NO: 19671 - protein, 445 aa, Nocardioides sp. JS614
MTAGATLPTAASAALFERARAVTPGGVNSPVRAFNAVGGTPRFIRSARGAWLTDADGNEYVDLICSWGPMLLGHAHPEVQAAVSAAVARGTSYGAPTEPEVELAEEIAARAPVERVRFVSSGTEATMSAIRLARGFTGRDVVVKFAGCYHGHVDSLLASAGSGLATFAVPGTPGVPESSTALTLVLPYNDRAAVEKAFAEHGDRIACLITEAAPGNMGVVPPDADGSGGGFNGFLAETCARHGALFVSDEVMTGFRASRQGQWGLDGAVEGWRPDLMTFGKVMGGGFPAAAFGGRADVMSRLAPEGPVYQAGTLSGNPIATTAGLATLRLATDDVYAHIGAAADTIKTAASDALSRAGVEHVVQAAGTMFSVFLTAGPVRDFADASRTDVAAYAAFFHAMLDQGVYLPPSAYEAWFLSSAHDDRAVQTVLDALPTAARAAAAAQT

SEQ ID NO: 19672 - protein, 431 aa, Acinetobacter sp. ADP1
MFMSQIVDIRAREILDSRGNPTIEADVILASGVVGRACAPSGASTGSREALELRDGDKARYLGKGVKTAVNNVNTIIRDALVGKSVFEQKDIDNTMIELDGTENKEKLGANATLAVSLAAARAAADEKKIPLFQYIADLRGQTILTMPVPMMNIINGGSHADNNVDIQEFMIEPVGFTSFSEALRAGAEIFHSLKSVLNKKGLNTAVGDEGGFAPNLRSNEEAITVILEAIGQTGYKAGSDIMLALDCASSEFYKNGQYILAGEGNKAFTSNQFSDYLAGLVNQYPIISIEDGLDESDWEGWSYLTSILGDKIQLVGDDLFVTNPKILQRGINEKVGNSILIKYNQIGTLTETLDAIYLAKDNGYSTVISHRSGETEDSTIADLAVGTAAGQIKTGSLCRSDRVAKYNQLLRIEELTKAAYRGKAEFKGLN

SEQ ID NO: 19673 - protein, 192 aa, Carboxydothermus hydrogenoformans Z-2901
MRRAEVQRTTLETMINVEFTMDGNGEFSGTSGLGFFDHMLTLFCKFGGFNLNLSCQGDLEVDDHHTVEDIGLVLGEAFSKALGDKKGIARFASGFYPMDEALMLIAVDISGRPYLAFEADFPPVLAGKFNYQMVEEFLRGFVQKAGITLHVREISGKNLHHKAEAIFKGLGRTLKVAVSVQGDELPSTKGVI

SEQ ID NO: 19674 - protein, 518 aa, Glycine max
MPAVGGINTGGGKEYPGSLTLFVTVTCIVAAMGGLIFGYDIGISGGVTSMDPFLLKFFPSVFRKKNSDKTVNQYCQYDSQTLTMFTSSLYLAALLSSLVAATVTRKFGRKLSMLFGGLLFLVGALINGFAQHVWMLIVGRILLGFGIGFANQSVPLYLSEMAPYKYRGALNIGFQLSITVGILVANVLNYFFAKIKGGWGWRLSLGGAMVPALIITVGSLVLPDTPNSMIERGDREKAKAQLQRIRGIDNVDEEFNDLVAASESSSQVEHPWRNLLQRKYRPHLTMAVLIPFFQQLTGINVIMFYAPVLFSSIGFKDDAALMSAVITGVVNVVATCVSIYGVDKWGRRALFLEGGVQMLICQAVVAAAIGAKFGTDGNPGDLPKWYAIVVVLFICIYVSAFAWSWGPLGWLVPSEIFPLEIRSAAQSINVSVNMLFTFLIAQVFLTMLCHMKFGLFLFFAFFVLIMTFFVYFFLPETKGIPIEEMGQVWQAHPFWSRFVEHDDYGNGVEMGKGAIKEV

SEQ ID NO: 19675 - protein, 314 aa, Gossypium hirsutum
MNWSVRRDKKYRLAIASLLEHYNNRLEIVQLDDSNGEIRSDPNLSFDHPYPPTKTIFIPDKECQKPDLLATSSDFLRIWRISDDHSRVDLKSLLNGNKNSEFCGPLTSFDWNEAEPKRIGTSSIDTTCTIWDIERETVDTQLIAHDKEVYDIAWGGVGVFASVSADGSVRVFDLRDKEHSTIIYESSEPDTPLVRLGWNKQDPRYMATIIMDSAKVVVLDIRFPTLTVVELQRHQASVNAIAWAPHSSCHICTAGDDSQALIWDLSSMSQPVEGGLDPILAYTAGAEIEQLQWSSSQPDWVAIAFSTKLQILRV

SEQ ID NO: 19676 - protein, 725 aa, Xanthomonas oryzae pv. oryzae KACC10331
MSPLNAGVPAHPRLSMRRPASAAYANPSRIRQGRPFPRGAVFDGKGTNFALFSAHATRVEVCLFDEQGNETRVDLPEYTNEIWHGYLPDTKPGQRYGYRVHGPYAPTEGHRFNHNKLLLDPYARELEGDLIWADELYGYTVGHPDGDLSFDERDSAPFMPKCVVVEDIYDWGDDTRLLKPWNEMVIYETHVRGYTMGNPQVPEAVRGTFAGLAQPQVLQYIKDLGITAVELLPVHAYLDDQHLLDKGLRNYWGYNTIGFFALKSRYLASGHRDEFRDMVKAMHKQGLEVILDVVYNHTAEGSELGPTLSFKGIDNASYYRLAEDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGETDNAEILQIRERQMKNLLATLLLSQGAPMMLSGDERGQTQGGNNNTYCQDNAITWLDWENDPTDGRLTDFVKALTKLRKRYPILSRGRFLNGQYNEEAGVRDLTWLNPGGIEMDDAHWTDASARSVGLLLEGKAQTSGVKELANDDTLLIVINAYHEGVSFTLPSSDEPVHWKLVLSTDEALEVDMMPAAASEFLAPPRSVSVFECKSDQ

SEQ ID NO: 19677 - protein, 417 aa, Deinococcus radiodurans R1
MADIKVPVFSESVSEGTLLTWHKKPGEAVKRGELLAEIETDKVVLEVTAQQDGVLQSIAKNEGDTVLSEEVLGTMGEGDAAAPAPAAQDQASGPVASETTAGGTAQQPDSTGTQPAAQSGERREDLSPAVRKIVEEKGLDVSQVPATGPKNNITKADAMGASAPAPAAQPAPQAAKSAVVLPSGPRPEERVPMTRIRARIAERLKEVQNTAALLTTFNEVNMQPTMELRKKYQDQFVKKHGVKLGFMSLFVRAATEALKAFPMVNASVDGKDVIYHGYYDIGIAVASERGLVVPILRDTDNMSLADIEKQIAEFATRARAGKLTMEDMSGGTFSITNGGTFGSMMSTPIINAPQSAILGMHNIIERPIAQNGQVVIAPMMYLAVSYDHRLIDGKEAVQFLVMIKNLLEDPARMLLDL

SEQ ID NO: 19678 - protein, 558 aa, Spiroplasma citri
MSYLDNLNLWKNAKNLDPTLATEFQQMSEADLIAAFSDDLEFGTAGLRGLLGPGTGKMNLYTIRRATLAFMQYLKTIYSETDLKTKGIVIGHDNRYFSAEFAQAVANIFASNNIKAILFANNDLRPTPMVSYTIRKIKAAAGVIITASHNSREYNGYKIYDHNGSQFLPVATDIIGENYLKIKEEVFTLTLNPNSTLITYVPKEVEDNYVSDVKAMQFYPNQKRNIKIVFSNLHGTSKEWTPRIFEECGYDVTIVEEQFDNDPNFTFAPNPNPELTECYDLALKYAKKVNADVIILNDPDADRLGIGVKIKDNEYYLMTGNETAPVLIEYLFSHYQRQKTLPKNGVMYNTFVTGNLSDKVAEGYGVQVIKTLTGFKWIGDQMSKASAKGLQFLFGFEEAYGYVLKDITRDKDGIQSSLILAEACWYYHNQGKTLYDVLVEQYNKFGYFYCKTVNLVRDGIDGKKVINNMLKKLRQETITSLNQIKCIKKEDYLNGLYEMPGQDLLKFYFADGSWFAVRASGTEPKIKFYFVCVDKTNEEAKIKMEAMYQELETTYLKE

SEQ ID NO: 19679 - protein, 610 aa, Zea mays
  misc_feature (145)..(145): Xaa can be any naturally occurring amino acid
  misc_feature (173)..(173): Xaa can be any naturally occurring amino acid
  unsure (1)..(610): unsure at all Xaa locations
MDPPAPPARRSVSTICDLHPGEAFTGFCAACLRERLQGLEASAAAASAPGRKSTSAIRSLFARPFAAGSSSASGPAEPPDLRRCKSFSCGHGGDALAAAAAAAAGAAATRADEPQRRSCDVRGRSTLWALFHQDDRDRVRDGTAXPRRSQPPHRPPRPRSPSTCIPHRRHPEXNAAAQGGKAIKDHIDLESAENKKASPKDLKEIAGSFWVAASVFSKKWQKWRRKQKLKKEAAVSKAAAAAMPPPEKPSKPSFLRRSRLRGEAGSELADGRRSCDTDPRFSLDAARMSIDDAGFSWDEPRASWDGYLFGAGAGAGIGLGRAPPPLSRLPPILSVLEDTPADIVERSDGQIPVEDDFDPEPPGGSLQTRDYYLDSSSRRRRSLERSSSVRRPSFEVTDPTRPMAPAVNGTGRESPIGGGSEFYHFQHAEDLLDRGFSSNSLIEDISASLEAALSGSGPAKKPRRWRKAWSLWGLIHRRAAGRRSGGGPSDITDRSFSEPWPDLRVRGANPKMQRCNSSNLSARSSFSSNSGGLGSSRRSYVDANGNVRRREEPHAQAQVERNRSARYSPGRAATADNGMLRFYLTPMRSGTGRPRGAGLPTKAGSVLRLY

SEQ ID NO: 19680 - protein, 917 aa, Bifidobacterium longum NCC2705
MSNEYPYASMRDSFDLSAYFVVGPEDCKGRPLTDVVDQALHGGATFIQLRAKEADASELTDMARDIAQIIEDNEKSDSVAFVIDDRADVVWQARRKGIKVDGVHIGQTDMEPREARALLGDEAIVGLSAETESLVRLINELPDGCIDYIGAGPLHVSTTKPEASVGGNDGSGKTLDAAQINTICVASEFPVVVGGGVTAADMAMLADTKAAGWFVVSAIAGAENPEEAARTMVEGWKAVRGDKKHGYAPRVVTHTPATDTQAAQEGAAKPGSEATEKKFTNAKDAKDAQKLAKQQRVDIAARGSKQRDKAHIRKTKSVPFTYQYGSYDLEVPYTEIKLSDTPGVGPNPPFHDYNTEGPKCDPKEGLKPLRLDWIRDRGDIEDYEGRRRNLEDDGKRAIKRGRATKEWRGRKHEPMRAKDHPITQMWYARHGIITPEMQYVATRENCDVELVRSELAAGRAVMPCNINHPEAEPMIIGSAFLTKLNANMGNSAVTSSIDEEVEKLTWATKWGADTVMDLSTGNDIHTTREWILRNSPVPIGTVPMYQALEKVEDDASKLSWELFRDTVIEQCEQGVDYMTIHAGVLLRYVPLTANRVTGIVSRGGSIMADWCLRHHQESFLYTHFDELCDIFAKYDVAFSLGDGLRPGSLADANDAAQLSELMTLGELTERAWAKDVQVMIEGPGHVPFDTVRMNIELEKAVCHNAPFYTLGPLTTDTAPGYDHITSAIGATEIGRYGTAMLCYVTPKEHLGLPNKDDVKQGVIAYKIACHAADIAKHHPHAMDRDNAISKARFEFRWLDQFNLSYDPDTAIAFHDDTLPAEPAKMAHFCSMCGPKFCSMAISQNIRKAFGGEAAQQQIVKEAAAGIDSEALATAKANVDNGVVSANVLSPEEILAGMDAMSEKYTAQGGKLYSTAQE

SEQ ID NO: 19681 - protein, 405 aa, Methanopyrus kandleri AV19
MVESSTTSWRRPVRGHRCTSTTRMLPVKAAREYQEAFSWFPDRVYVCYAMKANFNPYLVEHIVDETRAADVVSLWEMKVAVNAGAETVVVNGNAKSSDEIRAAVERSWVINVDSFEEFQRIEKIARHEGERALVALRVNPKVSPDTHSHIATAVEGSKFGVELEIAERVCRRMIESEWVEFLGLHYHIGSQITDLRPFSEALRSVRTFLEDTGLIEEISYLNIGGGLGIRYRRGEEVPSPHDLAEELQEDLKELHSESSGFDLYLEPGRSIVGEAGILVTSVRQVKRGRRRWVFVDTGMNALIRPALYDAYHEVVVHGGDYSATEKASVAGPLCESGDVLAEDRELPIDISEGDLVVFLSAGAYCESMASNYNCYPIPGSVVVRNGEITGVRRVQDYEAFSKTWW

SEQ ID NO: 19682 - protein, 298 aa, Rickettsia tarasevichiae
EKSDFLEVAYLLIYGELPSSEQYNNFTKKVAVHSLMNERLHYLFQTFCNSSHPMAIMLAAVGSLSAFYPDLLKFKEADYELTAIRMIAKIPTIAAMSYKYSIGQPFIYPDNSLDFTENFLRMMFATPCTKYEVNPVIKNALNKIFILHADHEQNASTSTVRIAGSSGANPFACISTGIASLWGPAHGGANEAVINMLKEIGSSENIPKYIAKAKDKDDPFRLMGFGHRVYKNYDPRAAVLKETCKEVLKELGQLENNPLLQIAIELEASALKDEYFIERKLYPNVDFYSGIIYKAMGI

SEQ ID NO: 19683 - protein, 316 aa, Arabidopsis thaliana
MKIGDFLWKGEKVNGNDHDFLVTPNGLRDIVPLLYWFWVFTRTRLLAYPKGCVDHETKSLSLFLDVADSKSLPDGWKRHTKYRLTVVNQTSEKLSKKIGRQRKTLYGSTCHGLIGRRTCCSEIQLGQPWFDQQYPNRGSLAMVPLTKLLDKNGGFMVNGEVKIVAEVGVLEVVGKSDVLEETSLVMESMYVNGFQVLPSQVEFVKSLFEKHPDIESKLHLKNPHMRITYLNSLLTLTEILSQSPENISNDDLANAYSTLSYVTKAGFKLDWLEKDLKDVGETRIQEIEEELKDIKQKCVEMKHKCVDMEALLEFLL

SEQ ID NO: 19684 - protein, 421 aa, Aspergillus oryzae
MRDMSSTFESLLYHTSAPLTSLGRVFPYMLPAYYFVRLRYFMNMTRIPQAITSKFQTSRASDGETSSVKIENCVGFTRVPLGVAGPLQVQGSDGTTGSFYGPLATCEATLIASCSRGCKALNMCQGVRFKILHDSMSRAPAFWFANTEDAVAFFDLVPSLQPKFKKDAESTSKHIRLRTVIPHIVGSSVHVRFEYLCGDAAGQNMVTIATQRVCDRFSASAEAHALRLQRITTDNQMSSDKKLAWGNIIRTRGVRVLVWGSVSNDVSKRVLGCSTELLYQSILNSKEGAAMNGQLGYSVNPSNVIAAMFIACGQDAASVAEAAWSQLTAEYDADTKLLRLISYFPSLPVGVVGGGTAYPTQRESLEILGCNVPGTKHRLAGLIASFSLALDISTLAALATQTFSRSHEKLARGRWSPETKL

SEQ ID NO: 19685 - protein, 377 aa, Oryza sativa (japonica cultivar-group)
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPILLTEAPLNPKANREKMTQIMFETFSVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKSSSSVEKSYELPDGQVITIGAERFRCPEVMFQPSLIGMEAPGIHETTYNSIMKCDVDIRKDLYGNIVLSGGSTMFPGIADRMSKEITALAPSSMKIKVVAPPERKYSVWIGGSILASLSTFQQMWISRAEYEESGPAIVHRKCF

SEQ ID NO: 19686 - protein, 358 aa, Thermosynechococcus elongatus BP-1
MSHAVTLIRGDGIGPEVAAAARTAIDATGVKIDWVVVDAGVAMMERYGTPLPEEVIDAIKSTKTAIKGPITTPVGTGFRSVNVEIRKRLNLYANLRPAKSIVGVKSYFQNIDLVIVRENTEDLYAGIEFAYTSPEAAKARAFLSDLSGKPIREDAAIGVKPISVLGSDRILEFAFKYAKANGRKKVTAVHKANIMKFTDGLFLERAREIASRYPDIVFEDRIVDNMCMQLMQKPELYDVMVMPNLYGDILSDLCAGMIGGLGVAPGANIGDECAVFEAIHGSAPKYAGQNKANPTALILSGVLMLQHLGEMEAAQRLQAAVEKVIAEGRFVTYDLAAPGKEPVGTQEMAAAIAEYAAP

SEQ ID NO: 19687 - protein, 396 aa, Oryza sativa (japonica cultivar-group)
MASAAGGASGKDWFDCLPDDLVHHVLSFLPALDAVRTSVLSRRWRDFWVSMPRLNVDVGDFRDDGQFENFTVHALPLLDSSVPLRSLRLRSSLHYLSALWVNHAVKRKVAVLEYSGRAELCSSVDASLSLASSYLTKVVLKHFDFDYGQFWPLIDACPALENLELLDVWTFYSVTISSSSLKHLRIVSCLFYNGFRINAPNLLTMCLDDVNVNGPLGHDSLVLENLSSLMTASVSVYHCFYPKHYVKTELHFFHGLSHARNLKLIAPLYEALFEEGLPTCPVFNNLKCLVLGDWCMAFDLYPLRCILRQSPMLEELCVELGEEECENCKNRKPAFSYGEISPFWCDRLKTIKIKCTEHDERFVALLQLFCKILVCIEEVDIDRQWVSAQPPDSSEL

SEQ ID NO: 19688 - protein, 591 aa, Oryza sativa (japonica cultivar-group)
MASPPTSESAITSAGSASASGFDCLPDDLVHHVLSFLPAPDAACTSLLSRRWRNLWVSMPCLDIDVSDFHDASQFDRFMDHVLHLLDDSVPLRSFRLRSCWIDDSAVSWLRYAVKRKVPVLEYAERQGYFIHGCHDLISASSYLTKVVLEHVVLHDCHFGPLNNGCPALENLELLEVNIQFTEISSTSLKHLRIVNCMMDCKFWIRTPNLLTMCLDGVECKSSLYWTVLNNRSLFTVLEDWRYQIPAVHSGRSNGQDASVPRECDGCGGLSDGCDLETFGRRRMQGLRLDYFLISSSPTLAQRMPMGASDDGRTETYRVAKVPTSGEPPDPLWSPLDSSATSSPSSLLHSRRLLGALLPVDSPMLLLLVLVPRLQHSHPQHLFSSPLLPSAYRGRLPHQEDYDANYEDEDLSEDEDEDLSDGHHIEYNILGVLSHARSLKLVAPLREALFEGCLLTCPVFNNLKCLVFGDWCMDFDLYPLRCVLKQSPILEELCVELREKECEYCKEKAPPFSYSYGEILPFKCHRLKTVKIKCGERDERFIALVKLFFKISVCIEKFDLDRRSPPLIYVAGATAAARDPLVAVAVAPLLP

SEQ ID NO: 19689 - protein, 752 aa, Triticum aestivum
  misc_feature (645)..(645): Xaa can be any naturally occurring amino acid
  misc_feature (724)..(724): Xaa can be any naturally occurring amino acid
  unsure (1)..(752): unsure at all Xaa locations
MGEIAADERGLAGGKGSEEEEEETSPIEEVRLTVPPGDDPTLPVWTFRMWSIGLLSCALMSFLNQFFSYRTEPLIVTQITVQVASLPMGHFLARVLPRRKFRAPAALGGGEWSLNPGPFNMKEHVLISIFANAGYAFGNGNAYAVMIVDIIRAFYGRSISFIAAWLLITTTQVLGYGWAGLMRKYVVEPAHMWWPSTLVQVSLFRALHEKEESPKGSRQISRSKFFLVALICSFAWYVVPGYLFPALTSISWVCWVFSKSVTAQQLGSGMKGLGIGAFTLDWSAVSSFLFSPLISPFFATANIFVGYFCFLYVLVPTAYWGMNLYNAKTFPIFSSHLFMSNGSAYQITDIVNQQFQLDTEAYARLGRINLSTFFALSYGLSFATIASTITHVGIFYGKEIYHRFRASQQEEPDIHTKLMRKYDDIPAWWFYSLTVLSMTVSLILCTVLKDQVQLPWWGLLFACGMAFVFTLPISIITATTNQTPGLNVITEYAMGLIMPGYPIANVCFKVYGYMSMSQAVAFLSDFKLGHYMKIPPRSMFIVQFAGTLVAGTVNLSVAWWLLGSVENICQDQLLPPDSPWTCPGDRVFFDASVIWGLVGPKRIFGPHGNYEAVNWFFLIGAAGPVIVYIFHRIFPSQRWILMINXLPVLIGATANMPPATAVNYNSWLLIGTIFNFFVFRYRKKWWQRYNYILSAALDAGVAFMAVLLYFTLTMENRTVNWWGXTAGEHCPLASCPTAKGVDLGPDSVCPVF

SEQ ID NO: 19690 - protein, 886 aa, Wigglesworthia glossinidia endosymbiont of Glossina brevipalpis
MHNKYYDIDPIETSEWQDSIKSVIEIDGIERAKYIVSKVFTEIKKKDKNFIFKNENYINTISKEDEPKYPGDLKLENKIRSFIRWNAMMMVLRASKKNLELGGHISSFQSSATIYEVCFNHFFRGPLAKDGGDLVYFQGHISPGIYSRAFIEGRLNENQINNFRQETNGSGLPSYPHPKLMPNFWQFPTVSMGLGAICGIYQAKFLKYLHNRKLKNTEQKKVYVFLGDGEMDEPESKGSINIASREKLDNLIFIINCNLQRLDGPVYGNGKIITELSEIFYGAGWEVIKVIWGGRWDSLINSDKSGKLIKLMNETLDGDYQNFRSKNGEYIRKNFFGKYVETSKLVENMSDDEIWKLNCGGHDPKKIYSAIKKANESKGKPVVILMHTIKGYGMGDLAEGKNIAHQVKNMDFDGIKKFKNRFGLNDINDKCLNLLPYVSFSKKSKEYIYLHNCRKNLHGYLPKRHSSCNKLFNLPELKDFSSILEEQKRNISTTMAFVRIINILLNNKFISKLLVPIVADEARTFGMEGLFRKIGIYNYNGQKYVPQDKDQLAYYKEDKTGQILQEGINELGAGASWIAAATSYSTNNVIMIPFYIYYSMFGFQRIGDLLWSASDQQAKGFLIGATSGRTTLNGEGLQHADGHSHIQSSIIPNCVSYDPSYAYELAVIIQNGFTRMYGDNPENIFYYITTLNENYYMPSMPNGVEEGICKGIYKIDSLKSNKSNKVQLIGSGSILRHVREAAQILYKKYNINVDVYSATSLTEIAREGQDCIRWNMLNPLEKPKIPYISKIMDKTPTIVSTDYVKLFSDQIRNFVPSKTFKSLGTDGFGRSDSRNNLRNYFEVSSEYVVISALAALYEEEKISKKVIKKAIKDFNIDVNKINPRLI

SEQ ID NO: 19691 - protein, 327 aa, Wigglesworthia glossinidia endosymbiont of Glossina brevipalpis
MPNNDVPSNFDFIYYGKQVLDLEKNGICKLKKCINRDFQKIGELLLKCNGKIATMGIGKSGHIARKLSSTFSSTGSPSFFIHPTEAGHGDLGSLCSNDIVIAISNSGESKEIISLIYYLNNFNITYISITGNPLSTMSKLSKINLSIKVTKEACSLGLSPTTSSTAALVMGDALAISLSIAKGFNIKNFSFLHPGGILGKKLSLRVNDIMRKKIDVPIVYSTYSIFDTIVKITKKNFGIAVILNNNKTIKGVFNFKNLKKIYKLNLNLNDSISTVMNINFNQINPDILVEKAFKIMQSIKTDYLLVSIKNYFSGIIHINDIKKYGFY

SEQ ID NO: 19692 - protein, 270 aa, Chlamydia muridarum Nigg
MLTDKKSSPTWSSLLPSETSQYFVFGNWKMNKTFSEAQTFLKDFVSCEILSNPKIITGIIPPFTLLSSCQQIIKNTPIRLGAQTLHEVDSGAFTGEISAPMLKDIGVDFVLIGHSERRHIFHEQNHSLAEKLLAAIRNGIVPVLCIGETLEEQEAGATQDILLEQLTVGLSRLPEHAPFILAYEPVWAIGTGKVANPDLVQEIHAFCRNVVKDLISKDAAERTPILYGGSVKADNTRALTLCPDVNGLLVGGASLSVESFLAIIQQIAVS

SEQ ID NO: 19693 - protein, 533 aa, Aspergillus oryzae
MKNEPLPFNWVTIVVSPITGFLAAVYTPLKRETECFAVIYYFVSGIAITAGYHRLWSHKSYGATLPLKWFLAIFGAACCQWSIRTWAECHRSHHRYTDTDKDPYSVRHGLVHAHIEWVLQPEIRAGPTDLSDLDADPVVRLQHRYYLTFAIIMSCIFPSGGFIYAGVIGLFFCYQAIFSIHSIAHWVGDQPYDDRHTPRNHTLVTLLCFGEGYHNYHHEFPADYHNVVEWYQCDVTKWCIWVWKQLGLAYGLKKAPDNVVGKGTYQQARKKLERKANKLDWGLPLSQLPGITWDGFQEAVKDGRQLIILSGMVYDIATFIPFRPGGVKILVSHIEKDATKAFNGEIYSHFHCRTKLKLSHVPIPAVIQDSKGKRLYTFEIHEVLVLRYSRPGRDETNRKQDKADRRTPHFKLPTSPKQLELPEGADAKAFIVFVTSDDPTTGQSWCPDVRAAWPVLEATFSGVNAPALRVVEVGQKPEWKDLNNVYRTNWKVPCIPALVRYERVNGETAETGKLVEGEILDKKRLGEFIGTTL

SEQ ID NO: 19694 - protein, 165 aa, Triticum aestivum
HSSPIPRHRSCSFLVCLWANLSGDGDLSSPARPSSDVATPSSIATRSTTAPSSSPVSADLRRRAALPTVLPSHVSGCILRAGLQNTPGGIPDVLVAHLNAADCILMMEVKPKLTVPMGPAITVSVLAHRKDTNKMTCIINTSSFDYIDSNAARALAYEYLKVSPN

SEQ ID NO: 19695 - protein, 503 aa, Acinetobacter sp. ADP1
MRYIDPNQPGSKVQFKAQYENFIGGQWVPPVKGEYFGNSSPVDGKVFTQIPRSSVEDIELALDAAHKAKADWNKASPTVRSNVLLKIADRLEENLELLAVAETWENGKPIRETLAADIPLAIDHFRYFAGCIRAQEGGISEIDEDTIAYHFHEPLGVVGQIIPWNFPILMAAWKLAPALAAGNCIVLKPAEQTPSSILVLAELIQDLLPPGVLNIVNGYGAEVGRPLATNPRISKIAFTGSTKVGQMIMQYATENIIPVTLELGGKSPNIFFEDILDKEDDYLEKTLEGFAMFALNQGEVCTCPSRALVQESIADKFLEMAVERVKRIKTGHPLDTETMIGAQASKQQFDKILGCIDTGRNEGAQLLTGGDARHDVDGGFYIEPTIFKGNNSMKIFQEEIFGPVLSVTTFKDFDDAMRIANDTIYGLGAGVWSRSAHTSYRAGRAIEAGRVWTNCYHLYPAHAAFGGYKQSGIGRENHRMMLDHYQQTKNLLVSYSTKPMGFF

SEQ ID NO: 19696 - protein, 177 aa, Filobasidiella neoformans
MGAAESSMFNSLEKNSNFSGPELMRLKKRFMKLDKDGSGSIDKDEFLQIPQIANNPLAHRMIAIFDEDGSGTVDFQEFVGGLSAFSSKGGRDEKLRFAFKVYDMDRDGYISNGELYLVLKQMVGNNLKVQDQQLQQIVDKTIMEADKDGDGKLSFEEFTQMVASTDIVKQMTLEDLF

SEQ ID NO: 19697 - protein, 479 aa, Alkaliphilus metalliredigenes QYMF
MNCKMYIDGQWVEGKEGEKLEVVNPATGDILVYIAKAGYAETERAIESADKAFKTWSKTTAGERANYLTKLYHLMIEHKDEIAKIMTLEQGKPLQEAMGEVVYGAGFVEWYAEEAKRVYGETIPASKENKRIMVLKQPVGVVAAITPWNFPAAMITRKMAPALAAGCTVVLKPASSTPLTAIKIFELCEKAGFPKGVVNLVIGDASKIGETLMNDFRVRKLTFTGSTEVGKKLMTQAGATVKRISLELGGHAPFIVFDDADLDKAVTGALNSKLRNCGQVCVASNRFYVQEGIIDDFILKMKEKLKNYKIGSGLEEGVHLGPLIDQNAYEKVKTHIEDAVNKGAKIEFGGEGFHRGSSAAGGYFYQPTLLSNVTEEMLIMKEETFGPVIPVVSFKSEEEVIARANDTKYGLAAYFFTQSLAKGFRVSEALAYGIVGVNDGVPSTPQAPFGGFKESGIGREGGHYGIEGFLETKYVSFEI

SEQ ID NO: 19698 - protein, 351 aa, Bacteroides fragilis NCTC 9343
MLLDKIQNLIIQSDISIFQSMKKMDEEKVKLLFVFRGDCFVGILTIGDIQRAIIKQNDTSMQINNILDQNKVFAYKGESLEIIKNKMIHLRAECMPILDSKGELVDVLFWKDLFIDEVRVDDRKIDLPVVIMAGGKGTRLKPLTNVIPKPLIPIGDKTILEAILDQFESIGCSKFYMSVNYKYDILKFYLAQLDHKYDIRFFKEDKPLGTIGSVSLLKDKISTPFFVSNCDIIIDQDYRDVYDYHINNSNDLTIVTAVKRTRIPYGVIETIENGLMTELIEKPEFTYMINSGVYILQPELINEIPENELFHITHLMEKVKSRGGKIGCFPVSEKSWTDIGEWNEYLKLLGI

SEQ ID NO: 19699 - protein, 433 aa, Alkaliphilus metalliredigenes QYMF
MEKQNENNKHFMFGGCNTVELAERYGTPLYVLSKEKIQERCKEIRETFLQKYENTKAAYASKAFLTMAMCRIIESEGLGLDVVSGGEIYTAVQAGFPMEKTMFHGNNKSFEELYLAVEHGVGRIIVDNLLELEMLQQIAKEQGKKVDVLFRVTPGVEGKTHAYIVTGQKDSKFGIPLQPEIIESAVKQTMESPYIKLKGFHFHIGSQLFENDSYTDATQVLVNLMKHLKDHLEFITEELNTGGGFGIKYVDEAPRPLGYFTDAIMETIKDACEKVGLEVPTIIIEPGRWIVGEAGITLYRIGTVKEIPDVRTYASVDGGLPDNPRPALYNAKYDAVVANKIDEEKDQIVTIAGKCCESGDILIWDLQAPQIQTGDLLAVLSTGAYNFSMASNYNRLPRPAVVLVDQGKAEIMVQRETYGDLLSREQMPNSLRR

SEQ ID NO: 19700 - protein, 366 aa, Xanthomonas campestris pv. campestris str. ATCC 33913
MLFETLDTTGHEQVIFCHNRDAGLKAIIALHSTRLGPALGGVRMRPYANSEAALNDALRLSRTMTYKNALAGLNVGGGKAVIIGDPKTDKSEALFRAFGRFVDTLGGRYITSEDVGTDVNDMEQIYLESEYVTGVHQVHRGSGDPAPFTAYGALQALMASLNRKLGHEEVGKASIAIQGLGHIGMELVKLLKERGAKLYVADLNPALVDRAVSEYGAEAVRPEEIHEVPADVFAPCALEGAINEDTLPRLKAKIICGTANNQLSSAAIGEELHKRGILYAPDYVVNAGGVMNVSLEIDGYNRERAMRLIRSIYHNLEKVFDLSTQLGIPPQQAADQIAETRIEAISKLKLPLGRTAPRFLHKLRGE

SEQ ID NO: 19701 - protein, 250 aa, Nocardioides sp. JS614
MSDDSSDVKPGPKGPEQPAVEQSPENVPAPTGEVHQVGARHGMFGVRGTGDTSGYGGLNQAIVLPGDAQRPYGGWFDEVADGLAAATREAGLEIAAPRVVIHRGEITFHLRREDLLPVAQVLRDDERLRFEFCAGVSGVHYPDETGRELHAVYHLLSMTHNRRIRLEVAVPDADPHIPSIVPVYPTNDWHERETYDMFGIIFDGHPALTRILMPDDWPGHPQRKDYPLGGVPVEYKGGTVPPPDQRRSYN

SEQ ID NO: 19702 - protein, 202 aa, Thermosynechococcus elongatus BP-1
MPYHLEAWCIYVDRTPELRQHINLEHLRHMGGKRNAELLPELLGRSLSAAEIERWGAGKEAVFRELLAPHLELLPGLLPFLKSAKEKGYRLGLGTSACAANVELVLSCEGVGHFFDTVVMEQDVQRGKPDPECYLLVAERLQVVPQYCLVFEDAVAGVMAAVQAGMLCWGVLTTQSAMTLQAAGAEVCIEDFTDPRLQRLLS

SEQ ID NO: 19703 - protein, 446 aa, Nocardioides sp. JS614
MADQDLYSGSSETTEGRVFTVTGQDWDSIAEGLAEDEAQERIVVNMGPQHPSTHGVLRLILELEGETVTEARAGIGYLHTGIEKNMEYRTWTQGVTFCTRMDYLSPFFNEMTYVLGIERLLDIEDRVPEKAQVMRVLLMELNRISSHLVAIATGGMELGALTVMTIGFRERELVLDLFELITGLRMNHAFIRPGGVAQDMPPGALDEIRGFVALMKKRLPEYADLCNANPIFKGRLEGIGHLDLAGCLALGLTGPVLRSTGYPWDLRKTQPYCGYETYDFDVQTWDTSDSYGRFRIRLNEMWESLRIIEQAADRLAGLDGAPVMIEDKKIGWPSQLAIGSDGMGNSLDHIRHIMGESMEALIHHFKLVTEGFRVPPGQAYVPVESPRGELGAHVVSDGGTRPFRAHFRDPSFTNLQATSVMAEGGMVADVIVAIASIDPVMGGVDR

SEQ ID NO: 19704 - protein, 298 aa, Wigglesworthia glossinidia endosymbiont of Glossina brevipalpis
MFTGSIVALITPMKKSGKIDFDSIKGLIEYHIVNNTSAILAIGTTGENFSLTFEEQCNIVKYIFETCDKKIPVIAGIISSNIENIKKQINFYNKINISGILISTPYYSCPTQNGIFNYFKEISKNTDIPQIIYNNPKRTGCDILPETVSKLSYIKNIIGIKDSSKDLSRVKKIKFFSKKNFCLLCGDDINILDFMQLGGCGVISTAANIIAYESSSLCRLINNRHYYKAEKLYYNILDLYKILLIAPNPTPIKWACNFLGLIKTKYIRLPMIGLNKKEIFMFKKILNKIKLKSKINCI

SEQ ID NO: 19705 - protein, 473 aa, Mycobacterium smegmatis str. MC2 155
MLESRSDLSSSDEPRSGLARSLKTRHMTMIAIGGAIGAGLFVGSGAVIKTAGPAAIVSYVVAGALVLCTLRMLGEMVVAKPRTGAFADYARIGIGPWAGFTLGWLYWYYYVIIIAVEAVAGAQILAVWVGLPLWLMAMLLMAALTLTNLISVRWFGEFEFWFSGIKVAAIVSFIVVGLLWVFGVWPGDTNGLTNLVAHGGFAPNGFGSIFGAVVVVIFAFGGAEIVTIAAAESAEPAKSVARATTGVIWRIILFYVGSIFLVVCILPWNDASVLSSPYVAALEKLQIPGAGLIMNIVILTAVLSVLNSSIYTSSRMLRVLASHGDAPQWLVRTNTRGVPTRAILASTVVGWVSVVLAYIAPDSLFLFLVNSCGVVAIFMYVMIGVSELRVRRAIEREDPAKLTLKMWFFPYLPIAVIACFVLVLVAMLFDADQRVQLLASVVSLAVVLLAYALRKRHGQVPATDTKQAARTDE

SEQ ID NO: 19706 - protein, 658 aa, Pleurotus djamor
MAFNLTSTSLTPSRPAPQAPRRGTEDSFGSSSTLNSSGYSSSFSFTPASPSSSSYAASYSGIGGSPNRHPENNMYGGNQIVRNGVVSVKEDGTFASWMWKAKWLVLTDSELSIHKSEHAPKQTVVNLGDISSIERTDLKPYCLLLETKDKRFYFSLKNDEELYGWQDDVYARSPLMGVSNPTNFVHKVHVGFDPVSGAFTGMPEQWSKLLTKSAITREDYAKDPQAVLDVLEFYTDHQKREMEEMGAKESLPIQAPPPLQPSQSKDRERERERERAEREREREKDLARPGMGAPSKSSPATTQPATQPASGPAGATAGPPPVKPLQPTKKVQIQAEEKPKTTGVAAAAAALEKPKEKEKRISTMTEVQIMEKLRQVVSDEDPKTIYSKIKKVGQGASGHVYVAKTLATGKKVAIKEMDLSHQPRKELIVNEILVMKESQHPNIVNFLESYLVKSNELWVVMEYMEGGALTDIIENNTLEEDQIASICFETCKGLGHLHSQSIIHRDIKSDNVLLDAQGRVKITDFGFCAKLTDQKSKRATMVGTPYWMAPEVVKQKEYGAKVDIWSLGIMAIEMIENEPPYLDEEPLKALYLIATNGTPTLKKPEALSRELKGFLAVCLCVDVSSRATASELLDHEFLKKSCALSGLAPLLRFKTKQQ

SEQ ID NO: 19707 - protein, 106 aa, Wigglesworthia glossinidia endosymbiont of Glossina brevipalpis
MKNSIEKIKEQIKKNKIILYMKGSPENPKCGFSSKVARILCESNFRFAYVDVISNPHIREKLPEFSNWPTFPQLWVNGSLVGGCDIVTKMHEKGELVPFINKEINK

SEQ ID NO: 19708 - protein, 417 aa, Haemophilus ducreyi 35000HP
MNHFAYKHHQLFAEKVAVKALATQYGTPAYIYSRATLEQHWRAFDEAFGDRPHLICFAVKSNPNLAVLNVMAKLGSGFDIVSQGELERVLAAGGDPAKIVFSGVAKSHIEIRRALAVGIHCFNVESVAELHRINQIAGELGKIATISLRVNPDVDAGTHPYISTGLKENKFGISVQQARAVYQLASRLPHIQVVGLDCHIGSQLTELQPFLDAADRLIVLLEQLYRDGIRLSHLDLGGGLGVVYHTETPPQPAEYVRALLAKFAHYPELEIILEPGRAITADAGILVTKVEYLKSNEDRHFAIVDTGMNDLLRPALYDAYMHISEVDQSLKRVEQQYEVVGPICETADFLGKARTLAIAEGDLLAVYSAGAYGASMSSTYNSRPQAVEIMVDGATSHLIKKRSDFAELWRNEKCITD

SEQ ID NO: 19709 - protein, 361 aa, Solibacter usitatus Ellin6076
MNLNVLVLPGDGIGTEVTCQAVRVLEHVAKKWNHTLHLTEGLLGGIAIHKTGTPFPQETAKLAASADATLMGAVGLPEFDNAPPEKRPEKGLLGIRQALGVYANLRPVRAYASQLDSSPLKNHLVEGTDMIIVRELTGGIYYGTPRGISGSGLEERAVNTMTYTRAEIERVARMAFHLARARRKKVTSVDKSNVLENSQLWRRVVVEVAKNFPDIELDHILVDNCAMQLVLNPKRFDIVLTENMFGDILSDEGAVLAGSIGMLPSASIGDQRPSGAWVGLYEPVHGSAPDIAGQNKANPLGAIGSVAAMLAYSFGLKEEAAAVETAIEAVLTSGQVTADLRPAGAPATTAQVGQAVCAAIG

SEQ ID NO: 19710 - protein, 132 aa, Boechera holboellii
ASWHPPWYSSYTAHYREAECMKEAMEELLYSYGTDIVFNGHVHAYERSNRVYNYELDLCGPVYIVVGDGGNRERMAIEHADEPGKCPEPLTTPDPFMGGFCAWNFTPSGKFCWDHQPDYSAMRESSFGHGIL

SEQ ID NO: 19711 - protein, 678 aa, Chlamydia muridarum Nigg
MRHSIYQLDSAVENVFRLAWTLRFSERKMLLLSRQSGSGGSFQLSCAGHELAGVVAAKSLIPGKDWAFPYYRDQGFPLGLGCDLSEIFASFLARTTQNHSDGRMMPYHYSHKKLRICCQSSVVGTQFLQAAGRAWAVKNSGKNEVVYVSGGDGSTSQGEFHEMLNFASLHQLPLVIVIQNNQWAISVPFADQCGADLVALGKSYSGLATYKVDGGDLSALTQTFDCAVSDARHHHIPALVIVDVVRLESHSNSDNQTKYRSEEELLYCQEQDPLVRLEKSLIDDFGVAQETIEQIKEELQETISKACELAESTPFHCKGATKHEVFAPYNVSLIDYENSLESASLQGSEPRVMRDAITEALVEEMHRDPGVVVFGEDVAGNKGGVFGVTRTLTERFGRNRCFNTPLAEATIIGTAIGMAFDGFHKPVAEIQFADYIWPGINQLFSEAASIYYRSAGEWEMPIVIRTPCGGYIQGGPYHSQNIEAFLAHCPGLKVAYPSNAADAKALLKAAIRDPNPVVFLEHKALYQRRAFSTTPVFSSDYVLPFGKARIVHSGTDLTIVSWGMSLVMSVEVAKDLLGLGVSVEVIDLRTIVPCDFATVCESVKKTGKLLVVHEASEFCGFGSELVALVAERAYRYLDAPIKRIGGRHSPIPYSKVLENEVLPQKEMIFQEAKSLAEF

SEQ ID NO: 19712 - protein, 392 aa, Chlamydia muridarum Nigg
MDYYTILGVAKTATPEEIKKAYRKLAVKYHPDKNPGDAEAERRFKEVSEAYEVLGDAQKRESYDRYGKDGPFAGAGGFGGAGMGNMEDALRTFMGAFGGDFGGNGGGFFEGLFGGLGEAFGMRGGSEGARQGASKKVHITLSFEEAAKGVEKELLVSGYKSCDACSGSGAKTSKGVKVCDRCKGSGQVVQSRGFFSMASTCPDCSGEGRVITDPCSECRGQGRIKDKRSVHVNIPSGVDSGMRLKMEGYGDAGQNGAPAGDLYIFIDVEPHPVFERHGDDLVLELPIGFVDAALGIKKEIPTLLKEGTCRLNIPEGIQSGTVLKVRGQGFPNVHGKARGDLLVRISVETPQHLSNEQKELLRKFSETEKAENFPKKRSFLDKIKGFFSDFAV

SEQ ID NO: 19713 - protein, 331 aa, Vibrio sp. Ex25
MTIKVGINGFGRIGRFVFRAAQERADIEVVGINDLIDVDYMAYMLKYDSTHGRFNGTVEVEGGNLIVNGKTVRVTAERNPADLKWDEIGVDVVAEATGLFLTDETARKHIEAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDAVVSQDFIGEVQTSVFDAKAGIALTDNFVKVVSWYDNEIGYSNKVLDLIAHISK

SEQ ID NO: 19714 - protein, 132 aa, Boechera holboellii
ASWHPPWYSSYTAHYREAECMKEAMEELLYSYGTDIVFNGHVHAYERSNRVYNYELDPCGPVYIVVGDGGNREKMAIEHADEPGKCPEPLTTPDPFMGGFCAWNFTPSGKFCWDQQPDYSAMRESSFGHGIL

SEQ ID NO: 19715 - protein, 294 aa, Vibrio sp. Ex25
MDLKTLPALTVLSDNVTVVEIDQVKVVRVIHEKATAGISLHGGHVVSFTPAGHEDLIWMSEKAIFDGKKALRGGIPVCWPWFGRIAAPAHGFARTAEWELVEHRENDNGVIVELALFPTEEIHDIWPHMFDARLVVEVGDELKVTLKVMNIDDEAWTFSGALHTYLNVGDIKQAQTTGMGAEYIDSLKADAVCQGGDVLQLTDTIDRVYTQPEAKILVKDPELNRTLSVENHGHNSAVLWNPWAEGAQGMADMADDGYQTMLCVESTVHAPSIEQGKTLQPGETHELVTVISVQ

SEQ ID NO: 19716 - protein, 971 aa, Aspergillus oryzae
MLDAQKEAEAKIDLLTSSNGPLVTGIYKISSLTKEVKTKRQLLTKKLTNIQFAAKQFDWTILLDAASTLVSLRADPKSIVDTVKQGYEIYKKGTDESTAKNLHGDAVKKEYIIDQLAQCSDTLESLEKAFTTRKDNQIEIDDPGALKIMATKGNIQKILREFKNAIVEKDKKDIESALDDYIAVTLNRNNAVLDYNSSLQLLFEASNAREYSKSQAESLGQRRHTLDPNTPAILFWLRKTRDNMRLQLMQRLNYESRAIRFWGLKKHLDYSSPGPLRSFIELRDGQSKLNAAYEDSLNSYANNIRVTWPREEKEKGLFYILSNAELKSFKQRQRLTTSKGDDGVYSASIRLEPGAPPFGPGRADVRINQVRLWLLGVEVKADNAGRKQLMVKIAHSGNETLENTDRQALGFSHDAVNIQFEYNTAKVQTPDDFKTDVVFGKQGLENDWSGGDSKPTASTFAAIGPFTEWRFSIRESENVGLDMGSVTAAYVEFRGANRPFSVDYRKAPINPMVDQRIKPHSTGRKLDMIDIPYGALADNEWKFEPITLPCEWVEDYRPGGYHPVVLGDIFNNGQYKVIRKLGEGSYSTVHLLYFVVHRYLFRFRNRRYVALKILVSEISGSTTELRILRHITEVAPAEAGRHITRLLGEFEHHGPNGVHRCLVFEPMGPSVNTMVEELPQFKPRMRGMKIRYPLRMAKSILKQSLQALAFLHENGIAHGDFQPGNILFTLDDIGSTPEDVLRQEEDVQAESISPPVQRLDGKEDKWAPRYLCVAQSLVPFTYYAEGFKVKLSDMGGAYFFTDPPTKPVTPLGLRAPELILTGAVDNTLDIWSFGCLVFELITGQPLFCIPGSDFEDDDHLLSLTDRLGALPDELFKHWKTSSLYFTSERKLFNCQLGGVAPGGEPLMVEQTSMEELFDQAGPDLDEEEARKVKALIRWILQYDPAKRPSPAEILSDPWFCEIDVESESARV

SEQ ID NO: 19717 - protein, 491 aa, Bifidobacterium longum NCC2705
MSTTDAPKKPRETDDVPVPATLRKSLKNRHIQLIALGGAIGTGLFYGSSESIALAGPSILLAYLVGGLAIFAIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 19718 - protein, 454 aa, Corynebacterium diphtheriae NCTC 13129
MTNTPFRPEGGRHHVVVIGSGFGGLFAVQNLKDADVDITLIDRTNHHLFQPLLYQVATGILSSGEIAPQTRQVLAQQNNVHVLKAEVTDIDTESKTVVADLDDYSKTIEYDSLIVAAGAGQSYFGNDHFAEFAPGMKTIDDALELRARIIGAFERAEMCEDPKERERLLTFVIVGAGPTGVELAGQLAEMAHRTLSGEYTQFTPSNAKIILLDGAPQVLPPFGKRLGRTAQRELEKIGVTVKLNAIVTGVDENSVTYKSTVDDSLHTIDSFCKIWSAGVAASPLGKLVAEQLGVEVDRAGRVPVNEDLSVGDDKNVFVIGDMMSLNRLPGVAQVAIQGGEYVAEQIAAGVEGRSSSERPAFEYYDKGSMATVSRFNAVVKLGKVEVTGFIGWVMWLLVHLMFLVGFRNRATAAFSWGINALSRKRWNLATTRQQLHGRTGLQKLTALVDTAEKK

SEQ ID NO: 19719 - protein, 196 aa, Nocardioides sp. JS614
MAGSPEPKSMREQFWDPIAGFGVTFRTMFKKVVTEQYPFDKYPTAPRFHGRHQLNRWPDGLEKCVGCELCAWACPADAIYVEGASNSDDPDGGERFSPGERYGRVYQINYLRCILCGLCIEACPTRALTMTNEYELADDNRADLIYEKSDLLAPLLPGMEQPPHPMRLGDDEGAYYRGEFAAPAPTAPGSSTEAGA

SEQ ID NO: 19720 - protein, 111 aa, Zea mays
  misc_feature (29)..(29): Xaa can be any naturally occurring amino acid
  misc_feature (57)..(57): Xaa can be any naturally occurring amino acid
  unsure (1)..(111): unsure at all Xaa locations
SWVTLLYFISAIFWISGLYYCNSLGYIPXDGVATNAAMDKYISAASKAMPFYSSVPXLFDSMISMGWTRRYFNIRPTGLSMYLSYMVMHRIFVKLRIYCIGRKLRDITPLY

SEQ ID NO: 19721 - protein, 138 aa, Zea mays
  misc_feature (18)..(18): Xaa can be any naturally occurring amino acid
  misc_feature (26)..(26): Xaa can be any naturally occurring amino acid
  misc_feature (53)..(53): Xaa can be any naturally occurring amino acid
  misc_feature (67)..(67): Xaa can be any naturally occurring amino acid
  misc_feature (102)..(102): Xaa can be any naturally occurring amino acid
  misc_feature (125)..(125): Xaa can be any naturally occurring amino acid
  unsure (1)..(138): unsure at all Xaa locations
MVSLAGASAHPATIKGLXSSFISGRXLAVARPAARSIRRPRAAAVVVKYGDKXSVYFDLHDIGNTTXGQWHLYGSDAPSPYNPLQSKFFETFAAPFTKRGLXLSRACCVRGGSVLAYASSSASPXFLPIKKGPQEPSQ

SEQ ID NO: 19722 - protein, 156 aa, Triticum aestivum
  misc_feature (42)..(42): Xaa can be any naturally occurring amino acid
  misc_feature (50)..(50): Xaa can be any naturally occurring amino acid
  misc_feature (66)..(66): Xaa can be any naturally occurring amino acid
  misc_feature (101)..(101): Xaa can be any naturally occurring amino acid
  misc_feature (109)..(109): Xaa can be any naturally occurring amino acid
  unsure (1)..(156): unsure at all Xaa locations
FLPAIFHPAIARLCINLKKHLITTSYLYDSISKSQQTAQITXLTILSKMXLYPCIDHMLSMKIIDXTHPLNSKIKSFTSFSGGLPSPAAANNPLTYNFNLXPASSIRTXRNPPVYKFLKKIIYVNGSNLYQSPKNLILPQLPLLLSNTSKSKFLDV

SEQ ID NO: 19723 - protein, 662 aa, Acinetobacter sp. ADP1
MTTPLNERRIANAIRVLAMDAVQQANSGHPGAPMGMADIADVVWREFLNHNPTNPQWANRDRFVLSNGHGSMLHYALLHLSGYDLSIEDLKQFRQLHSKTPGHPELGYAPGIETTTGPLGQGIANAIGFALAERTLAAQFNKDDLKVVDHYTYCFLGDGCLMEGISHEVCSLAGTLGLGKLIAYYDDNGISIDGEVEGWFSDDTEQRFKAYGWQVLRVDGHDTDAIRQATVEAKAQTAQPTIIICKTIIGLGSPNKQGKEDCHGAPLGTDEIKLTREALGWEEEAFVIPKDVYSAWNAKDKGQAAESAWNDVFAQYQAKYPSEAAELLRRVQGDLPAEFLAQADAFIAETNAKAETIATRKASQNTLQAFGPLLPELLGGSADLAGSNLTLWKGCEGVQDNPAGNYVYYGVREFGMTAIANGVALHGGFIPYVATFLMFMEYARNAVRMSALMKQRVIHVYTHDSIGLGEDGPTHQPIEQIASLRGTPNLNTWRPADTVETAIAWKSALERKDGPTALILSRQNLPFQSRSEAQIQDAAKGGYVLAQEKGELKAIIIATGSEISVAMDAYVQLEGVRVVSMPCAEEFMKQDAAYRESVLPSQIRARVAVEAAHVDYWWKFVGLDGKVIGMTTYGESAPAKDLFKHFGITSDAVVEAVKSLTA

SEQ ID NO: 19724 - protein, 334 aa, Nocardioides sp. JS614
MTPASSGLALPVTDEALASRLRDRMAAVEVALAGHVVSRAGFVSETASHLMAAGGKRFRPLLVLLAAETGEHPDADEVITAACVVELTHLASLYHDDVMDEAELRRGAVSANARWDNHVAILTGDFLFSKSSELTAELGPDAVRVQARTFTRLVEGQILETVQPGPGEDPLAHYLDVVAGKTGSLIATSAHYGARFGGASREVEEALTAYGEIVGSAFQLSDDILDIASDSGESGKTPGTDLREGVPTLPVLMARASTDPADARLLELLGGDLTDDDRHAEALRLLRAHPALGQARDYVIARAHEAKAHLAVVPPGPVRDALEAFADLVAVRSS

SEQ ID NO: 19725 - protein, 424 aa, Medicago truncatula
MGMLSKEEKEKAAVGMAATMVATVRGSKQKGIAKSWMVVFETGESRVEDIDKHSIMRRTGLPARDLRVFDTKLSQPSSILGREKAIIVNLEHIRAIITSNEVLMINSIDPFFIRFLQDLQKRVLLSNNIQVPMRGSDDVDSHCEVKPLLEELLPSVQSPTHFPNNESIGVAGVSAPKQLPFEFKALESCIESACTCLEYETQRLEEETYPALGELTSQISTLNLERVRQIKTRLVALSGRVHKVAYQIENLLDDDNDMAEMYLTQKLDAQLSDQTSVKEAYNEAFDEDIDKSERSYSDTYKSYDHKPDVEELEMLLEAYFAQINGILQKLSTLSEYVGNTKDYINIMLDDKQNQLLQASIILNTMNFIVNLGILVVGVFGMNIHIDLYQGQPSQFWATTSGTVLGCVLLFLVSIWWGKRYLLPQ

SEQ ID NO: 19726 - protein, 648 aa, Arabidopsis thaliana
MKNSAAIFLTSSLILLLQTLHGVKAGFICVGSSFPTNSSYQKNRDSLFSTLSDKVTTNGGFYNASLDGVHVVGLCRRDYDRQGCINCVEESIRQIKTSCSNRVQSFHCNSDDRERVSCLVRTTDQSTYRILELGPATNDPSPVAIDTFAKNMTLFRQEWEAMVDRTLEAVTIDNSTTVLKYYGALKSEFSEFPNVYMMMQCTPDINSGACKRCLQASVTYFRDQNWGRQGGGICRPSCVFRWEFYPFYGAFANVTRVPAPPRALIPRTEAISITRLKGGIIAIFVVPIVINLLVFIGLIRAYTRIRKSYNGINEAQYDYGGQSKLRFDFRMILTATDDFSFENKIGQGGFGSVYKGKLPGGEEIAVKRLTRGSGQGEIEFRNEVLLLTRLQHRNLVKLLGFCNEGDEEILVYEFVPNSSLDHFIFDEEKRLLLTWDMRARIIEGVARGLVYLHEDSQLRIIHRDLKASNILLDAYMNPKVADFGMARLFNMDQTRAVTRKVVGTFGYMAPEYVRNRTFSVKTDVYSFGVVLLEMITGRSNKNYFEALGLPAYAWKCWVAGEAASIIDHVLSRSRSNEIMRFIHIGLLCVQENVSKRPTMSLVIQWLGSETIAIPLPTVAGFTNASYQAEHEAGTLSLNELSITELSPR

SEQ ID NO: 19727 - protein, 132 aa, Boechera holboellii
ASWHPPWYSSYTAHYREAECMKEAMEELLYSYGTDIVFNGHVHAYERSNRVYNYELDPCGPVYIVVGDGGNREKMAIEHADEPGKCPEPLTTPDPFVGGFCAWNFTPSGKFCWDQQPDYSAMRESSFGHGIL

SEQ ID NO: 19728 - protein, 714 aa, Legionella pneumophila str. Lens
MIKKIHRWLPLLVLIGLLVLFFSLHLDKYLSFNALRENHALLIAWTQTHYFIAPLIFIVFYTTAVAISIPGAVLLTLTGGFLFGVFWGVLFVVISATLGATILFFAVRSALGDWFAQKASGWIERMRRGFQHNAFSYLVTLRLIPLFPFWAVNIVPALLNIRAKTFVTATFLGIIPGTTVYVMVGNGLSQIFAANQTPNLGIIFELQILGPLLALAVLSLMPVLYQFSTRKHQNHHSFSDISRVINCDLAIIGGGAGGLSLASGCSQLGLKVVLVESGKMGGDCLNYGCIPSKSLLAAAKTFYYAKHATHFGVHTEAIKVNFEQVMQHVHQIIDNISEHDSVQRFESLGVQVIKQVGKFLTPDTLQAGDSIIKAKRFVIATGSSPFIPPIPGLDAVSYFTNETIFDLKEQPEHLIVIGGGPIGCELAQAFAMLGSKVTLLEGLNLLPKDDPDCVAVLRTQMKSMNILIYEQIEITQINSHPDKGISVCFEFQNTQFIITASHLLIATGRRANVKPLDLEKAGVKLTSKGVEVNKYLQTSNKKIYALGDVTGLYQFTHMASYQAGIVLRNIVFKLPSKVDYRAIPWVTYTDPELAHVGIGVSDALRHPDTQIIEWPFVDNDRAQTEHTLNGKIKIITDKKARILGVTIVGPHAGELILPWVMAIREKKTLRSFTDVIVPYPTLSEISKRVAGSFYAPKLFSNKTRMLVRWLQKIG

SEQ ID NO: 19729 - protein, 324 aa, Legionella pneumophila str. Lens
MPDITLVEAVTQALAYELAHDENVVVFGEDVGKNGGVFRATVGLQDRFGENRVFDTPLAESMIAGLAVGMSIQGLKPVAEFQFMGFIYPAMNQIISHAARMRNRTRGRLHCPLVYRAPFGGGIRAPEHHSESTEALFAHIPGLQVVIPSSPKRAYGLLLAAIRNPDPVIFLEPKRIYRLVKQPVPDDGQALPLGKCFTLQQGDDLTLISWGASMHETLQAAKQLTDEGISCDVIDVATIKPLDIETILSSVEKTGRCVVVHEGAKTCGVGAEISAQIMEHCMADLLAPVQRVTGYDTVMPYFQLEKQYIPSIARIKNTVMSIME

SEQ ID NO: 19730 - protein, 132 aa, Boechera holboellii
ASWHPPWYSSYTAHYREAECMKEAMEELLYSYGTDIVFNGHVHAYERSNRVYNYELDPCGPVYIVVGDGGNREKMAIEHADEPGKCPEPLTTPGPFMGGFCAWNFTPSGKFCWDQQPDYSAMRESSFGHGIL

SEQ ID NO: 19731 - protein, 339 aa, Escherichia coli CFT073
MTVALFPCKGADMSERHLPDDQSSTIDPYLITSVRQTLAEQSAALQNLSKQLDSGQYQRVLNLIMNCKGHVILSGMGKSGHVGRKISATLASTGTPSFFIHPAEAFHGDLGMITPYDLLILISASGETDEILKLVPSLKNFGNRIIAITNNGNSTLAKNADAVLELHMANETCPNNLAPTTSTTLTMAIGDALAIAMIHQRKFMPNDFARYHPGGSLGRRLLTRVADVMQHDVPAVQLDASFKTVIQRITSGCQGMVMVEDAEGGLAGIITDGDLRRFMEKEGSLTSATAAQMMTREPLTLPEDTMIIEAEEKMQKHRVSTLLVTNKANKVTGLVRIFD

SEQ ID NO: 19732 - protein, 427 aa, Aspergillus oryzae
MSSKHLDWILEKTLENIVSAGSSSTATTRLEAFTRAVRIRRITVSRTPSTQDLSGGIQNSLLPYHSYNYELVHGACCENVIGYLPLPLGLAGPMVIDGQAYFIPMATTEGVLVASASRGCKAINAGGGAVTTLKGDGMTRGPCLGFPSAKRAAEAQRWAESPIGRRVLTDTFNATSRFARLQSLTFAQAGTYLYIRFRTTTGDAMGMNMISKGIEQALQAMTAHGFPDMNTITLSGNFCADKKSAAINWIGGRGKSVIAEATIPAETVRKVLKTEVDALVELNTAKNLVGSAMAGSMGGFNAHASNLVQAVFLATGQDPAQNVESSSCITTMKNIDGNLHIAVSMPSMEVGTIGGGTILEAQGAMLDLLGVRGAHPTDPGANARRLARIIAAAVLAGELSTCSALAAGHLVNAHMQHNRSAASSRVN

SEQ ID NO: 19733 - protein, 671 aa, Mycobacterium bovis AF2122/97
MSFVLVSPSQLMAAAADVAGIGSAISAANAAALAPTSVLAAAGADEVSAAVAALFSAHAGQYQQLGARAALFHEQFVQALTGAASAYASAEATNVEQQVLGLINAPTQALWGRPLIGNGADGTAANPNGGAGGLLYGNGGNGFSQTTAGLTGGTGGSAGLIGNGGNGGAGGAGANGGAGGNGGWLYGSGGNGGAGGAGPAGAIGAPGVAGGAGGAGGTAGLFGNGGVGGVGGDGGQGGNGAGAGASGTKGGDAGAGGAGGAGGWIHGHGGAGGDGGAGGAGGQASPGAPGPPSQPGGAGGAGGAGGRGGDGGSAGWLSGNGGDAGNGGGGGTAGGAGNGGQFGGDGGTGGTGGTAGAGGNGGRGAVLFGHGGNAGHGGAGGNGAAAGAGGEHVMATAGKGGTGGVGGDGGGGAGGGGGLLYGNGGAGGNGGAGGAGNSGGDGGTGLNAALGGNGGGGGVGGNAGAGGTGGSAGWLSGNGGAGGSGGSAGAGGAGGKGGDTPNGLAINPGIGGNGGDTGNAGNGGNGGSAARLFGGGGAGGAGGTGSTAGSGGSGGTNPPTGLQAAGGNGGSGHAGGHGGNGGGAGLLGGGTGGNGGGGGQGGLGAAAGGVDGNGGNGGNGGKGGDAQLVGDGGNGGNGGKGGAGLIAGLDGAGGAGGTRGLIFGNAGTPGQ

SEQ ID NO: 19734 - protein, 490 aa, Acinetobacter sp. ADP1
MQLPVYHSTQIQAWEQRWFEQQNSSLGLMQQAAWAISQKLHHHILKNSLSIKKIAVWCGSGKNAGDGYYIAIYLKSLGYNISIFTMPAGQSTDLKQAVADAHANQLPISNHFDVNNDYDCHIDALFGIGLNRELDQNWQSIVHHFNRLSGFKVAVDLPSGLNANTGASLPVAIKVDVTYTILAEKIGLFTGQATEYVGQLELISLIPKDNMLQAFAYLSTQQVKLPIRQSFGHKGTYGHVLVVGGHKNMGGAVIMAAEAAFHAGAGKVTVICDALHHSAILARAPNIMIKDINQIDAQEIEQILKEIDAVCFGMGLGRDQWAKQTFDVWFQQLHQQQKLHVVLDADALWFLSDQSIKLGQNFYMTPHAGEAARLLDISVAQIEQDRFTAIRQLQQRYNGAWVLKGAGSLSLFHDKIMICTAGNAGMGTGGMGDVLAGMIASLKAQFDDQICLSDVVTLHAQAGDLLAQNGQRGIQAYDMAKAIYHVVNHP

SEQ ID NO: 19735 - protein, 461 aa, Thermosynechococcus elongatus BP-1
MVRSEWIAARKGHDNVTQMHYARQGIITEEMHYVAQRENLPPELIRDEVARGRMIIPANINHPNLEPMAIGIAAKCKVNANIGASPNSSNLEEELAKLRLAVKYGADTVMDLSTGGGDLDAIRTAIINASPVPIGTVPVYQALESVHGSVERLTPDDFLHVIEKHAQQGVDYMTIHAGLLIEYLPLVKNRITGIVSRGGGILAKWMLYHHKQNPLYTHFRDIIEIFKKYDVSFSLGDSLRPGCLHDASDEAQLAELKTLGQLTRKAWEHDVQVMVEGPGHVPMDQIEFNVRKQMEECSEAPFYVLGPLVTDIAPGYDHITSAIGAALAGWYGTAMLCYVTPKEHLGLPNAEDVRNGLIAYKIAAHAADIARHRPGARDRDDELSRARYNFDWNRQFELALDPERAREYHDETLPADIYKTAEFCSMCGPKFCPMQTKVDAEALAELEKFLAKDKDQVSASA

SEQ ID NO: 19736 - protein, 420 aa, Bradyrhizobium japonicum USDA 110
MSAVGNEPLARQALAFVLAGGRGSRLLELTDRRAKPAVYFGGKSRIIDFALSNAVNSGIRRIAVATQYKAHSLIRHLQMGWNFFRPERNESFDILPASQRVSENMWYVGTADAIYQNIDIIESHNARFIVVLAGDHIYKMDYEVMLRQHVDSGADVTVGCLEMPRAESSGFGIMHIDENGWIQEFLEKPADPPPMPGKPDVSLASMGIYVFDAKFLFDQLKRDAEDPSSNHDFGKDIIPYIVKNGRAIAHQFSTSCVRSGDDPRAYWRDVGTVDAYWAANIDLTDVVPELDLFDRAWPIWSYSEITPPAKFVHDEESRRGQAVSSLVSGGCIISGASLRRSLLFTGVRINSYANVENAVIMPYVNVGRGARLKNVVIDRGVEIPEGLVIGEDPELDAKRFRTTEQGISLITQPMIDRLNT

SEQ ID NO: 19737 - protein, 311 aa, Arabidopsis thaliana
MFYDGYAYHGTTFEQTYRCYPSSFIDKPQIESGDKIIMPPSALDRLASLQIDYPMLFELRNASTDSFSHCGVLEFIAEEGVIYIPYWMMQNLLLQEGDMVRVRNVTLPKGTYVKLQPHTTDFLDIANPKAILETALRNYSCLTVGDSIMVPYNNKKYFIDIVEAKPSNGISIIETDCEVDFAPPLDYKEPERPVAPAPAKAKEVDVAEAEPKFNPFTGSGRRLDGRPLSYEPQPGAANSNGQSHPVASSSSSGSEKATQQNRGKLVFGSNVERSTKETTKVGAGKDRKQEEEAEKEAKFQAFSGKKYSLRG

SEQ ID NO: 19738 - protein, 496 aa, Oryza sativa (japonica cultivar-group)
MATLAPALVLLPEWGSGHLMSMLESCKRVLLAGAGGGREFSITLLVMRPPTDEAGSEVEAHVRREAASGLDIRFHRLPAVDPPADAAGVEEFIARYIHLHAPHVRDAVAGMGRPVAALVLDMFAAPMVDVARDLGVPSYVFMSSTGAMLALMLHLPVLHDRVAVEFHEVDGEVDVPGLPPLPPASMPCPVVDKKSPNYTWFVRLGDRFMDATGIIANTADELEPGPLAAIADGRCVPGRAAPPVYPIGPVLSLGGNDKRDSSEPPHECIAWLDGQPPASVVFLCFGSMGWFEAAQVVEITAALERSGHRFLWVLRGPPPAAESGTGAPDGSEHPTDANLDELLPEGFLERTKGRGMVWPTWAPQKEILAHPAIGGFVTHGGWNSVLESLWHGVPMAPWPLYAEQHLNAFELVRDMGVAVPLGVDRERDNFVEAAELERAVRSLMDDASEEGKKAREKAAEMKAVCRSAVAAGGGSSHAALQRLSEALHQGAALPKN

SEQ ID NO: 19739 - protein, 1112 aa, Solanum pimpinellifolium
MMMVSRKVVSSLQFFTLFYLFTVAFASTEEATALLKWKATFKNQNNSFLASWIPSSNACKDWYGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEISYLRSLTELDLSDNALNGSIPASLGNMNNLSFLFLYGNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASFGNLNNLSRLNLVNNQLSGSIPEEIGYLRSLNVLDLSENALNGSIPASFGNLNNLSRLNLVNNQLSGSIPEEIGYLRSLNDLGLSENALNGSIPASLGNLNNLSMLYLYNNQLSGSIPEEIGYLSSLTYLSLGNNSLNGLIPASFGNMRNLQALILNDNNLIGEIPSSVCNLTSLEVLYMPRNNLKGKVPQCLGNISNLQVLSMSSNSFSGELPSSISNLTSLQILDFGRNNLEGAIPQCFGNISSLEVFDMQNNKLSGTLPTNFSIGCSLISLNLHGNELEDEIPRSLDNCKKLQVLDLGDNQLNDTFPMWLGTLPELRVLRLTSNKLHGPIRSSRAEIMFPDLRIIDLSRNAFSQDLPTSLFEHLKGMRTVDKTMEEPSYESYYDDSVVVVTKGLELEIVRILSLYTVIDLSSNKFEGHIPSVLGDLIAIRILNVSHNALQGYIPSSLGSLSILESLDLSFNQLSGEIPQQLASLTFLEFLNLSHNYLQGCIPQGPQFRTFESNSYEGNDGLRGYPVSKGCGKDPVSEKNYTVSALEDQESNSEFFNDFWKAALMGYGSGLCIGISMIYILISTGNLRWLARIIEKLEHKIIMQRRKKQRGQRNYRRRNNHF

SEQ ID NO: 19740 - protein, 331 aa, Zea mays
MATSTSQHALSSIKLLSTGCLHPDKRNCRVLSVSVGRRCPSARNLGLLCASNSQSSVIEPVQLPRSPKSGVAPKKSGESALILIRHGESLWNEKNLFTGCVDVPLTPKGVDEAIEAGKRICNIPVDVIYTSSLIRAQMTAMLAMMQHRRKKVPIILHNESEQAHMWSQIYSEETKKQSIPVITAWQLNERMYGELQGLNKQETADRFGKEQVHEWRRSYDIPPPNGESLEMCAERAVAYFKDQIIPKLVDGKHVMIAAHGNSLRSIIMHLDKLTSQEVITLELSTGIPMLYIFKEGKFIRRGSPAGPSEAGVYAYTKNLAQYRQKLDGIVQ

SEQ ID NO: 19741 - protein, 132 aa, Boechera holboellii
ASWHPPWYSSYTAHYSEAECMKEAMEELLYSYGTDIVFNGHVHAYERSNRVYNYELDLCGPVYIVVGDGGNREKMAIEHADEPGKCPEPLTTPDPFMGGFCAWNFTPSGKFCWDQQPDYSAMRESSFGHGIL

SEQ ID NO: 19742 - protein, 1112 aa, Solanum pimpinellifolium
MMMVSRKVVSSLQFFTLFYLFTVAFASTEEATALLKWKATFKNQNNSFLASWIPSSNACKDWYGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEISYLRSLTELDLSDNALNGSIPASLGNMNNLSFLFLYGNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASFGNLNNLSRLNLVNNQLSGSIPEEIGYLRSLNVLDLSENALNGSIPASFGNLNNLSRLNLVNNQLSGSIPEEIGYLRSLNDLGLSENALNGSIPASLGNLNNLSMLYLYNNQLSGSIPEEIGYLSSLTYLSLGNNSLNGLIPASFGNMRNLQALILNDNNLIGEIPSSVCNLTSLEVLYMPRNNLKGKVPQCLGNISNLQVLSMSSNSFSGELPSSISNLTSLQILDFGRNNLEGAIPQCFGNISSLEVFDMQNNKLSGTLPTNFSIGCSLISLNLHGNELEDEIPRSLDNCKKLQVLDLGDNQLNDTFPMWLGTLPELRVLRLTSNKLHGPIRSSRAEIMFPDLRIIDLSRNAFSQDLPTSLFEHLKGMRTVDKTMEEPSYESYYDDSVVVVTKGLELEIVRILSLYTVIDLSSNKFEGHIPSVLGDLIAIRILNVSHNALQGYIPSSLGSLSILESLDLSFNQLSGEIPQQLASLTFLEFLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIMQRRKKQRGQRNYRRRNNRF

SEQ ID NO: 19743 - protein, 298 aa, Pseudomonas putida KT2440
MATFQVVTEQHGELNCWRISSDRAELLIAQQGAQVLSYQQVGEPPLLWLSDQAIFRQGKSVRAGVPVCWPWFGNLQRNPQAVQAMYQGTPAPAHGLARTRDWQLLGIEEVGETLRIEFELPEAQGDLPGWPHDVELKLVVEMGAELKLSLTSRNMGNTPVTISQALHSYFAVSDVRQARVEGVDGLGYIETLAGWEQRQQQGALTFAGETDRIYLNTPQTLSIVDPHWNRRITLTSSGSRSAVIWNPWTERAKELADMADDGWQRMLCIETANVWDDLVELKPGASHSLGVQIGCENI

SEQ ID NO: 19744 - protein, 132 aa, Boechera holboellii
ASWHPPWYSSYTAHYREAECMKEAMEELLYSYGTDIVFNGHVHAYERPNRVYNYELDPCGPVYIVVGDGGNREKMAIEHADGPGKCPEPLTTPDPFMGGFCAWNFTPSGKFCWDQQPDYSAMRESSFGHGIL

SEQ ID NO: 19745 - protein, 238 aa, Glycine max
  misc_feature (125)..(125): Xaa can be any naturally occurring amino acid
  unsure (1)..(238): unsure at all Xaa locations
MLRRDNITHSHPKESRREEKQRGRRHRRRGSTSSSSMATPDSDATTQPQDSDTAPNSSPPNALVPAAPAVCLLRFATDSAGGALMGSVFGYGAGLFKKKGFKGSFVEAGSYAKTFAVLSGVHSLXVVCILKRLRGKDDVINAGVAGCCTGLALSFPGAPQALLQSCLTFGAFSFIMEGLNKQQPALAVPMSWKKTVQHNACPPLVLPLQLSLPDELKDAFSFFSESLKKRSKGPYPTS

SEQ ID NO: 19746 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 19747 - protein, 132 aa, Boechera holboellii
ASWHPPWYSSYTAHYREAECMKEAMEELLYSYGTDIVFNGHVHAYERSNRVYNYELDPCGPVHIVVGDGGNREKMAIEHADEPGKCPEPLTTPDPFMGGFCAWNFTPSGKFCWDQQPDYSAMRESSFGHGIL

SEQ ID NO: 19748 - protein, 168 aa, Zea mays
MEYGQQGQRGHGATGHVDQYGNPVGGVEHGTGGMRHGTGTAGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGSYATGTEGTGEKKGIMDKIKEKLPGQH

SEQ ID NO: 19749 - protein, 286 aa, Chlamydia muridarum Nigg
MSVVTACITPFKADLSIDFAALESVVRSQEHAGNGVFLFGSTGESLSLAYEEKFAALSFVSTLKLNVPLFLGVTATSIQEAISWIEFAQRWPIDGFFVPTPLYTKPGLYGQKVWFEKILSVSKKPIILYNNPSRTGVALHPEVVKSLASHPLCMGVKDSGGSTQACTLFAESGVRVFCGDDGMWPEMRLSGASGLVSVLSNVWPELARDYVAQCRSIDAWKKTCSWLELSVNPLGIKALMAAQKMIECELVRPPLSIRDFQERDQLADILACRAILQAELLSVCVQ

SEQ ID NO: 19750 - protein, 483 aa, Burkholderia xenovorans LB400
MMERGGDMQRSTETTELKAGLKQRHMTMIALGGVIGAGLFVGSGVVVQQAGPAAVLSFLITGALVVLVMRMLGEMACAMPAVGSFYEYARLAFGGKRACGNLAGFLTGWMYWYFWVIVVAVEAVAGAKLVQFWLPDVPAWAISLVLLVTLTATNLVSVGSYGEFEFWFASIKVAAIMVFLFLGSMYVLGLWPASKHVTEVLPTLFSHGGLMPKGIGPVLSGAVAATGFYFGAEIVTIAAAEAQEPAKAVARATNSVITRVLVFYVGSILLVVALVPWNSPKMATPYVSALDAMGIPAAASVMNAIVLTAVLSALNSGLYAASRMIFALTRHGDAPAALARVNRRGVPVRAILIGTVFGYASVVMSYVSPDTVFAFLVNSYGTVAIFVYVLIAISQLKLRARIERDAPQTLRVRMWCYPYLTWVSIIGMVGILVAMAFIPEQRQPLWFGVASLGVLLLAYPLRGRRSDAMPGEPETVEYRHHHR

SEQ ID NO: 19751 - protein, 341 aa, Thiobacillus denitrificans ATCC 25259
MSRPAAWFAVRASVCFFAILLGVAGLAACATPVEQPCRDDAAAPRLEADRVIAADGAVLPLSVWRPPGEVRAVVLALHGFNDYGHAFADVGPFLARRGIVTYAYDQRGFGRTAGRGLWPCRGRLVDDARSVAALLRETYPGRPLYLVGESMGGAVAMRLLADTPAAADGAVLVAAAVWSRATMNPLQRAALWLVAHTLPDLQLSGRGLGIRASDNDAMLHALREDPLVLKKARADTLWGLADLRDGAFAAAPRLTTPTLVLYGERDEIIPRRPFCRTLATLPPAARVAVYPDGYHMLTRDLGASAVLADLAAWLGDRDAPLPSGREFERQRERALNNLCAS

SEQ ID NO: 19752 - protein, 332 aa, Oceanobacter sp. RED65
MSQYTEILLTKRPDGNPIGPHMFEVVKKDMPQAGPGEILIKQTHMSLDPAMLGWMNPDKESYIPPVELGTVMRSSGLGEVVESNHPDFAVGDTVMGMTGWAEYIVSNGQGFNKVQTGVDAETALSIFALPGLTATQGLKKIGEPKAGETLVVTGAAGSVGSIVGQIAKADGLRVIGVVGDDEKAQWITEELGFDGAINYKTDDLAAKLEELTPNGVDVYFENTGGPIQAEVFKRLNAHARAVVCGMIADYTNPTPPPGPNWIPLIKKRIRVQGFAMPDHFKDVPELLGILTPYVMQGKIKYRSHILEGLESAMTGLNLFFTGGNKGKLIVKL

SEQ ID NO: 19753 - protein, 495 aa, Vibrio vulnificus CMCP6
MDLRKALYTAKQVREGEVGAAANAGVTLYELMERAGRATFAVILNYYPAVSRLCVVCGKGNNGGDGYVVARLARQQGLHVVLIQSGNAESLSGDAKQAQQAWRDAGGEISDTASLNAALSDCDLVVDALLGTGLAGAVREKMAKVIDTVNLAGKPIVSVDIPSGLCADTGQALPDAIHADHTVTFIGTKQGLVTGKARAFCGAIHFADLGVGAEFSKLVPSFKMTIERDEIAQWRLTRDRCAHKGDHGRVVLLGGNRGMSGAISLAATACARSGAGLVAALTHPESALPLQIHCPEVMTLGYNEDKRELEKKLDWADVLVVGPGLGTDEWAKKRWNDIANFQGPMVLDADALNWLARYPNHNDRRIITPHPGEAARLLGCSVNEVEADRFAAISVLQSQYGGVVVLKGAGTLICDGTQTFACSAGNPGMATGGMGDVLSGVIGALLAQKLPLLRAASLGVLLHSCAADICATEKGEIGLLASDLFDKIRQLLNAD

SEQ ID NO: 19754 - protein, 371 aa, Aspergillus oryzae
MTIAKTYNILVLPGDGIGPEIMAEATKVLSAFNTSTVQFNTRSELIGGCSIDLHGKPITDAVKEAALASDAVLFAAVGGPKWDNMRRGLDGPEGGLLQLRKAMDIYANLRPCSADSPSRSVAREFSPFRQEIIEGVDFVVVRENCGGAYFGRKVEEDEYAMDEWAYSTSEIQRITRLSAELALRHDPPWPVISLDKANVLASSRLWRRVVEKTMAEEYPQVKLVHQLADSASLILATNPRVLNGVILADNTFGDMISDQAGSIVGTLGVLPSASLDGLPSETRRRTNGLYEPTHGSAPTIAGKNIANPVAMILCVALMFRYSLDMEREAQQIEEAVRTVLDSGIRTPDLGGKAGTTEVGDAIVAVLRGQKL

SEQ ID NO: 19755 - protein, 448 aa, Oceanobacter sp. RED65
MLVNNDNSVAPMTQSKPLLSESLTGEQISELDAKHVWHPYSSFNSPLLPFPVESTEGVRIRLKDGRELIDGMASWWSAVHGYGHPVLKQAAHDQIETMSHVMFGGLTHEPAVTLCEKLVKLSPDGLNKVFICDSGSVSVEVAMKMAFQYALSQGNRERNKLLTVRSGYHGDTFATMATCDPVNGMHHMFENILPKHIFAEAPPCKFEEAFSESHIQDLKDKLVQHQQEVAAIILEPIVQGAGGMRFYSPDYLKRVRELCDEYDVLLIADEIATGFGRTGKMFACEHAGITPDILCVGKALTGGFMSLAATLCTDKVAKGICEGEAGVFMHGPTFMANPLACSVANASLDLLMSGEWQQQVANIESGLKIGLGPAKALSQVEDVRVLGAIGVIELHEPVDMPTVQPQFVQEGVWVRPFGRLVYVLPPFVIENEDLAHLTKAMVSVVSRL

SEQ ID NO: 19756 - protein, 579 aa, Nicotiana tabacum
PFLCSTSWLLMELVVDSGVRKMEGEAMTRNETLICAPIMADTVDQMLNLMQKAKISGADLVEVRLDSLKSFNPQSDIDTIIKQSPLPTLFTYRPTWEGGQYAGDEVSRLDALRVAMELGADYIDVELKAIDEFNTALHGNKSAKCKVIVSSHNYDNTPSSEELGNLVARIQASGADIVKFATTALDIMDVARVFQITVHSQVPIIAMVMGEKGLMSRILCPKFGGYLTFGTLEVGKVSAPGQPTIKDLLNIYNFRQLGPDTRIFGIIGKPVSHSKSPLLYNEAFRSVGFNGVYMPLLVDDVANFFRTYSSLDFAGSAVTIPHKEAIVDCCDELNPTAKVIGAVNCVVSRLDGKLFGCNTDYVGAISAIEEALQGSQPSMSGSPLAGKLFVVIGAGGAGKALAYGAKEKGARVVIANRTYERARELADVVGGQALSLDELSNFHPENDMILANTTSIGMQPKVDDTPIFKEALRYYSLVFDAVYTPKITRLLREAHESGVKIVTGVEMFIGQAYEQYERFTGLASSKGTFQENYGWILRARSLSLFNAALLVTFPPKSLHSCVIAMVLDSSALPFVLRRN

SEQ ID NO: 19757 - protein, 644 aa, Thermosynechococcus elongatus BP-1
MEDKNTMVASPPSADAALKRSKIEALKERSQHLREPVATELLEPTNRFSEEGAQILKFHGSYQQDNRDNRVKGQEKDYQFMLRTRSPAGYIPPQLYLTLDRLAEEYGNRTLRATTRQGFQLHGILKKNLKAAIAAIVRSMGSTLGACGDLNRNVMAPPAPFRDRPEYTLAYEYAHRIADLLTPQTGAYYEIWLDGEKVISAEEHPDVKAARQRNGNGTIFPNNEEPIYGDHYMPRKFKCCVTVPGDNSVDLFSQDLTLVVITNPQGQLEGFNIYAGGGLGRTHNKEETFARLADEIGFVRAADVYDAVKAIVATQRDYGDRYNRRHARLKYLIHDWGVEKFKAKVEEYFGKPLEPFRPLPPWRYQDFLGWHPQGDGKFFYGLSIANGRILDQGNFKLKSALKKIVEDFHLPLRVTPHQNLLLCDISPEQQDAIQHLLEEHGVRDVSAIDPLERYSMACPALPTCGLAITESERAIPGVLERIRRLMDRLGLKDEHFVIRMTGCPNGCARPYLAELGFVGIVPGAYQTWLGGSPDQTRLAEVYIERLPIAELETVLEPLLVFYRDRRQQGESFGDFCHRVGFAALRQFAANYVPTAPPKRYRVDVRADQYQQLKELAAAEGRSLAAVTREAIQHYLEQSRQNKQG

SEQ ID NO: 19758 - protein, 324 aa, Cymbidium hybrid cultivar
MESGSFPVINMELLEGSSRPEAMAVLRDACQNWGFFELLNHGISHELMNRVEAVNKEHYRRFREQRFKEFAAKTLASGEEVDSDNLDWESTFFLRHLPTSNISEVPDLDDDCRSTMKEFAREVEKLAESLLDLLCEDLGLEKGYLKRVFCGGSDGLPTFGTKVSNYPPCPKPELIKGLRAHTDAGGIILLFQDDKVSGLQLLKDGEWVNVPPMRHSIVINIGDQLEVITNGKYKSVLHRVVAQTDGNRMSIASFYNPGSDAVIFPAPALVEREAEEKKIETYPKFVFQDYMNLYVRQKFEAKEPRFEAMKSMESVSSSQLIPTA

SEQ ID NO: 19759 - protein, 829 aa, Vibrio vulnificus CMCP6
MKMTRRAFVKANAAASAAAVAGITLPASAANLIASSDQTKITWDKAPCRFCGTGCSVLVGTQNGKVVATQGDPEAPVNKGLNCIKGYFLSKIMYGQDRLTQPLLRMKDGKYDKEGDFTPVSWDVAFDTMAEKWKASLAKKGPTSIGMFGSGQWTVMEGYAAAKMMKAGFRSNNIDPNARHCMASAVVGFMRTFGIDEPMGCYDDFEHADSFVLWGSNMAEMHPVLWTRITDRRLSHPHVKVNVLSTYYHRSFELADSGYIFKPQSDLAIANFIANYIIQNDAVNWDFVNKHTNFKQATTDIGYGLRDDDPLQKQAKNPNSGNMTSISFEEYKKSVAPYTVEKASEMSGVAQDKLIELAKQYADPNTKVMSLWTMGMNQHTRGVWMNSLVYNIHLLTGKISTPGNSPFSLTGQPSACGTAREVGTFAHRLPADMVVANPKHRAIAEKIWKLPEGTIPPKPGFHAVLQDRMLHDGVLNCYWVQCNNNMQAGPNINGERLPGYRNPENFIVVSDPYPTATAQAADLILPTAMWIEKEGAYGNAERRTQAWYQQVGTVGEAKSDLWQVMEFSKRFKMEEVWPEELLAKAPQYRGKTMYDMLFANGQVDKFPLSEARQLNDDSHHFGFYVQKGLFEEYAEFGRGHGHDLAPYDVYHTVRGLRWPVVDGKETLWRYKEGSDPYAKKGSGWDFYGKPDGKALIISAPYEAPPESPDAEYDMWLCTGRVLEHWHTGTMTRRVPELYKAVPDAVCYIHPEDAKARGLRRGDEVLISNKRGEVRVRVETRGRNRPPQGLVFVPFFDARILINKLILDATDPLSKQTDFKKCPVKITKVA

SEQ ID NO: 19760 - protein, 229 aa, Glycine max
EALRFIVIIIIIIQRVHRMSSSSGQSSGYDLSFKILLIGDSAVGKSSLLVSFISNSAEDIAPTIGVDFKIKMLTVGGKRLKLTIWDTAGQERFRTLTSSYYRGAQGIILVYDVTRRDTFTNLSLVWSKEVELYSTNQNCVKMLVGNKVDRDSERVVSKEEGLALAEELGCLFFECSAKTRENVERCFEELALKIMEVPSLLEEGSTAVKRNILKQQQQPQASEFGGCCS

SEQ ID NO: 19761 - protein, 349 aa, Xanthomonas campestris pv. campestris str. ATCC 33913
MSAASVKGPIHHGEPCVPSSGLDPRVAPTPHPATPPQRAGKARRFGSLRRWVDSQTDEPLDEARADRIDWLRALPFIALHLACFAVFWVGVSWFAVSMAVALYALRMFALTGFYHRYFSHRAFKTSRVVQFVFAAIAATCVQRGPLWWAAHHRNHHRHTDTGRDPHSPAQHGFWWSHTGWFLTPRNFRTDWEVIPDLRRFTELRFLDRFDIVMPVLLALGLYLLGDWLAAAAPGLHTSGAQLLVWGFVLSTVALFHATFTINSLAHRFGSRRFDTRDDSRNNWLLALLTFGEGWHNNHHFFPGSARQGVRWWEYDMTWYGLTVMSWVGLVWDLKPMPAMLTRRAGRVAR

SEQ ID NO: 19762 - protein, 896 aa, Bradyrhizobium japonicum USDA 110
MPDAMVAARESKAASGTAQQVDVAVVGAGFAGLYLLHRLRQAGFTTVALEEAGDVGGTWYWNRYPGARCDIQTIDYSYTFDPELEAAWAWSEKYATQPEILRYLGFVADRYELRRDIRFGTKVTEAKWNEAAERWQLTTDNGAPVSCRHYIMATGCLSAPKPPEIDGVKDFKGEVYFTGRWPHDGVNLAGKRVAVIGTGSSGIQSIPLIAEQAAHLTVFQRTPNFALPAHNGPAPSDRMSLLQGDRAAYREQARQSMAGVPYPQQTAVSWQLSDAERRARFEEAWGKGDLVYILTQLWADQAVDVDGNKLICDLIREKISATVKDPETAAALMPHDHPFGAKRPCLDTNYYATYNRPNVTLVNLRQEPIKAITATGITTARRSVDVDVIVFATGFDAMTGAIRAVHPITGRGGKSLSDVWAQGPQTYLGLTVEGFPNFFMITGPGSPSVLSNMAVSIEQHVDWVVDRLRALRDAGFTTIEPTETAQAGWGQHMADCSMLTLHRLANTWYTGANVPGKVQGLMPYTGGVGPYRSICDEVVSRGMLGFKLTGPKVAAQCNDGEVVRLQPDVRLVLNLLATLNLPPIESMGALGARAFVNEFNKGRPAGRPIGDVVDGTLPGTDGPLPYRVYKPATPGPHPVVVYFHGGGWVLGDEQSDDPFCRDMVRRTGMMFVSVGYRHAPEHRFPTAAEDGYAATRWIAEHAAELGGKPGPVLVAGWSAGGNIAAVTCQLARDRGGPEIAGQLLVCPVTDCDFDRSSYNDNATGYFLTRSLMYWFWDLYCSPADRTDPRVSPLRGKVSGLPPAFVVTCEFDPLRDEGIAYAEAMAAAGVPVEQLKARGQFHSSFAMVDVVITGVPGRVQMAEALRRFAGLPPEVSLGDEHSHGHTSPGHKIAAAAS

SEQ ID NO: 19763 - protein, 433 aa, Synechococcus elongatus PCC 6301
MPAGVTSKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVITGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 19764 - protein, 356 aa, Prochlorococcus marinus str. NATL1A
MSIILSLETSCDESAAALVSNEKGKIDLLANEIASQIDEHANWGGVVPEIASRRHLENLPFLIEEVFAKSTLQIKDIDAVAATVTPGLAGSLLVGSITARTLANLHQIPFLGIHHLEGHLSSIYLSENHPKPPFLVLLVSGGHTELIKVDVKHKYQRLGRSHDDAAGEAFDKVARLLGLSYPGGPAIQKIAKSGDPKKFLFPKGRVSKPEGGFYPYDFSFSGLKTAVFRQIEKIRSENKKLPIEDIAASFEYIVAEVLVERSFKCALDQGLNSLVLVGGVAANVRLREMMLAKASKNSIDITLAPMEFCTDNAAMIGAAALLRLSSEGFKSSMELGVSARWPLEKSDSLYDPIPPF

SEQ ID NO: 19765 - protein, 562 aa, Idiomarina loihiensis L2TR
MPQTQRPLYIPYSGPNLLETPLLNKGSAFSKEERAAFNLTGLLPPRYESIEEQAERAYMQYRSFETPINKHIYLRAIQDNNETLFYRLLTDHLEEMMPIIYTPTVGDACEKFSDIYRSSRGLFISYSERDQIDDILRNATKQKVKVIVVTDGERILGLGDQGIGGMGIPIGKLSLYTACGGISPAYTLPVMLDVGTNNEKLLEDPMYMGARHKRIEQDEYDEFLDKFIKAVTRRWPGVMLQFEDFAQPNAMPLLRRYRDEVCCFNDDIQGTASVTVGTLLAACRQKGKKLSEQKVVFVGAGSAGCGIAEQIMIQMTAEGLTEEQAKRQIFMVDRFGLVMDTMDGLRDFQQALAQKTSDLNAWEYSGEYPSLLDVMHCAEPDILIGVSGQAGLFTEQVISTMAKNVERPIIFPLSNPSKHVEAHPADVLKWSEGKAIVATGSPFGEVEYDGRIYPIAQCNNSYIFPGIGLGVLSVKSERVSDEMLRVASKTLANASPSANGKGEALLPAFNDLTQLSKDIAFAVGKVAQQEGLALEIDDDTLRERIDNNFWKPEYRFYKRVSI

SEQ ID NO: 19766 - protein, 495 aa, Ralstonia solanacearum GMI1000
MNTETTSAAPSSDPVTFDTFGLHPDILRALAESGYTRATPIQAAAIPVVIAGRDVMGAAQTGTGKTAGFSLPIIQNLLPDANTSASPARHPVRALILTPTRELADQVYDNVAKYAKHTALRSAVVFGGVDMNPQTEQLRRGVEVLVATPGRLLDHVQQRSVNLSQVRMLVLDEADRMLDMGFLPDLQRIINLLPAHRQTLLFSATFSPEIKKLAASYLRHPQTIEVARSNATADNVRQVIYTVPDGHKQAALVHLLRQRAEQGLPSQCIVFSNSKIGCSRLARALEREKINANAIHGDKTQTERMQTLEAFKQGTVDVLVATDVAARGLDISQMPCVINFDLPFNAEDYVHRIGRTGRAGASGDALSLFAPGDERLLADIEKLIKRNLPRETLTDFDPTGEQARERERRERDERRNRTEIRRARERDERNGARVLDHTVVRPPFRPSEDPFFSRPYESNVPAEAAEAAKPAPAGGHPRSAKRPIAALLGGVPRKR

SEQ ID NO: 19767 - protein, 158 aa, Coccidioides immitis RS
MAQTRTMESRTGRTNQRYGTNGERLVAGVVPMSPDKSKVLLIQSARPGGWVLPKGGWELDEESAQQAACREAWEEAGVVCTVLRDLGVISDMRTPAQVTAKAPKVQYQFFEVRVDREEAQWPEMHKRKRQWVTYAQAAAALTNRPELLEALNRSSIKR

SEQ ID NO: 19768 - protein, 175 aa, Triticum aestivum
MAPTVMASSVTSVAPFQGLKSTAGLPVSRRSNGASLGSVSNGGRIRCLQVWPIDGIKKVEILSYLPPLSTEALLKQVDYLIRSKWVPCLEYSKVGFIFREHNASPGYYDGRYWTMWKLPMFGCTDATQVINEVEEVNKEYPDAYVRIIGFDNMRQVQCVSFIAFKPPGCEESGKA

SEQ ID NO: 19769 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHSVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDVFKTHPMNLLNERTLKGTFFGNYKPRTDLPGVVEKYMNKELEVEKFITHS

SEQ ID NO: 19770 - protein, 132 aa, Boechera holboellii
ASWHPPWYSSYTAHYREAECMKEAMEELLYSYGTDIVFNGHVHAYERSNRVYNYELDPCGPVYIVVGDGGNREKMAIEHADEPGKCPEPLTTPDPFMGGFCAWNFTPSGKFCWDQQPDYSAMRERSFGHGIL

SEQ ID NO: 19771 - protein, 421 aa, Saccharomyces cerevisiae
MMSSRVTIFTSCNDAYIYLLREGNSQAFPNAVGSKMVNLNTIPPKNGRDYYIALGLEGSANKLGVGIVKHPLLPKHANSDLSYDCEAEMLSNIRDTYVTPPGEGFLPRDTARHHRNWCIRLIKQALAEADIKSPTLDIDVICFTKGPGMGAPLHSVVIAARTCSLLWDVPLVGVNHCIGHIEMGREITKAQNPVVLYVSGGNTQVIAYSEKRYRIFGETLDIAIGNCLDRFARTLKIPNEPSPGYNIEQLAKKAPHKENLVELPYTVKGMDLSMSGILASIDLLAKDLFKGNKKNKILFDKTTGEQKVTVEDLCYSLQENLFAMLVEITERAMAHVNSNQVLIVGGVGCNVRLQEMMAQMCKDRANGQVHATDNRFCIDNGVMIAQAGLLEYRMGGIVKDFSETVVTQKFRTDEVYAAWRD

SEQ ID NO: 19772 - protein, 639 aa, Solibacter usitatus Ellin6076
MCGIAGFTRLNKYASRGVAQRITEALSHRGPDQQGVFEGSEATLCAVRLKIIDLAGGDQPILSDDGDTAIAFNGEIYNHREVRGELEALGHRFRSNCDTETVLRAFLQWDTAAFQRLRGMFAIALWTESRKRLLLVRDRMGIKPLYYYRSGDDLYFGSELKAILEHPDVPRTLDLSALDTYLSVNYVPGPQTLIRGIRKVPPGHLLEWRHGKAWCEAWWKRPDSGTRRISLGAAKEQLDVLMKDSVREHLVSDVPLGVWASGGLDSSAILHYAAAQTAGRLKTFSVSFEGRSFDESRYFREIAQVYGTDHHEFDLNPDVELQSAIEDFAYYSDEPSADAGALPVWFLSRMSRRHVTVALSGEGADELFGGYLTYQADRLARPFRMVPAGLRRLMRGALDRYMPVSDDKISLEYKLKRWIDGSLLNADEAHFFWNGTFSPEQLRQIRPGTNGNGLQRMVEGLNGPREVVQRYLDVDQSFYLPDDILYKTDRMSMAHSLEVRPPFLDHRIVEFAASLPQRLKIRGAKQKHVLRELMRGKLPESVLTRKKSGFDIPTHDWFRGTLRGMLMDTLTPDAIAATGVFDANAIDGLIRDHMERRINVGYHLWGLLTLFLWMKRWKVEALPPEEEMRQVPARVLATR

SEQ ID NO: 19773 - protein, 426 aa, Lactuca sativa
MPTDIEDEIKDEKNPRPLDEDDIALLKTYGLGPYSNSIKKAEKDVKEMAKRINDLCGIKESDTGLATPSQWDLVSDKQMMQEEQPLQVARCTKIINPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVQLGIDPPKGVLCYGPPGTGKTLLARAVANRTDACFIRVIGSELVQKYVGEGARMVRELFQMARSKKACIVFFDEVDAIGGARFDDGAGGDNEVQRTMLEIVNQLDGFDARGNIKVLMATNRPDTLDPALLRPGRLDRKVEFGLPDMESRTQIFKIHTRTMNCERDVRFELLARLCPNSTGADIRSVCTEAGMYAIRARRKTVTEKDFLDAVNKVIKGYQKFSATPKYMVYN

SEQ ID NO: 19774 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKAVQQVLIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 19775 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECGHVGWGVAVLVGVPSKDDEFKTHPMNLLNERTLKGAFFGNYKPRTDLPGVVEKYMNKELEVEKFITHS

SEQ ID NO: 19776 - protein, 478 aa, Chlamydia muridarum Nigg
MLCTIIRGPSFLEARNQLLRSLKKCRCFEMRADLLTVSDAELQKLILLAPISVLTWKKPPSCTPQAWVKKIQSLAKLHPTYLDLDKDFPEEEILHIRHLHPNIKIIRSLHTSEHTDITQLYTQMLASSIDYYKLAVSPASTTDLLNICRQKHSLPQNTTVLCLGKIGQSSRILSPILQNPFTYTIPTGADPVAPGQLSLNHHYFYNFTNLSPQSQICALIGDTSRSIGHLTHNPFFSQLSIPCPYVKLPLTPQELPEFFSSIRALPFLGISVTSPLKTAIIPFLDKQDSSVKLSGSCNTLVIRQGEIIGYDTDGEGLFSVLTQHNMDLSNQRVAILGAGGAARSIAARLSRTGCELLIFNRTKIHAEAIASRYQAQAFDIKDLPLHSVSLIINCLPPSSIIPQALAPLIVDINTLPKHNSFTQYARLKGCSIIYGHEMFAQQALLQFRLWFPTHSFNHLEKNFSRRAAVLASLFSIAA

SEQ ID NO: 19777 - protein, 105 aa, Brassica napus
MVKALQGAAQNLPADVNQLIDQLERHCLAPDGSLVTKSAYYDLQLAREEMSRERLRYLEAMAIYCEAAAMVEEYQPPTMMTKMTTNPTAVPLLSPPLLTQTKLFS

SEQ ID NO: 19778 - protein, 485 aa, Campylobacter jejuni RM1221
MKIVKRALTFEDVLLRPGYSEVLPKEVKIHTKLTKNITLNMPLISAAMDTVTEHRAAIMMARLGGLGVIHKNMDITSQVREVKRVKKSESGVIIDPIFVSPKASVAEALEIMAEYRISGVPVVDEDKKLIGILTNRDLRFESDFSNLVENVMTKMPLITAPKGCTLDDAEKIFSTNKVEKLPIVDEQGRLEGLITIKDLKKRKEYPDANKDNFGRLRVGAAIGVGQMDRVDALVEAGVDVVVLDSAHGHSKGIIDTVKAIKAKYPNLDLIAGNIATAAAAKALCEAGVDAVKVGIGPGSICTTRIVSGVGVPQISAIDECVEEANKFGIPVIADGGIKYSGDIAKALAVGASSVMIGSLLAGTDESPGELFTYQGRQYKSYRGMGSLGAMQKGSSDRYFQQGTAQDKLVPEGIEGRVPYVGSIRSVVHQLLGGLRSSMGYVGAKDIEDFQKRAEFVEITTAGLKESHVHDVTITHEAPNYKVNHQ

SEQ ID NO: 19779 - protein, 618 aa, Aspergillus oryzae
MKATTASVLLALLSAVNGRPTVDNRFPYKGPAVPVGDWVDPTINGNGKGFTRLVEPPAVKPASSHPTNNVNVISLSYIPDGIHIHYQTPFGLGQSPAVKWGTSPYHLVNVARGFSHTYDRTPSCSQMKAVTQCSQFFHEVSLPHLESGKTYYYQIPAANGTTESEVLSFTTARKAGDPTEFSVAVLNDMGYTNAQGTQKYLTKAASEAAFAWHGGDISYADDWSSGIMACEDSWPVCYNGSSTSLPGGVITSEYKKPLPQGEIPNQGGPQGGDMSVIYESNWDLWQQWMGNITKKIPYMVLPGNHEAACAEFDGPHNVLSAYLDHNEPNSTWTKNDLNYYSCPPSQRNFTAFQHRFRMPGSESGGVTNFWYSFDYGLAHFVSMDGETDYANSPEWSFAEDLTGDETFPTESETFVTDSGPFGAIDGSVKNTKAYEQYKWLKKDLSSVDRTKTPWVIVMSHRPMYSSAYSSYQKNIREAFEALLLQYGVDAYLSGHIHWYERLWPLGANGTIDTASVLNKNTYRVNPGKSMTHIVNGMAGNIESHSEFSAGQGLTNITAVLNTKEYGFSKLTVANATALKWEYVKGSDGSAGDTLWLVKPEAAGFQGRGKSPYGKKTRS

SEQ ID NO: 19780 - protein, 333 aa, Saccharomyces bayanus
MSEHEDKKQKVGGSSLDQLKNAGTHVVADSGDFESISKYEPQDSTTNPSLILAASKLEKYEKLIDAAVEFGRKHGKTDHEKVENAMDKILVEFGSQILKIVPGRVSTEVDARLSFDKKATVKKALHIIKLYKDMGVPKERVLIKIASTWEGIQAAKELEAKHGIHCNMTLLFSFTQAVACAEANVTLISPFVGRIMDFYKERSGEDYTGETDPGVLSVRKIYSYYKRHGYKTEVMAASFRNLDELKALAGIDDMTLPLNLLQQLHESTDPIENKLNAETAKQEGVEKVSFINDEPHFRYVFNEDQMATEKLSDGIRKFSVDIEALYELVEKKM

SEQ ID NO: 19781 - protein, 530 aa, Candida glabrata CBS 138
MFARIVSRRLMSSTAARLNSVPKVAAKPKSSFFRTMGKWSLRATLYGALAGTGYISYSLYRESNPSKQKPQSDTFPNGSKRKTLVILGSGWGSISLLKNLDTNIYNVIVVSPRNYFLFTPLLPSTPVGRVELKSIIEPVRYIARRTTGEVLYYEAEATDIDPHAKTVKIKSNSQNNDYELDINYDYLVVGVGAQPTTFGIPGVYENSSFLKEISDAQEIRIKIMRNIEKAASLAPNDTERERLLSFVVVGGGPTGVEFAAELRDYVDQDLRKWMPELSKEIKITLVEALPNILNMFDKKLVTYAQDLFRQEKIDLRLKTMVKKVDSTKITAKCEDKTESIPYGVLVWATGNAPRDVCKGLMQKIPETQNSRRGLLINSKMQLLGAEDSIYAIGDCTFYPGLFPTAQVAHQEGEYLARVFKKLHKVDQFEYMASKNNQTKENIKDLTSKINNLKAQIEDFQYNHHGALAYIGSEQAIADLAVGEAKYRLAGSFTFLFWKYAYLAMCMSFKNRILVAMDWTKAYFLGRDTSA

SEQ ID NO: 19782 - protein, 531 aa, Bradyrhizobium japonicum USDA 110
MTLLRDPLLNKGTAFTEAERAALGLRGLLPPCVLTMETQVDRVLTNLRMLPTDLEKYVALNALHDRNEALFFRVVVDNIDEIQPIIYTPTVGLACQKYGLIFQRPRGMFISSRDRGQIAEILKNWPYPARLIVVTDGERILGLGDLGANGMGIPVGKLSLYSACAGVHPEHCLPIVLDVGTNNEELLNDPYYLGLRERRLTGEAYDSFVDEFMVAARKTFPGVLIQFEDFANHSAFKLLHKYRDEACVFNDDIQGTAAVALAGLFSGLRISGGKLKDQKILFLGAGEAATGIADLVVSAMMAEGATEAEALRRNWLVDSRGLVVSGRDGLSGHKLRYAHAGQAPISDFLTAIKTLKPTAIIGVAAVGGAFTPDVLKAMAGLNEHPIVFALSNPTSKAECSAEDAYRYTEGRALFACGSPYDPVKLNGRTFVPRQGNNSYIFPGVGLGVIATRSRLVTDEMFMAAAHSLADCVGKEDLAQGSLYPALPRIREVSARIAAAVADVAYQRGLADGPAPNDVKALVQSQMYEPKY

SEQ ID NO: 19783 - protein, 335 aa, Saccharomyces bayanus
MSEPAQKKQKVANNSLEQLKAAGTVVVADTGDFNSIAKFQPQDSTTNPSLILAAAKQPAHAKLIDVAVAYGKKHGKTTAEQVESAVDRLLVEFGKEILKIVPGRVSTEVDARLSFDTQATIDKARHIIKLYEQEGVSRERVLIKIASTWEGIQAAKELEEKDGIHCNLTLLFSFGQAVACAEAQVTLISPFVGRILDWYKASTGKEYAGETDPGVVSVKSIYNYYKKYGYKTIVMGASFRSTDEIKNLAGVDYLTISPQLLDTLMNSTEPFPRVLDPATAKKEAGDKISYINDEPKFRFDLNEDAMATEKLSEGIRKFSADIVTLFDLIEKKVTA

SEQ ID NO: 19784 - protein, 162 aa, Prochlorococcus marinus str. NATL1A
MSVDSKEPSSEEVKIEDESNASEDSGVKTASENKSKGKKISIKNLSPAEIIKTFEDAQLGKDLPDIYVGDTVRVGVRISEGNKERVQPYEGVVIAKRHGGIHQTITVRRIFQGIGVERIFLVHSPQVASIKVERRGKVRRAKLFYLRERVGKATRVKQRFDR

SEQ ID NO: 19785 - protein, 889 aa, Thermosynechococcus elongatus BP-1
MSERSPALADFLAQLPFELDAFQAAAIAALDAGRSVVVCAPTGSGKTLIGEYAIHRALTRQQRVFYTTPLKALSNQKWRDFQQQFGAAQVGLLTGDISINRDAPILVMTTEIFRNMLYGTPIGEVGTSLAGVEVVVLDECHYMNDRQRGTVWEESIIYCPKEIQLVALSATIANGEQLTDWIQSVHGDAELIYSDWRPIPLHFYFCNGKGLFPLLDGQRKRLNPKLHGQPELRRRGSKRDFLSIRYVVSQLQQRDMLPAIYFIFSRRGCDQAVQEVLGMNLLTKAEQQALAERVEAFLAQHQDIVAPEMIAPLYQGIAAHHAGVLPVVKTLVETLFQEGLIKLVFATETLAAGINMPARTTVISTLSKRTDSGHRLLTASEFLQMAGRAGRRGMDTVGHVVTLQTPFEGAHEAAFLATAAPDPLMSQFTPSYGMVLNLLQRHTLEEARELVERSFGQYLATLQLTPQRQAIAQLEMELQTVQQRLAGIDRQQLAQYQKLRERLRQDQRLLKILEQQAEQERTQALLPLMMAVPPGTWLHIKSPLREHPPLAAVLCQPVAGSGQLPHWLCLAADGRLRVVGIDDILGVYPDRPPCDPLPPLPEAMKLRRGESYPCHGADHYLGCLPNLPPVLAAPEVAAQAAKIADLEAKLSQLQGSLPQNVHSLLRLVRREERLQTELRDRQQKLHQQSQRHWEQFLALIAALQDFGGLNDLTPTPLGEMAAALRGENELWLALALASGELNDLPPHLLAAAVAALVTETPRSDSWCNYPIPSEVEERLAALSPIRRRLFQVQRRYQIIFPLWYEWDLIGLVEQWALGTPWHELCAQTNLDAGDIVRLLRRTLDFLSQIPHAPHTSPQLRQSAQQARYLLDRFPVNDLLEGVELEVATL

SEQ ID NO: 19786 - protein, 985 aa, Kluyveromyces lactis NRRL Y-1140
MTKDNDIVKEAAAPGAEEKPITVPDEQNNKKKDANNEEELSEEDLKLKDDLEFLVSTLKGDDTSLYLGSLDQLKDSIKNSTSSMTAVPKPLKFLRPSYPELVSVYESWTDDKLQSLLADVLSVLSMTYSDDGKYDSLKYRLLSNEKNIESWGHEYMRHLALEIGDVYNKQVEKEADESTPEPDADFNQQDLVSLSLQIVPYFLKHNGEADAVDLLLEIESIDKLPQFVDDTSFTRVCQYMVACVPLLAHPDDVSFLQTSFAIYLSHNELTEALNLAIRIGDENLVRSVFDATADPVIHKQLAYILSSQRSSFQQEGVQDIIDNVQLSEHFRYLAKELNLLQPKTPEDIYKSHLESSKASFNKTSMSSAQQNLAEFMVNGWLNLGYSSDSIYSKDSNCVYKTKGDGMTSAVASIGSIYQWNLDGLQELDKYLVTEDLEVKAGALLGIGISTCGVHDGEVEPALLLLQEYVTNPNVKLSSAAIMGLGIAFAGSNNDELLGTLLPVAADTSLPIEVCSMACLSLAHAFVGTCNGDITTTIMDNFLERSSEELKTHYTNFFALALGILYMGQGEQVEDVLDTISAIENPITSAIEVLVNACAYTGTGDVLMIQDLLHRLTPKKDSKDDKEEEADEEMGDVLPSEIQDSLGLGLQDIPGAADTVYNEQDEQPEEVDVVMDDADGSNATNDETKASEQKGDEDAEDEQEGEKEENAEDAGEDKENENSQAAELAFAVLGIAMIAMGEEIGKEMSLRHFGHLMHYGSDEIRRSVPLAMGLISVSDPQMKVFDTLSRFSHDADLAVSMSSIFSMGLCGAGTNNARLAQLLRQLASYYSKESDALFMTRLSQGLVHLGKGTLSLDIFNDAQVLNKVSLASLLTVLVGMMSPEFMLKNHSLFYYLNSATRPKYIVTLDEEGNPIKASVRVGQAVDTVGQAGKPKTITGWITHSTPVLLGHGERAELETNEYISYTSRIEGVVILKKNPKYTEEVN

SEQ ID NO: 19787 - protein, 376 aa, Saccharomyces bayanus
INSWNPTLLKEISSTKFESKLFDSNKVSEYSFKNLSMDDVRLIYKNIPKAGFIEVFTNLYNSFNVTAYRQKELEIQYCQNLTFIERKRLLHQLRINVAPKLSSPAKDPFIFSYEKAMWKELSESMNQTVLDQVTNMVHEEYVDKIIGLSEGLKFKNFTLFNITLDGTGAIANDNSDDFVPASDTNVNPVDFQSHLNFSGNPFLDLNSYGLDLFAPTLSDSNRKGILMFDKDPIIVYEDFAYAKVLERRKKKEKEDKKKKEEEDKKKKEEEEKKKKEEEAKKKKEEEEKKKKEEEDKKKKEEDEKKKKEEEDKKKKEEEGKNNEEEDKKKKEEDEKKKKEEEDKKKKEEEGKNNEEEDKKKKEEDEKKKKEEEDKKK

SEQ ID NO: 19788 - protein, 397 aa, Oryza sativa (japonica cultivar-group)
MRHYLICSYAREKLQAVLFLSIRPFSKSLYRRINRFLAELLWLQLVWLVDWWAGVKIQLHADDETYKAMGNEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAVSQGLPAPRNVLIPRTKGFVSAVTIMRDFVPAIYDTTVIIPKDSPQPTMLRILKGQSSVVHVRMKRHAMSEMPKSEDDVSKWCKDIFVAKDALLDKHLATGTFDEEIRPIGRPVKSLLAVWGLSGLKLKTWVEAPSFVRAKSEDQGRCFAGTTVTLFWSCLLLYGAVKLFLWTQLLSTWKGVGFTGLGLALVTAVMHVFIMFSQSERSSSAKAARNRVKKD

SEQ ID NO: 19789 - protein, 238 aa, Zea mays
MEAGGAGAEGVMRVLLVDDSPVDRRVAQLLLSSNSCAGSFHVIAVDSAKKAMEFLGLKDGGKEQAIDMVLTDYCMPEMTGYDLLKAIKALNPLKPIPVIVMSSEDEPQRISRCLNAGAEDFIVKPLQSKDVQRLRNCSTAARPSNKGGATLPCEENAVAKWSNNKLPPSAGATSPSGRRANLAGVAMRQVLHSSSVEISQYLPLLLKLVVLAYAALCLGELLHRWSSGGSCSLSPWCA

SEQ ID NO: 19790 - protein, 441 aa, Ralstonia solanacearum GMI1000
MAGQVDGAGGPRIVVVGGGAGGLELATRLGDKLGKRRAARVVLVDRNPTHIWKPLLHEVAAGSMDPNTHQLEYAAQARWHGFEFQQGELKGLDRAAKTITVSGCVDADGTEVLPERAIAYDMLVLAIGSVTHFFGVPGTAEHAIALDAASQAERFRRKLISACMRAQNGVGDARAQVDIAIVGAGATGVELSAELRNTAHVLAAYGLHKLDPLRDIRIHLIEGSPRILAALSERVSTETTKLLQKLNVEVITGERVNQVTDSAVKTASGKSIPADLTVWAAGIRAPAILGELGLPVNKLGQVVVSRTLQAEGDDAIYAFGDCASCPWPEASASVPPRAQAAHQQATYLYKALCRRLEGKPVEPFGFKDLGSLVSLGHFSAVGSLMGGLIGGTMFIEGMMARLMYTSLYRMHVMALHGFVRMALDTVTHWLRSKTNPRVKLH

SEQ ID NO: 19791 - protein, 141 aa, Triticum aestivum
MTTLGKRHRNSSSMRRTTSMSGFAVPPEEEAAGRQPTRAARGASAAPAQTEWGAASAAFQRRHSGDFNAAVETAAFLKACGLCCRRLGPGRDTFIYMGEVAFCSLECRQQQMNLDELKEKKCFPATGSGGSDGTSGTVAAA

SEQ ID NO: 19792 - protein, 659 aa, Arabidopsis thaliana
MGKYSVLMIFIASSLLIVLQNVEIVNAVGCTGSFFNGNSSYAQNRRDLFSTLPNKVVTNGGFYNSSLGKSPNIVHAVALCGRGYEQQACIRCVDSAIQGILTTTSCLNRVDSFTWDKDEEDNVSCLVSTSNHSTFGNLELRPSVRYQSPNSIEPSKNMTLFEQEWNAMANRTVESATEAETSSVLKYYSAEKAEFTEFPNVYMLMQCTPDITSQDCKTCLGECVTLFKEQVWGRQGGEVYRPSCFFRWDLYAFHGAFDNVTRVPAPPRPQAQGNESSITKKKGRSIGYGGIIAIVVVLTFINILVFIGYIKVYGRRKESYNKINVGSAEYSDSDGQFMLRFDLGMVLAATDEFSSENTLGQGGFGTVYKGTLLNGQEVAVKRLTKGSGQGDIEFKNEVSLLTRLQHRNLVKLLGFCNEGDEQILVYEFVPNSSLDHFIFDDEKRSLLTWEMRYRIIEGIARGLLYLHEDSQLKIIHRDLKASNILLDAEMNPKVADFGTARLFDSDETRAETKRIAGTRGYMAPEYLNHGQISAKSDVYSFGVMLLEMISGERNNSFEGEGLAAFAWKRWVEGKPEIIIDPFLIEKPRNEIIKLIQIGLLCVQENPTKRPTMSSVIIWLGSETNIIPLPKAPAFTGSRSQSEIGAMSMSDDVFTELSCR

SEQ ID NO: 19793 - protein, 524 aa, Chlamydia muridarum Nigg
MGKSFLDCESLIALQEIATNPVDLTLPGTLSQDRIQQYALSAEGFTYSYATERVDDRSLNALRMLAEERELIKQMESMQQGAVMNYIEGFQSESRSVLHTATRAWVRDHDLKDEAASIANHSEREAHRLAEFLYAARSKFSTLVQIGIGGSELGPKAMYFAMQGICPSDKRIFFVSNIDPDNAAEVLKEVDLKQTLIVVVSKSGTTLEPSVNEELFKRAYQDKGLSVADHFVAVTAEGSPMDDKTHYLEVFHLWDSVGGRFSATSMVGGVVLGFAFGYEVFFEFLQGAASMDAHALTPIMEKNLPLLSAMLGIWNRNVLKYPTTAVIPYATGLKYFTAHLQQCGMESNGKSISRQGKEVHFATSPIIWGDVGTNCQHSFFQSLHQGTDIVPVEFIGFLQNQRGIDCVLSGSSSSQKLFANLVAQSLALAQGRDNDNPNKRFKGNRPSSILVAQQLSPRIAGGLLAFYEHKFAFQGFCWGINSFDQEGVSLGKELATQIIGLMSGAAPIEFPEARELLRLFNVLQ

SEQ ID NO: 19794 - protein, 442 aa, Burkholderia xenovorans LB400
MTSRPVIDDLSSFWMPFTANRQFKAAPRLLESAKGMYYRSTDGREVLDGCAGLWCVNAGHGREEIIAAITQQLSTLDFAPTFQMGHPLAFEAATKVAELMPEGLDRIFFTNSGSESVDTALKIALAYHRSRGEGQRTRLIGRERGYHGVGFGGISVGGIAPNRKTFSGALLPAVDHLPHTHNLEQNAFSKGQPAWGAHLAEELERIVTLHDASTIAAVIVEPVAGSTGVLIPPQGYLQKLREICTKHGILLIFDEVITGFGRVGKATASEYFGVTPDLITMAKAINNAAIPMGAVAASRTVHDTIVNSGAQGAIELFHGYTYSAHPAATAAAIATLDLYRREGLFERAATLAPTFEAAAHSLRGAKHVKDVRNIGLIAGVELESRDGAPGARAYEAFVKCFEAGVLVRFTGDILAFSPPLIINEEQIAHIFKTVGDVLATVQ

SEQ ID NO: 19795 - protein, 182 aa, Arabidopsis thaliana
YPYIAGMGVYCFKTEALLKLLTWRYPSSNDFGSEIIPAAIKDHNVQGYIYRDYWEDIGTIKSFYEASIALVEEHPKFEFYDQNTPFYTSPRFLPPTKTEKCRIVNSVISHGCFLGECSIQRSIIGERSRLDYGVELQDTLMLGADSYQTESESRLLAEGNVPIGIGRDTKIRKCIIDKNARI

SEQ ID NO: 19796 - protein, 273 aa, Aeropyrum pernix K1
MIRLALFGSGVSSSLSPAIYRGFAAKRGLRLEYRVYEAGPGGLAPALRMAGELHGFNVTKPLKREALSLASTLDSHARAIGAVNTMVAGEEGWEGFNTDWKGFLDSLKLYTASPPDTALVIGAGGAGRAAAYALATWGAGRVLIASRTGLTARRAAQDLAGLGAEVEPVPPGGLEDAAAASDVVVNATPLGWDGVSTPVERGFREGCIAVDMVYRPLATPFLRRAAASGCTPVDGLWMLAIQAAENIAVWLGLEASPVELRTYALEAMRGGRG

SEQ ID NO: 19797 - protein, 358 aa, Aspergillus oryzae
MRAVVYTGKDTISVEERPKPSLLEPTDAIVKVQHTTICGTDLHILQGHVQTCTPGRILGHEGVGIIESLGTGVTRFSVGQPVLISCITSCGSCNFCRKRMPSQCTSGGWILGNTIDGTQAEFVRIPHASFSLHALPNGLDPKVAVTLSDVLPTAYECGILNGQIQPGSTVAIIGTGPIGLMALQMARNLFGPSMTAVVGRGQPRLDTAKEMGADHAISVLGGQADAVASALAVTSNQGFDVVIEAVGTTDSFELAQALVGPGGTIASLGVFGTPCALHLEDLWHRNICIRTRLVDACTTPDLLKIVESGKISPHFLVSHNFSFDQIYKAYETFQTPSKSGSLKVVISMAELQPANPRL

SEQ ID NO: 19798 - protein, 113 aa, Triticum aestivum
MGCAGSTPKVDESSKNLRKPKPWKHTQPITPAQLKQMRDEFWDTAPHYGGQKEIWDALRAATDADLTLAQTIVDSAGIIVSNPDLTLCYDERGAKYELPNYVLSEPTNLIRDG

SEQ ID NO: 19799 - protein, 850 aa, Mycobacterium bovis AF2122/97
MSFVIAAPEALVAVASDLAGIGSALAEANAAALAPTTALLAAGADEVSAAIAALFGAHGQAYQTVSAQASAFHAQFVQALTGGGGAYAAAEAANVSAAQSTDQRLLDLINGPTQALLGRPLIGDGANGGPGQDGGPGGLLYGNGGNGGTSTTAGVAGGNGGAAGLIGNGGAGGGGGAGAAGGNGGAGGWLYGNGGAGGAGGTSVIPGVAGGNGGAGGSAGLWGTGGAGGDGGNGRSGPVNVAGSAGGNGGAGGAAGLFGDAGAGGNGGKGGAGGAAFSINFTAGDGGAGGAGGSGGHALLWGAGGAGGNGGSGGTGGAGGSTAGAGGNGGAGGGGGTGGLLFGNGGAGGHGAAAGNGLAAGNGVSSSGGGGAGGTGGAGGDGGAGGAGGNARLWGVGGAGGAGGDGGAGGAGGKGGSGLSGNANGGAGGDSGRGGTGGAGGEGGAAGLLVGTGGHGGDGGAGGAAVKGGDGGAAAGTGIAGAGGRGGAGGSGGSGGDGGGGAAGPAGWLFGDGGAGGNGGAAAAGGAGGQAGGGGGNGGNGGNGGNGGNGGNGATGGWLYGNGGAGGQGATAGAGGAGANGVSSTNGGGNGGIGGTGGSGGAGGNAGLLGVGGAGGHGASGGAGDRGGAGGTGFISSDGGAGGDGGDGGNGGAGGTGGLLFGAGGNGGPGGSGGAADIGGNGGAGNGGGTDGNGGNGGSGGGAGSGGDGGGAGGNGAWLFGNGGAGGGGGKGGNGAGGGLGGGSFGLPGLNGSGGDGGDGGNGAPGGVLYGNGGAGGQGSSGGIGGPGATGGAGGKGGDGGDAQLIGDGGNGGNGGAGGTGGTPGPGGPGGSGGLGGLLFGQTGTAGVSP

SEQ ID NO: 19800 - protein, 550 aa, Corynebacterium diphtheriae NCTC 13129
MPTDVEIAQAHTLEPITDIANRAGVPSDALIPYGFTKAKIDINRIASENTGKLVLVTGISPTPAGEGKSTVLIGLSDAMRLRGHNSIVAIREPSLGPVMGIKGGAAGGGYSQIVPMEDINLHFTGDFHAITAANNTLAAMIDNHIHQGNTLGIDVRRITWQRCLDVNDRCLRKVVTGLGGKAHGVPTETGFTITAASEIMAILCLALDLTDLEARLARIVVGQTFSSEPVTVGQLNAQGALAALLRDAVNPNLVQTLGGTPALCHGGPFANIAHGCNSLIATKTALSLGDVVLTEAGFGSDLGAEKFFDIKSRVGDLNVAATVVVATVRSLKYNAGVPKDELTTENLEALASGVVNLERHVENIRAFGIEPIVALNKFASDTDAEINQLKAWAETMSVQLIPVEVWAHGGQGALELADAVAVSMQNQTSHHLYDPELGIEASLLTIAQKIYGAADVELSKQARQDLAYLQENGWDRLPVCISKTQYSFSDDPSQLGRPEGHTLHVRNLLPRIGAGFIVALTGDVMTMPGLPKKPAAENIGVENGEIKGLF

SEQ ID NO: 19801 - protein, 347 aa, Zea mays
  misc_feature (17)..(17): Xaa can be any naturally occurring amino acid
  misc_feature (179)..(179): Xaa can be any naturally occurring amino acid
  misc_feature (239)..(239): Xaa can be any naturally occurring amino acid
  unsure (1)..(347): unsure at all Xaa locations
DPQTTLEEVVSKTFTTXAETMLNARTLKEWIVSSLGPQAVAKHMIAVSTNLKLVKEFGIDPNNAFAFWDWVGGRYSVCSAVGVLPLSLQYGFPIVQKFLEGASSIDNHFYSSSFEKNIPVLLGLLSVWNVSFLGYPARAILPYSQALEKLAPHIQQTGEIDFGEPGTNGQHSFYQLIHXGRVIPCDFIGVVKSQQPVYLKGETVSNHDELMSNFFAQPDALAYGKTPEQLHSEKVPENXIPHKTFKGNRPSLSLLLPTLSAYEVGQLLSIYEHRIAVQGFIWGINSFDQWGVELGKSLASQVRKQLHGTRMEGKPVEGFNHSTSSLLARYLAVKPSPPYDTTVLPKV

SEQ ID NO: 19802 - protein, 126 aa, Chlamydia muridarum Nigg
MRRSTEFGVKTAGGSMTTIFERIIEGAVECDKVFEDENFIVIKDKFPQAPVHLLIIPKKHIEKLQDMQSDDFSLLSEAGKIIQLMARDFGIENGYRVVINNGLEGGQSVFHLHIHLLGGGLLGSIA

SEQ ID NO: 19803 - protein, 187 aa, Methanopyrus kandleri AV19
MILIIDNHGQYVHLIRKNFDYMGVPAEIIPNTTDPEDVRERASGVVISGGPSRERAGNSREIIEELTGEVPILGICLGHQLMAEVFGGKVDWAAGREEYARTEVEILDHEGIFEGLPDKIVAWASHRDEVKEVPDEFVVTARSDRCEVEAMRHEELPLYGVQFHPELKFTEYGPDILKNFAKLCGEL

SEQ ID NO: 19804 - protein, 377 aa, Arabidopsis thaliana
MADADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 19805 - protein, 512 aa, Gerbera hybrid cultivar
MTPLTLLIGTCVTGLFLYVLLNRCTRNPNRLPPGPTPWPVVGNLPHLGTIPHHSLAAMAKKYGPLMHLRLGFVDVVVAASASVAAQFLKTHDANFADRPPNSGAKHIAYNYQDLVFAPYGPRWRMLRKICSVHLFSTKALDDFRHVRQEEVAILARALVGAGKSPVKLGQLLNVCTTNALARVMLGRRVFDSGDAQADEFKDMVVELMVLAGEFNIGDFIPVLDWLDLQGVTKKMKKLHAKFDSFLNTILEEHKTGAGDGVASGKVDLLSTLISLKDDADGEGGKLSDIEIKALLLNLFTAGTDTSSSTIEWAIAELIRNPQLLNQARKEMDTIVGQDRLVTESDLGQLTFLQAIIKETFRLHPSTPLSLPRMALESCEVGGYYIPKGSTLLVNVWAISRDPKIWADPLEFQPTRFLPGGEKPNTDIKGNDFEVIPFGAGRRICVGMSLGLRMVQLLTATLIHAFDWELADGLNPKKLNMEEAYGLTLQRAAPLVVHPRPRLAPHVYETTKV

SEQ ID NO: 19806 - protein, 182 aa, Triticum aestivum
  misc_feature (51)..(51): Xaa can be any naturally occurring amino acid
  unsure (1)..(182): unsure at all Xaa locations
ADAWADPLYILPVLTSLTYLAIVELGHPYTSSKMKMLDRGMGVMVVPFTIXFAKGFFFYWITANLFTLVYDIVMRRPAVRKLFNFPDLEAQSAPALNSALDMFGGSKAVPSAKPPLALMELEEVRSKIEYMAAQPRGSPEWRKLMALYKHCSSGFGDAAALGYRPKNIEKKGKSRGKSRKGR

SEQ ID NO: 19807 - protein, 428 aa, Prochlorococcus marinus str. NATL1A
MNTKRSEEIFGAAKNLMPGGVSSPVRAFKSVEGDPIVFDRVKGPYAWDVDGNRYIDYVGSWGPAICGHAHPEVIAALQETLEKGTSFGAPCVLENQLAEMVIDAVPSVEMVRFVNSGTEACMAVLRLMRAFTGRDKVIKFEGCYHGHADMFLVKAGSGVATLGLPDSPGVPRSTTANTLTAPYNDLEAVKELFAENPDAISGVILEPVVGNAGFITPEPGFLEGLREVTQENGALLVFDEVMTGFRISYGGAQERFGVTPDLTTMGKVIGGGLPVGAYGGRKEIMSMVSPSGPMYQAGTLSGNPLAMTAGIKTLELLKQEGTYEKLEALTKKLLDGILTAAKESNIPIYGQSISAMFGFYLCEGPVRNFEEAKSSDTELFSKIHRLMLQKGVYLAPSAFEAGFTSLAHSEDDINATIKAFQEIFSEIS

SEQ ID NO: 19808 - protein, 469 aa, Bacillus cereus G9241
MKFSHDFLFGAASASYQVEGAWNEDGKGVTNWDEFSKIPGKTYNGTNGDVAVDHYHRYKEDVRLMAEMGLESYRFSISWARILPTGDGEVNEKGIEFYNNLIDECLKYGIVPFVTLYHWDLPLALEKDGGWTNKRTAEAFVKYAEICFKAFGDRVKHWITFNETVMFCGLGYLKGAHPPGIQNDVPKYFQATHYVFYAHAKTVAVYKQLKQYGEIGITHVFLPAYSVDGQKENILAAKHANEYETYWYYDPVLKGEYPSYVVQQLKKKGWTPNWTVEELEIIKQNAEKNDFIGLNYYQPIRVERYDMDINGGEHSRENSTLAPGNPSFDGFYRTVKMDDKTYTKWGWEISPEGFLDGLHMLKERYGDIKMYVTENGLGDEDPIIDGEIVDVPRIKFIEEHLKVIKRAIEEGINLKGYYAWSVIDLLSWLNGYKKQYGFIFVDHNDNLKRKKKLSFHWYKHVIETRGEEL

SEQ ID NO: 19809 - protein, 440 aa, Synechococcus sp. RS9917
MPALSSTMTEGKIVEWLKQPGDKVARGESVLVVESDKADMDVESFNEGYLAAVLMPAGSTAPVGETIGLIVESEAEIAAAQAKAGGGGGAATPAAAPAPATAHATAPTPAPPAAPAPAPAAAVVPPALEQPAALANGRIVASPRAKKLAAQMGVELTKVRGSGPNGRIQAEDVERAAGRPVTPPRVGEGTAVAIVAGAASAAPTAPASPAGNSFGAPGETVAFNTLQQAVNRNMEASLAVPCFRVGYTITTDKFDAFYKQVKPKGVTMTALLAKAVAVTLARHPQVNAATTAAGMAYPADVNVAIAVAMEGGGLITPVLRQADRTDLYAMSRQWADLVKRSRSKQLQPEDYSTGTFTLSNLGMFGVDRFDAILPPGTGAILAVAASRPTVVAGNDGSIAVKRQMQVNLTADHRVIYGADGAAFLKDLAELIETRPESLAM

SEQ ID NO: 19810 - protein, 209 aa, Triticum aestivum
  misc_feature (186)..(186): Xaa can be any naturally occurring amino acid
  unsure (1)..(209): unsure at all Xaa locations
MAAAAPAMRAGLAAFLLLLAASGAGAVGAEGALPRFAEAPEYRNGEGCPAAVAGAGVCDPGLVHIAMTLDAHYLRGSMAAIYSLLKHASCPESLFFHFLAADGAAPGVAELRSALAASFPSLRFEIYPFRADAVTGLISASVRAALEAPLNYARNYLGDLLPKCVPRGIYLDSDVLAVDDVRRVWXKRAWPAAAVFAAPEYCPRPTSSR

SEQ ID NO: 19811 - protein, 174 aa, Coprinopsis cinerea okayama7#130
MSELFNANPVVFSTTKPSSSRLAEKSAQSLWLYDNSDTEEEGNEVEEIDQDEVFGMIQELKLITAKLRSFSSDLIRSIYDPEHPNTLEELRVVSASQVTVGHNRIKVEFTPTASQSESAYSEAFQVGTRSILWSNQVLTRLNDKERVAAALENPPLVETVEKCLANTCAHDHAH

SEQ ID NO: 19812 - protein, 456 aa, Agrobacterium tumefaciens str. C58
MICNCINSISMKAQKMDKPVFGWRRNGDDLSLSDVHSSIRIKPDASTFRRAMAFFGPGYLVAVGYMDPGNWATSLAGGSKFGYTLLAVALVSNIMAIVLQSLCARLAIASGRDLAQACRDAYPKPVAMVLWLLAEIAIIATDIAEVIGTAIGLNLIFGIPLELGVLITALDVFLILYLQKLGFRWVEALVITLLGVIAVCFAIQLALADPDWGQVILGFAPTTEIVTNPDMLYLALGILGATVMPHNLYLHSGIVQTREIGPTIAEKREALKFATLDSTIALMFALLINASILILAAATFNKTGQTNVAELGEAHSLLAPLLGLAIAPTLFGVALLCCGINSTVTATLAGQIVMEGFLKMRLAPWLRRLITRAIAIVPAAGVTIFYGDSGTGQLLILTQVVLSLQLSFAVFPLVMFTSDKAKMGELRSPLWLSAIAWLIAVVIAALNVKLLMDFMG

SEQ ID NO: 19813 - protein, 150 aa, Aspergillus oryzae
MCGIGAFLDFHNHSQPVSHQQLESEIDNGLDFIKHRGPDARGKWVNADGRVGLGHIRLSIVDPSPSGNQPFHDSRGDIHAVVNGELYDHERYREQLASEFDFKGNSDCEIVIALYKHYGASFLSHLRGEFALVLWDAKRELFFAARDRRN

SEQ ID NO: 19814 - protein, 232 aa, Methanopyrus kandleri AV19
MVEIEIEPHEEFEGVYWAIFEDGRKKPATENLVPGHQVYGERLVEYDGKEYRVWEPRRSKLAAMIMNGMEYFPFEEGSKVLYLGAAAGTTPSHVSDIIKESGVEYCVEFASRMMQELIPVCEKRPNMIPILGDATKPHGYAPLVEQVDVIYQDIAQPKQAEVVADNAEAFLRPGGYVIVAIKARSIDVTKEPEEVFEDEERKLEERGFEVLEVIDLEPYERDHVGIVAEYHG

SEQ ID NO: 19815 - protein, 647 aa, Zea mays
MSRDLDCPVQTQMAVAVLDRSFSSEYPGGSRTEGRQLSWKRVFVQTDNGSVLGIELERGENVQTVKKKLQIALNVPTDESSLTFGDLVLNDDLSSIRNDSPLLLKRNQIHRSNSTPCLSPTGQDVWQRDRSGPIEILGCSSPSSRMKQIAKDVIKAIMNGVDPVAINSGMGGAYYFKNIWGERVAIVKPTDEEPFAPNNPKGFVGKALGQPGLKRSVRVGETGFREVAAYLLDYDHFANVPPTMLVKITHTIFNVNDCVGCKSKVFCNKSESVSKIASLQEFIPHDFDASDHGTSSFPVSAVHRIGILDIRIFNTDRHAGNLLIKKVGPGADNFGEQTELIPIDHGLCLPECLEDPYFEWIHWPQSSVPFSVEELEYIAKLDPIKDAEMLRVELPMIREACLRVLVLSTVFLKEAAAFGLCLSEIGDMMSRQFTAKEEEPSQLELLCMETRKWVEERELFLPDEAGVEDGDDDFTQFPLDSDAFEPPAFCKFGSVKTSSRNPLSKLDECDEEDGDLSEEEGEHGDVLTSGALPQKVPPISKLSSSMKGLGFIGKSKPYRTGGVPKGKVTGRTNYSGKASEHQSGSRSANELLPPSASFVKLSDMSRKEWSAFLEKFQELLPSALRTRKHSAGVGQRPMPRLGTSCQF

SEQ ID NO: 19816 - protein, 744 aa, Oryza sativa
VNPSQWALAPYLATSPSFLPSLAPPPTATALPSPAPHPSGSPDTRILGPRISPAFSPRAMSPESTGGPVHPPSHKHHRRPYHPHSPSPSPLPQGCTDNCSDPMTTTPIGSPCGCVLPICVIVDLDVAPYLLFMRIAELEVEVAAGTFLKQSQVKIMAAIPSIQDDQKTRVTIYLVPLREQFDGYTASLISDRFWNNKIQINSSIFGDYEVINVTYPGLRSPPPSLPETSHGSDPTGTGEDPITADVHHGKNKKLDSWIIVVVAGSSITLIAACIGLGVLLLKWYKLRQLQEAVSPATTPAVNRRYGGRSTLSVSRVSSASASMLSTVATCTTSVKTFSLSQLEKATDGFDSKRVLGQGGFGRVYHGTMDGGDEIAVKLLTREDRSGDREFIAEVEMLSRLHHRNLVKLIGICIEHNKRCLVYELIRNGSVESHLHGADKAKGMLNWDVRMKIALGAARGLAYLHEDSNPHVIHRDFKGSNILLEEDFTPKVTDFGLAREATNGIQPISTRVMGTFGYVAPEYAMTGHLLVKSDVYSYGVVLLELLSGRKPVCMSDTNGPQNLVTWARPLLCHKEGLERLIDPSLNGNFNFDDVAKVASIASMCVHNDPSQRPFMGEVVQALKLIYNDAEAACDDSYSHRDSSCDQYDDYHGALALDSGSGSWWNRSSNPSGFFDNRNPLPVITMEYSSGRIEGARDPRFALSTGGHAQSPALQNRSGPIRMKKKLASFYRSRGSFSEHGQLPRH

SEQ ID NO: 19817 - protein, 232 aa, Arabidopsis thaliana
MASSSATKFVDLFPCLFLACLFVFTYSNNLVVAENSNKVKINLYYESLCPYCQNFIVDDLGKIFDSDLLKITDLKLVPFGNAHISNNLTITCQHGEEECKLNALEACGIRTLPDPKLQYKFIRCVEKDTNEWESCVKKSGREKAINDCYNGDLSQKLILGYAKLTSSLKPKHEYVPWVTLNGKPLYDNYHNLVAQVCKAYKGKDLPKLCSSSVLYERKVSKFQVSYVDEAIN

SEQ ID NO: 19818 - protein, 364 aa, Alkaliphilus metalliredigenes QYMF
MIMKKFKIAVIPGDGIGNEVTAEGVKVLNTYAEIKGNVEFSYEYFPWGCEYYLKTGKMMDDDGLKTLEAFDAILLGAVGDPSVPDHISLHGLLINIRQGFNQSINLRPIKLLQGAPCPLKDKGPQDIDFTVIRENVEGEYAGVGGFRFPGRPEEVALQTSVFSRKNTEKVMDYAFKLARKRKKFNKVTNVTKSNALNYSMVFWDKIFEEIATNYKDIKTETTHVDAVSMYFIQKPEVYDVLVASNLFGDIITDLGAALQGGLGFAASANLNLEKEYPSMFEPVHGSAPDIKGKQLANPIAMIWTAKMLLDFLLEEDDTEMIIDAITAVLQEEKTLTPDLKGKAKTHEVGDAICGKLKEIMNAKI

SEQ ID NO: 19819 - protein, 466 aa, Pseudomonas putida KT2440
MKSYDVVIIGGGPGGYNAAIRAGQLGLSVACVEGRSTLGGTCLNVGCMPSKALLHASELYEAASGDEFAHLGIEVKPTLNLAQMMKQKDESVTGLTKGIEYLFRKNKVEWIKGWGRLDGIGKVVVKAEDGSETALQAKDIVIATGSEPTPLPGVTVDNQRIIDSTGALSLPQVPKHLVVIGAGVIGLELGSVWRRLGSQVTVIEYLDRICPGTDTETAKTLQKALAKQGMVFKLGSKVTQATAGADGVSLTLEPAAGGTAESLQADYVLVAIGRRPYTKGLNLESVGLEADKRGMLNNEHHRTSVPGVWVIGDVTSGPMLAHKAEDEAVACIERIAGKPHEVNYNLIPGVIYTRPEMATVGKTEEQLKAEGRAYKVGKFPFTANSRAKINHETEGFAKVIADAETDEVLGVHLVGPSVSEMIGEFCVAMEFSASAEDIALTCHPHPTRSEALRQAAMNVDGMAMQI

SEQ ID NO: 19820 - protein, 80 aa, Triticum aestivum
MAPTVMGSKDTYDAPFQGLKSTDGLPVRRRSNGASLGSVSNGGRIRCMQVWPMEGIKKFETLSYLTPLSTEALLKQVEYL

SEQ ID NO: 19821 - protein, 461 aa, Pseudomonas putida KT2440
MKTWLCIICGLIYDEAKGWPDDGIAPGTRWEDVPEDWLCPECKVGKADFEMIELSTPIAAVATAPVIQAQPLVAARPAQPVVIIGSGHAGYGLAQALRKAAPQLEIRVLTQESGHLYSKPALSIALAQGRTAAALATETPLAIEQRLGIRIYTGCKVERIDAQAQRLYTSLGEMDYGQLVLASGASPVRLPIEGRAEALLSVNNLQDYQAFRQRLDGVRRVAILGDGLIGCEFANDLASNGYQVRVIGLGAWPMERLLPEAAGQHLQQALSGLGVQWSLRTTLQCIEPDGEGYRLTLADGQVVGADLVLSAVGLRPNLELALEAGLDCGRGIKVDAQLQTSQPGIYALGDCVEINGQLLPYLAPINEGIRALAKTLLGQPTAAHYPLAPVTVKTPVVPLCLLTPPGGCEGQWRCDATSDGLSAAFHDHAGALRGFVLLGRQAQMQRNTWLQNCQDTQQNVA

SEQ ID NO: 19822 - protein, 352 aa, Aspergillus nidulans FGSC A4
MDIALELFDTFVGDRLYSALLPASLSSTVSVPGFPTAANSTLSLFGASKPFVYEPATKLLYLEPSKYAYLSAWPRNNIYRQFLSFFLIVWIFGFIVYFISATLSYMFIWDKSTVKHPKFLKNQIPLEIAQTMRSMPIMSLLTAPFLVAEVRGYAKLYDTFDEEPFPYYSILQFPLFIAFTDFFIYWIHRGLHHPLVYKTLHKPHHKWIMPSPFASHAFHPVDGWSQSVPYHVFPFIFPLQKAAYVLLFGFINIWTVMIHDGEYVANSPVINGAACHTMHHLYFNYNYGQFTTLWDRMGGSYRKPNEELFRRETKMGEEEWKRQTKEMETILKDVEGDDDRKYLAEEDSKKNL

SEQ ID NO: 19823 - protein, 244 aa, Coprinopsis cinerea okayama7#130
MNIIETLFGRTVTPAERLRQHQRSLTKAQRELDRERSKLEQSEKKLIADIKKSAKAGQMNACKVMAKDLVRTRRYIQKFYQMRTQLQAVGLRIQTLRSNQQMAEAMRGATRAMGAMNRGLNLPAIQKIMNEFERESSMMDMKEEMMSDAVDDVMEDDLEDEEEEGDKILKEVLDEIGVDLSQQLTDAPIGLAVSNPIANRTPVALGDGGGHSAGGDSGNSGGDGGVSMSDEDALQARLDALRKG

SEQ ID NO: 19824 - protein, 244 aa, Nicotiana benthamiana
MLPFKTLQEAESAIGRSLTTLETIWFNYSANKSDYYLYCHNILFLFLIFSCVPPYCLFLELFFRNSIQSYKIQPKVNFSLSEVFHCYKSVMRMFILVVGPLQLVSYPSVKMVGIRTSLPLPSLWEILLQLGTYFIVEDYFNYWIHRFLHCKWGYENIHKVHHEYTAPIGFAAPYAHWLEILILGIPSAIGPAIAPGHMVTFWLWIALRQIEAIETHSGYDLPWTITKYIPFYGGPDYHDYHHYV

SEQ ID NO: 19825 - protein, 262 aa, Roseovarius nubinhibens ISM
MSGELSPIDQAKFVAAKKAVEYVEDGMRVGLGTGSTAAWMVRCLGEMVREDGLRIKGVPTSTRTAALAQELGIDVVSLDEAKWLDLTIDGADEFDGELNLIKGGGGALLQEKIVATASDQMIVIADVGKEVESLGHFPLPIEVIPFGWQTTRALVEEMLVSMDVLGRDVTLRMSGDRPYVTDEGNHILDLHLGRIGNPRQLSMVLNQVPGVVENGLFIDICDIVCVGYGDGRVEVRDINDGTVRQDRLDFVESDNLFSDLSD

SEQ ID NO: 19826 - protein, 452 aa, Roseovarius nubinhibens ISM
MMSFDYDLFVIGGGSGGVRAARVAAQTGAKVALAEEDRYGGTCVIRGCVPKKLMVYASEFPGAIKQAAEYGWTVHAGGFDWGAFRSKLHAELDRLEGVYRKILGSNGVETYDARATVKDAHTVRLSTGEEKTAKHILVATGGRPVKPDMPGAEHGITSNDIFHLEELPKSVLIIGGGYIACEFAGILNGMGVQVTQYYRGAQVLRGFDDEARGLVADEMIRGGVDLHLGTNILELEPRDGGIWTKATNGSEKIFDKVLFATGRAPNTEGLGLEELGVELGRGGEVKVDEYSQTAVPSIYAIGDVTDRVNLTPVAIREGMAFVETVFKGNPTPVDHELIPTAIFTQPEMGTVGLSEEEAREKEEIEVYATSFKPMRESFAGQEERVLMKLIVSRANRKVLGCHIVAPGAGELIQMVGIAVKMGATKEDFDRTVAVHPTMSEELVTMKEPVRRA

SEQ ID NO: 19827 - protein, 394 aa, Aspergillus nidulans FGSC A4
MSQNRSGVFSNLRMGEVVREKVQDGLTGETKEIQYSQCKIVGNGSFGVVFQTKMMPSGEDAAIKRVLQDKRFKNRELQIMRIVRHPNIVELKAFYYSNGERKDEVYLNLVLEYVPETVYRASRYFNKLKTTMPMLEVKLYIYQLFRSLAYIHSQGICHRDIKPQNLLLDPATGILKLCDFGSAKILVENEPNVSYICSRYYRAPELIFGATNYTTKIDVWSTGCVMAELMLGQPLFPGESGIDQLVEIIKVLGTPTREQIRTMNPNYMEHKFPQIKPHPFNKVFRKAPHEAIDLISALLEYTPTQRLSAIEAMCHPFFDELRDPNTKLPDSRHPNGAARDLPNLFDFSRHELSIAPSMNSRLVPPHSRPALEARGLYIDDFKPLKKEEMMAHLD

SEQ ID NO: 19828 - protein, 317 aa, Aspergillus oryzae
MPQYNAPTTAEEVANDCRASIANKTILVTGVTLGSLGAGFATAIANYAPSLIILAARDVTKAQQTATEISIINPSVKTRILHLDLGSQVQIREAAKEVLEYEEHIDVLVNNAGVMAPPFSLTQDGVESQFGINHIGHFLFTNLIMSKLVTPGKSSRVVNISSDGHRLGPIRFDDWNFDDGNTYDPWLAYGQSKTANMLFSVSLAQKLGTKGLISVSLHPGVVSTQILRHDVDESVKALDETAICYYYIRYESVAANLTEIISEFASSRLQKALSEAYRTIRRLRPIVERDRRDGSGACYRELKQHLSPGTFKATSGL

SEQ ID NO: 19829 - protein, 328 aa, Chlamydia muridarum Nigg
MYVPDVAEDLCLDIFHKQKQVISRYFANFHCDVVRQLTERLLCHQGAVFFSGIGKSGCIARKLVATMQSFGEKAFFLSGDLLHGDLGVVSSGDIVCLFSNSGETREILEWIPHLKNRQVFLVGITSSPCSSLAVFSDFVVMLPKLEELDPFNLIPTTSTTCQLLFSDLLAMTVLRCRKISLSDYGKNHPSGQIGLKANGKVRDYLSPRTEVPFCSPSITVSEALTVLSSYGYGCVCVVNEQFELLGIFTDGDLRRGLSECGGAILECPLEQVMTRKPKVISEDSDVLLGLEMMESGNPVTVLPVVDAQHQRFIVGLLHMHTLARAGLL

SEQ ID NO: 19830 - protein, 295 aa, Escherichia coli CFT073
MMSHLKDPTTQYYTGEYPKQKQPTPGIQAKMTPVPDCGEKTYVGSGRLKDRKALVTGGDSGIGRAAAIAYAREGADVAISYLPVEEEDAQDVKKIIEECGRKAVLLPGDLSDEKFARSLVHEAHKALGGLDIMALVAGKQVAIPDIADLTSEQFQKTFAINVFALFWLTQEAIPLLPKGASIITTSSIQAYQPSPHLLDYAATKAAILNYSRSLAKQVAEKGIRVNIVAPGPIWTALQISGGQTQDKIPQFGQKTPMKRAGQPAELAPVYVYLASQESSYVTAEVHGVCGGEHLG

SEQ ID NO: 19831 - protein, 235 aa, Chloranthus spicatus
  misc_feature (108)..(108): Xaa can be any naturally occurring amino acid
  unsure (1)..(235): unsure at all Xaa locations
MGRGRVQLKRIENKINRQVTFSKRRSGLLKKAHEISVLCDAEVALIVFSAKGKLSEYSTDSRMDRILERYERISYAERELRSTDHRPDGNWNLEYSKLKAKLEGLQRXQRHYMGEDLEKLSLKELQPLENQLDNALKHIRTRKTQVMMDSIAELQAREKLLQEQNSMLEKKIQEKNALAHQAHWEQQNQTQSPPPFLLTHQHPTINNSTYQARGEEDRVRTNSLMPPWMLRHVNG

SEQ ID NO: 19832 - protein, 561 aa, Arabidopsis thaliana
MKESFKVCFCCVRNFKVKSSEPPEEIKNLFHDYSQDDRMSADEMLRFVIQVQGETHADINYVKDIFHRLKHHGVFHPRGIHLEGFYRYLLSDFNSPLPLTREVWQDMNQPLSHYFLYTGHNSYLTGNQLNSNSSIEPIVKALRNGVRVIELDLWPNSSGKEAEVRHGGTLTSREDLQKCLNVVKENAFQVSAYPVVLTLEDHLTPILQKKVAKMVSKTFGGSLFQCTDETTECFPSPESLKNKILISTKPPKEYLQTQISKGSTTDESTRAKKISDAEEQVQEEDEESVAIEYRDLISIHAGNRKGGLKNCLNGDPNRVIRLSMSEQWLETLAKTRGPDLVKFTQRNLLRIFPKTTRFDSSNYDPLVGWIHGAQMVAFNMQSHGRYLWMMQGMFKANGGCGYVKKPDVLLSNGPEGEIFDPCSQNLPIKTTLKVKIYTGEGWNMDFPLDHFDRYSPPDFYAKVGIAGVPLDTASYRTEIDKDEWFPIWDKEFEFPLRVPELSLLCITVKDYDSNTQNDFAGQTCFPLSEVRPGIRAVRLHDRAGEVYKHVRLLMRFVLEPR

SEQ ID NO: 19833 - protein, 820 aa, Aeropyrum pernix K1
MERRLILWLDEISKDLLPLVGGKAAGLGEMIKAGIPVPPGFVVTSEAYRRFVFETGIAGFIKHILEETIVSGRPEEYEKASELIRSKFVRTPMPPYLRRAIVDAYRKLGTLVGVEEPRVAVRSSATVEDLPEASFAGQQETYLNVKGEEEVVEKVKTAWASLWTARALSYRDSLNIDHETALMAVVVQKMVSSRSSGVMFTIHPVTGEEDKIVIESIWGLGEYIVGGKVTPDRFVVSKSDLEILEVRISRKDKALFYDPDLNENVEIKIPESGEELEDLRRKHPAVAEVVEKYGIRPDAPSLSEKEVKELARLAIKVENHFARPMDIEWAIDFELSPPENILLLQARPETVWSRKKEEAEAKPPEEEAVPEGEVLVRGVPASPGVASGRVKVALTVEEAAKKMEKGDVLVTKMTDPDWVPYMKMASAIVTDEGGMTAHAAIVARELGIPAVVGTGDATKKLKDGMLVTVDGSRGVVYAGAVKTEEAREEEARPELGAAVAEVLSEVYPVTATKIYMNLGHPEEIDRYKHLPFEGIGLMRIEFIISSWIGYHPMYLIEQGRGVYFIDKLAEGVAKVASAIYPRPVVVRFSDFKTNEYRRLKGGEKYETLDERNPMIGWRGVSRYIHPNYEPAFRLEVRAIKKVREEWGLKNVWVMFPFVRTTWELERALKIMEEEGLSRGRDFKVWIMVEVPSTVFLADEFAKMVDGFSIGSNDLTQLVLGVDRDSGFLAKMGYFDERDPAVLRSIEILIEKAHSQGATVSICGQGPSVYPELVEFLVRRGIDSISVNPDAVVRVRRQVASIERRIMLERLEELGSRLSRL

SEQ ID NO: 19834 - protein, 1059 aa, Oceanobacter sp. RED65
MFTASQVMENKFQSQERDTFWQYIVENYAVDEDSYVKELIEVAKSTDSEKKNIRNRATKMIKGVRAQDDAVHMVDALLQEYSLDTEEGILLMCLAEALMRIPDSHTADALIEDKLSNADWKKHVGRSESTLVNASTWGLMLTGKVVKMDKQLDGTPSSIWKRLVKRSGEPVIRSAMYKAMGIMGSQFVLGRNIKEALKNAKEYRKKGYTYSFDMLGEAAMTEDDAARYLEEYVNAIKAVGDDDFPTKDQPAPSISIKLSALHPRYEVAQEDRVMDELYKTVCGLLQIAKDKNVAVTIDAEEMDRLELSLHLFEKIFKSDVCQGWDKFGMVIQAYSKRALPVLCWLNKLAAEQGREIPIRLVKGAYWDTEIKICQQMGLDGYPVFTRKEATDVSYLACLKFLLSDHTKGNLYPQLASHNAHTVATVLELADQSGRQVECQRLHGMGDALYDHILENKNMPVRIYAPVGAHKDLLPYLVRRLLENGANSSFVHRLVDAKTPIDDLVHDPVDDLQKYKSLANDRIPLPPNIYPENRKNSRSMNIHVESQLNPLMDELGKWRECQWNAGPIINGKTHKDSDEQSVLSPQNNGDSVGSVVWSTEKHVQAALDTAKQGFDAWNMTPASQRAQCLLKYGDLMEDNMEELMAICCREAGKTMQDAIDEVREAVDFCRYYAQQGVKQFEEATLLPGPTGESNEHYMEGRGVFFCISPWNFPLAIFSGQIMAALMAGNTVIAKPAEQTSLVAHRAVELMLEAGFPKNVIQLLPGDGAKIGGILTPHEDIAGIAFTGSTQVAHLLNKTLAQREGAIVPLIAETGGQNAMIVDSSALPEQVVGDVLQSSFASAGQRCSALRVLYIQKDVAERVETLLQGAMDELIVGDPAYHRTDVGPVIDDEALAGLQSHVDEMKAKFDLVAKAHLTEECNSGYFITPCAFRINSMADLSKEHFGPILHIVHYEAEKLDDVIAEINKAGYGLTLGIHSRSEATAAYIEQRVKVGNCYINRNQIGAVVGVQPFGGRGLSGTGPKAGGPNYLTRFATERVRTINTTAVGGNASLLSLGVEKV

SEQ ID NO: 19835 - protein, 572 aa, Oryza sativa (indica cultivar-group)
MASLLLPPQFLCSLPCSTNSIRSHLHYKPHFLGNIMTKPKAKMRLLNRNVSSMAKKSSQDVAEGSSDDESDGETSKTKKRAPRRGRKKATIQASEGETQEGQVSTEEDESPEGTKKIKRRGRKKAATTASSSEEKDKAKEPKKRGRRKVKTVEELSDNEGEDLGEDLVPSNDRQEKISANDLESKIAALLLEDTDDNDINNLIPLVCCFGPAKYSFIPSGRPANRLIDHEIHEGMKDMFWSPDQFVRAPGGSSSNVALALAASGGRVEFMGKLGDDDYGQSTLYHLNVNGVQTRAIKMDPSAFTAMSLMKVTEDCFVQTDINPAVLKEAKMFYYNSSALLEPATRSSLSKAIEVSKKFGGVTFFDLNLPLPLWSSSKETKSLVKEAWEAADIIEITKQELEFLCGIKPSEKFGTKDNDKSKFTHYSPEVVTKLWHENLKVLFVTNGTSKIHYYTKEHDGWVRGTEDAPITPFTGDMSQSGDAIVAALMKMLAINPHLVTDKDYLHTAMKHAITCGVIDQWLLARERGFLPRERADPTSEQFGVRFVTEKEYRTLPDSIHTEDSSESELLYVE

SEQ ID NO: 19836 - protein, 335 aa, Prochlorococcus marinus str. NATL1A
MTNETNAASLDIVGIGNAIVDVLTTIDDSFLKKLSFDKGSMTLIDENKAKELYEMTTNRIQKSGGSVANSLACVAQLGGKAAFIGRVRDDKLGEIFTEEISTTGTIFKTPPSSVGPSTARCIIFVTPDAQRTMCTYLGASVLLEPKDIDLSLVKEAKILYLEGYLWDNPAAKNAFIKAAEIAKNAGRKVALSLSDSFCVSRHRESFIKLVDDHIDILFANEDEITNLYETSSLSKALEKLKKKCDLAAITIGEKGSILISNGKEIKIDPFILGKAVDTTGAGDLYAGAFLKGYADGLKPELSAKIGSICAGQIVTELGSRSNTDLLNLINSYLEN

SEQ ID NO: 19837 - protein, 575 aa, Coccidioides immitis RS
MLSRAALPLMRHRAIPTSIRLSYTTLQSRYYAKNHKPHGYDIPSSAPSSSSHVNPSQKPRVVSQPPNPSKPKDFSEEQTEFESNPESQQNEAPQSTGAGAGVSHAQMGPSGAGAKSPEFSNNQTEFETESRPTKDASESESAQQPQQPLPDLTRGIPSTIAEELAAKSRRRGPTGLNLTEDPERGGAGDESGGGGDIPKNAYVSSLDRRRTRLANLTYAIMLSVGLAGTIYLGRDWATEEEEKAHPDAPSGWGSGLFFNRIKARFDDLTSYYKDPAFEKLLPEEDPALRQPYTLVLSLEDLLVHSEWTREHGWRVAKRPGVDYFLRYLNQYYELVLFTTVPSMMADQVLRKLDPYRIIRWPLFREATKYEDGEYVKDLSYLNRDLSKVILIDTHEPHAKRQPENAIILPKWNGDPKDRSLVALIPFLEYVAGMGMDDVRTVLKSFEGTYIPAEFARREKIMREKFEQQLAEERAKRPKHSIGSIASLFGIKPMGTAIDGLDHSTTEGLEQGKMLWDQIRERGQKQYQLIEKEIQENGEKWLAEMAAEEEKMRDEQMKGMKNSFTSFFGGGGQEKK

SEQ ID NO: 19838 - protein, 220 aa, Oryza sativa
MLKDSETRNKFSRNHQGLVRSCRTPCRRNRSRRTTKLIYGCLRSHAPTRTVAALLAETLGCSFIEADDYHSQANKAKMSKGIPLTDGDRIPWLEALRDAVRERLDHGEDVAVSCSALQQKYREILREGDCSFRSGSGSYSSCRVKFVCLEASAEVIADRIRRRSMEGEHFMPASLLQSQLDLLQIDEAEGITVVDATVRPNAIVHDTIARFREQLASTVC

SEQ ID NO: 19839 - protein, 150 aa, Agrobacterium tumefaciens str. C58
MSIPFPSAPADKEALENAGLFSPKFDAHGLVTAVVTDARDGELLMVAHMNAEALSLTLETGIAHYYSRSRDKIWKKGETSGNLQTVKEFRTDCDQDAVWLKVSVAGHDATCHTGRRSCFYRTVELSNGDAVTKITDDTRHFDPATTYSNT

SEQ ID NO: 19840 - protein, 238 aa, Rosa roxburghii
MGVCYGTLGNDLPAATEVVNLYKRHSITKMRLFDPNTAALQALKGSGISVILGIQNQDLPALAASQEAVNAWFTANVEPYLDGIELSYIAVGNEVIPGPVGNYDFPVMRFLRIRTMLDGRELSGIKVTTVVPGTALGSSYPPSSGVFAAEAVEVMTSIVQFLASTNSSLMINAYPYFAYKSDPANVHLDYALFTTKTSVIQDGPLGYYNLLDAIVDSFYTAMEKVGSPNVTVVVSESG

SEQ ID NO: 19841 - protein, 234 aa, Rosa roxburghii
VGVCYGRNGDNLPTDTEVVDLYKSNGIGRMRIYEPNQATLEALKGSNIELIVTILNNHLQELTDAAAATNWVQQNVQPYAADVKFKYIAVGNEVHPDAAEAKYLLPAIQNIQNAVTAANLQVKVSTAIDTTLQANFPPSDGAFSDAANSFITPVITFLGNNGSPLLANIYPYFAYINDPVNIKLEYALFTSPGVVVQDGSNGYQNLFDALLDTLYSALEKAGAPNMAIVVSESG

SEQ ID NO: 19842 - protein, 473 aa, Zea mays
  misc_feature (343)..(343): Xaa can be any naturally occurring amino acid
  unsure (1)..(473): unsure at all Xaa locations
VKDPYWKKNFQEDWKSRFDLPSITDIYDLKPRCSTICCCPSRTLTGDENVDMWNGYVNNDDRALLKVIKYSSPTSAGAECVDLDCSWVEQWVHRAGPRKEIYYEPEEVKAAIVTCGGLCPGLNDVIRQIVFTLETYGVKNIVGIPFGYRGFFEKGLKEMPLSRGLVENINLNGGSFLGVSRGGAKTSEIVDSIQARRIDMLFVLGGNGTHAGANAIHEECRKRKLKVSVVAVPKTIDNDILLMDKTFGFDTAVEEAQRAINSAYIEARSAYHGIGLVKLMGRSSGFIAMHASLSSGQVDVCLIPEVPFTLDGEFGVLRQLEHLLKSKGFCVVCVAEAAGQVCXIHSCLDLLQESGATDASGNVILSDIGVHMQQKIKMHFKDIGVPADVKYIDPTYMVRACRANASDAILCTVLGQNAVHGAFAGFSGITSCICNTHYVYLPITEVITAPKRVNPNSRMWHRCLTSTGQPDFH

SEQ ID NO: 19843 - protein, 522 aa, Kluyveromyces lactis NRRL Y-1140
MLLRTTTAGTRLAFKSQTAAFAHALRYYSHLPLKVKVDLPNGISYEQPTGLFINNQFVPSKQGKTFEVLSPSTEEEITHVYEGREEDVDAAVEAADKAFKSGVWSKVDPLVRSQCLSKLADYIEKDLDTIASIESLDNGKAISSAKGDVQLVVNYLRSAAGYADKVDGRVIDTGSTHFSYTVREPLGVCGQIIPWNFPLLMWAWKIAPALATGNTVVLKTAESTPLSALYVSQYIPKAGIPDGVVNIVSGFGKIVGEAITTHPKIKKVAFTGSTATGRHIYQNAGVNLKKVTLELGGKSPNVVFADANLKSAVQNSLLGIYYNSGEVCCAGSRLYVEESIYDDFLKEIKSASEALKVGDPFDAETFQGAQTSQNQLDKILKYVEIGKNEGATLITGGERIGDKGYFVRPTIFADVEESMRIVKEEIFGPVVTVTKFKTIDELIEKANDSEYGLAAGIHTSNINTAIQVSNRLNAGTVWINTYNDFHHCVPFGGFNASGIGREMGSEALDNYTQVKAVRVKLE

SEQ ID NO: 19844 - protein, 765 aa, Arabidopsis thaliana
MNFRNLIASGSRLGKRFCATVFAPASATGIVEASVSSPAAANVVEASVSSPAAENGVRTSVAAPTVASRQRELYKKLSMLSVTGGTVAETLNQFIMEGITVRKDDLFRCAKTLRKFRRPQHAFEIFDWMEKRKMTFSVSDHAICLDLIGKTKGLEAAENYFNNLDPSAKNHQSTYGALMNCYCVELEEEKAKAHFEIMDELNFVNNSLPFNNMMSMYMRLSQPEKVPVLVDAMKQRGISPCGVTYSIWMQSCGSLNDLDGLEKIIDEMGKDSEAKTTWNTFSNLAAIYTKAGLYEKADSALKSMEEKMNPNNRDSHHFLMSLYAGISKGPEVYRVWESLKKARPEVNNLSYLVMLQAMSKLGDLDGIKKIFTEWESKCWAYDMRLANIAINTYLKGNMYEEAEKILDGAMKKSKGPFSKARQLLMIHLLENDKADLAMKHLEAAVSDSAENKDEWGWSSELVSLFFLHFEKAKDVDGAEDFCKILSNWKPLDSETMTFLIKTYAAAEKTSPDMRERLSQQQIEEVASFESQKAVYPGEVKGEQDLEVDIEAGRSDVTQESTSDTVSGNGVWSERANFGVSEKIADDLSYPLIRDENRVETSSQSLDLSEKKCGNGKFKKSRKASKPPRPPKGPSLSENDRKIMRDIQELAMRKRARIERMKKSLKRLKAAKTSPSSPCITIFSMIITAIFFAFLVFQGFSTGSSSMNSDKSPAPTVSPNNQMISVQFYNDFAPVEQTDPSPTTSLRYTRKRISGAEEEDSRDVTR

SEQ ID NO: 19845 - protein, 234 aa, Rosa roxburghii
VGVCYGRNGDNLPTDTEVVDLYKSNGIGRMRIYEPNQATLEALKGSNIELIVTILNNHLQELTDAATATNWVQQNVQPYAADVKFKYIAVGNEVHPDAAEAKYLLPAIQNIQNAVTAANLQVKVSTAIDTTLQANFPPSDGAFSDAANSFITPVITFLGNNGSPLLANIYPYFAYINDPVNIKLEYALFTSPGVVVQDGSNGYQNLFDALLDTLYSALEKAGAPNMAIVVSESG

SEQ ID NO: 19846 - protein, 232 aa, Synechococcus elongatus PCC 6301
MDPVTHMKHEVAKAAASRVQSGMVVGLGSGSTAALMIQYLGDRVRNGELTNIQAVPTSFQSSVLANEYGIPLTTLNEVDRIDIAIDGADEVDPQRNLIKGGGACHTREKLVDARAEQFIVVVDSSKLVEALGTTFLLPVEVLPEAYIQVGKALEKLGGKPELRMAVKKAGPVVTDQGNLVLDVKFDRIDQPAELEKAINNIPGVLENGLFVGLTDLVLVGEVDGDRVSVREF

SEQ ID NO: 19847 - protein, 445 aa, Acinetobacter baumannii
MSVTSVNPATNATNEYYLTRQSQMESNVRSYPRKLPLAIAKAQGCWVTDVEGTQYLDCLAGAGTLALGHNHPAVIQSIQDTLASGLPLHTLDLTTPLKDAFTEALLAYLPGGKEEYCLQFCGPSGADATEAAIKLAKTYTGRSSVISFSGGYHGMTHGSLAMTGNLSAKNAVNGLMPGVQFMPYPHEYRCPLGLGGEAGVDALTYYFENFIEDVESGVTKPAAVILEAIQGEGGVVTAPVKWLQKIREVTEKHNIVLILDEVQAGFARSGKMFAFEHAGIEPDVVVMSKAVGGGLPLAVLGIKRKFDAWQPAGHTGTFRGNQLAMGTGLVVLETIKEQNLAQNAQERGEFPCIGNVRGRGLMIGVEIVDERKPADRIGSHPADSQLAAAIQTACFNNNLLLEKGGRNGTVIRLLCPLIITQEECVEVIARFKKAVAEALVAVRGA

SEQ ID NO: 19848 - protein, 420 aa, Glycine max
MDGTFDDEAEPAVTIREYLEEVEERELEADLVLGGDDGKECTYSKGYMKRQAIFSCLTCTPDGNAGVCTACSLSCHDGHQIVELWTKRNFRCDCGNSKFGEFYCKIFPNKDVENVENSYNHNFKGSYCTCGRPYPDPDAEEQVEMIQCCLCEDWFHEEHLGLESSAEIPKDDEGEPMYEEFICKACSEVCFFLKLYPEEIWAAGKQPDATVQISKDKGVLEDILSTCRSEKPTCDTSCCSPKVDDVQATVDSKSISDGKSLSQGENCNGSMASNQCTKSTDLHVNCLLSVNIITVSPVLPGKPMFLSKNWRLALCKCNNCLEFYEQKKIAFLLDKEDSIAEYEQMAKQKREEKLQQQEGAELSFFNKLGHVEKVEILKGIEEMKDGLRAFLESADSSKPITAADVHQFFDDIKNKRRRVQ

SEQ ID NO: 19849 - protein, 434 aa, Desulfovibrio vulgaris (strain Miyazaki) [sequence omitted]

SEQ ID NO: 19850 - protein, 181 aa, Oryza sativa
  misc_feature (38)..(38): Xaa can be any naturally occurring amino acid
  misc_feature (47)..(47): Xaa can be any naturally occurring amino acid
  misc_feature (58)..(58): Xaa can be any naturally occurring amino acid
  misc_feature (95)..(95): Xaa can be any naturally occurring amino acid
  misc_feature (119)..(119): Xaa can be any naturally occurring amino acid
  misc_feature (139)..(139): Xaa can be any naturally occurring amino acid
  unsure (1)..(181): unsure at all Xaa locations
ASPRRPAAPRMWPPPEFPALSTPQMLSQPPTPVKPVGXSCRHGRSRXHKPKQTGTPVXVKAPKEGGTVTLVNQRKVAKDMQYYFKQNHLQESDQXGPFFGFLGKNEIFNGIWICVGFSXRHVDIFFSRPGFCSTSEDPXYQFWECGFVLIGICSPLLFCKSMKYYVSSFILQRESSLLHIV

SEQ ID NO: 19851 - protein, 498 aa, Oceanobacter sp. RED65
MSSQRTFEYWKEQAASLSINGQAFINGQSVDAKSGETFETISPIDGRVLANVASCDEADVNEAVKLARAAFDSGVWSQKAPAERKQVLLKFADLIEANQEELALLETLDMGKPISDALSADIGGTLRAVRWTAEAVDKVYDEIAPTSENEIGMITREPVGVVAAIVPWNFPMIMASWKFSPALAMGNSVILKPSEKSPLTAIKLGQLAKEAGIPDGVFNILPGFGHTAGKALALHMDVDTLVFTGSTNVAKQLMIYAGQSNMKRIWSEAGGKSPHVVFADAPDLDLAADAAAAAICFNQGEVCTAGSRLLVEDSIYDEFMEKVRQSLGKWKAGNPLDPETNVGAIVDEDQLNRVLSFIEKGKEEGANLTVGGNRVELAEGGYFLEPTIFEDAQPHMSIVKEEIFGPVLSVIRFKTDEEALQLCNDSIYGLASGVWTNNLTRAHRFAKGIKAGMVWINEYDQGDMTAPFGGYKQSGNGRDKSLHAFEKYSEVKATWIKI

SEQ ID NO: 19852 - protein, 167 aa, Medicago sativa
MKKKFARIFNKFDKNGDGKISRTELKEMMTALGCKTTTEEVTRMMEELDRNGDGYIDLKEFGELHNGGGDTKELREAFEMYDLGKNGLTSAKELHAVMRRLGEKCSLGDCRRMIGNVDADSDGNVNFEEFKKMMSRSEYCNDVMVKMYFTILFYYSSLSISILIYIS

SEQ ID NO: 19853 - protein, 441 aa, Mycobacterium smegmatis
MCMLKQSQPTRRPTRPQRTFTYPGGKLELPILKATEGTDSVALGKFLAETNLTTFDSGFMNTASTKSAITYIDGEQGILRYRGIPIEQLAEKSTFIEVSYLLIYGELPTPTQLEEFTTKIQRHTLLHEDLKRFFDGFPRNAHPMPVLSSAVNALSAYYQDSLDPKDDEQVELSTIRLLAKLPTIAAYAYKKSAGQPFLYPDNSLSLVENFLRMTFGFPAEPYEVNPDVAKALDMLFILHADHEQNCSTSTVRLVGSSQANLFTSISGGINALWGPLHGGANQAVLEMLDAIKADGGDTKKFMERVKNKEAGVKLMGFGHRVYKNYDPRAAIVKKTADQILETLGVQDDLLEIAKGLEEVALNDDYFIERKLYPNVDFYTGVIYRAMGFPTRMFTVLFALGRLPGWIAHWREMHEDPTTKIGRPRQLYTGYTERDYVPMSDR

SEQ ID NO: 19854 - protein, 463 aa, Oceanobacter sp. RED65
MFSGLMFYLFNINSAKHVQNNIQMTEVTMSTSKHDAFWMPFTANRQFKAEPRLMVSAEGMYYQTEDGRNVLDGTAGLWCVNAGHGRKRISEAVAKQIQQLDFAPTFQMGHPLPFELAERLVKHTPDGLNRVFFTNSGSESADTSLKIAIAYHKAKGNHGKTRLIGREKGYHGTNFGGISVGGLGNNRKSFGSLLTGVDHLKHAWKPGSEFTKGLPEDGAEMADELLDMIALHGAETIAAVIVEPIVGSGGVFMPPQGYLKRLRQITEQHDILLIFDEVITGFGRVGEAFASNRMGVTPDIMNTAKGLTNGAIPMGAVFLQDFIYDAFMQGPEEIIELFHGYTYSGHPVAAAAGLATLDIYEEENLFQKALQLESYWQESLHKLREHGVVKDIRNYGLVGAIELHSSEKFGERGYKIFNHCYWKQNALVRCTGDTIAMSPPLILEESHIDELMNALSKSLSNAL

SEQ ID NO: 19855 - protein, 122 aa, Mycobacterium smegmatis
MTSTEKPEVEFQAGPPPSELTMTDLIVGEGAEAVRGGVVDVHYVGVDYETGEEFDSSWDRGQSANFPLDRLIPGWQEGIPGMKVGGRRQLTVPPELAYGPAGAGHRLSGRTLVFVIDLLGVA

SEQ ID NO: 19856 - protein, 297 aa, Campylobacter jejuni subsp. jejuni NCTC 11168
MQKIDELIKQFLQELGYEPILNMLSNVKSGKKLRSKLLLAIADESEIAFKICAAIELIHLASLLHDDIIDESELRRGARSVNAEFGTKNALMLGDILYSKAFYELSKMDARFASIISDAVVKLAIGELMDVDLGEKFNINKEAYLKMIYNKTAVLIEASARCGAILAGLYEKDFAEYGKNLGLAFQMIDDILDIKSDEKILGKPAMNDFKEGKTTLPYIYLYENLQEQDRIYLQTLFKKDLNENEKEWLKTKFEEQKALEKAILEAKTYAKKARKAIEKYDNNKLNDIIKAMIDREF

SEQ ID NO: 19857 - protein, 496 aa, Xanthobacter autotrophicus Py2
MHALLDPQEMGQADRLATEMGTPSFTLMERAGTAVADVVARFPLPTRVVVLCGPGNNGGDGFVAARVLTQRGFRVRVALLGERDKLGGDARRAAERWRGPVEEPAVLDLTEAGVIVDALYGAGLARDLDGAAKALVMRMAASGRPIVAVDLPSGLDGATGKVRGAAAQAQETVTFFRRKPGHLLEPGRSLCGRVRVADIGIPDAVLDVIRPATSVNMPELWRPAFPLPSALGHKYDRGHAVVVSGGAWTSGAARLSARGAFRAGAGLVTVALPPDALPLHAASYAAIMPRPMACDDDLATLLADRRLGTVVLGPGLGMGAATRAKIDIAAPGRRLVLDADALTSYAGVPWALADVAARTAGLIITPHEGEFARLFAGDRAVLEAPSKLARTRAAAARLGAVVVLKGADTVVAAPDGHAAIAENAPPWLATAGAGDVLAGMAGGLLAQAMPAFEAAAAAVWLHGEAARVAGPGLVADDLPEALREVYRRLYETLGVR

SEQ ID NO: 19858 - protein, 471 aa, Xanthobacter autotrophicus Py2
MTIKTAKDVLDLIKSEDVKYVDLRFTDPRGKWQHVTFDISMVDDEFLTEGTAFDGSSIAGWKAINESDMLLMPDPATTCIDPFFAETTLSIVCDVLEPTTNQPYGRDPRSIARKAEAYAKSTGIGDAVYFGPEAEFFIFDDVRFKADPYNTGFKLDSVELPTNGDTEYEGGNLGHRVKTKGGYFPVPPIDSAQDMRSEMLAAMAKMGAKVEKHHHEVASAQHELGLKFGSLVTMADHLQVYKYCIHQVANIYGKTATFMPKPVFGDNGSGMHVHQSIWKDGKPLFAGDKYADLSDYCLWYIGGIIKHAKSLNAFTNPLTNSYKRLVPGYEAPVLLAYSARNRSASCRIPYTNNPKAKRVEVRFPDPGANPYLAFAALFMAGMDGILNRIDPGQAMDKDLYDLPPAELKQIPTVCGSLREALDSLAADHEYLLKGDVFQKDFIESYIELKMTEVMRFEMTPHPVEFEMYYSV

SEQ ID NO: 19859 - protein, 614 aa, Kluyveromyces lactis NRRL Y-1140
MSIDTLPSQLAAAPAPAAAVTASIPRNPSDPVDGLPKAGHLQQQQQQQQQQASVLRTRSRKGTFSSKIGKLFGVSKVSPDEDLPRHNVSVNTSTSQVPQATSAGSGTGTTASPPSPPSSSSSSSLSSRYRYDGTRPSSPRLASGATSTINSSSYNNKHFNSQQHLASDGKSIASSTEKLHSASSTANLSTLSSANTCPNPNRRFILHEDGTHEHHLKNAKRQEKLGSMIKNMLGAQKLRGEAKSAVPDILIKSMKSGDPPSLFAGLIKQVDAASAETYQLQNGTAYPYSGATQVLGTKQEQSQPDLKMLNFEDAVNPLHHGSVTFGQKYGRCQEVIGKGSFGVVRICHKKNLKSVSGEILYAVKEFRRRPTENPVKYSKRLTSEFCISSSLKHTNIIETLDLFQDAKGDYCEVMEYCSGGDLFTLIIAAGKLEYQEADCFLKQLITGVVYMHNMGVCHRDLKPENLLLTHDGTLKITDFGNSECFRMAWEKEIHLSGGVCGSGPYIAPEEYTQEEFDPRAVDIWACGVIYMAMRTGRQLWATAQKEDEFYLKYLKGRKNAAGYDPIEKLKRARCRNVIYSILDPVPSRRLSGDQILNSEWGREIVCCHEGHPIK

SEQ ID NO: 19860 - protein, 332 aa, Prochlorococcus marinus str. NATL1A
MESLLNQLSSMTVVVADTGDLEAIKKYHPRDATTNPSLILAAAQMPAYQSLIDQALTTSREMLGTSAAKVDVVKEALDELCVVFGKEILKLIPGRVSTEVDARLSFDTDATIEKARKIIAKYNADGISNDRVLIKIASTWEGIKAAEVLEKENIHCNLTLLFNFYQAVACAEAGVTLISPFVGRILDWYKSATGRDSYPATEDPGVVSVTKIFNYFKSNGYKTEVMGASFRNIEEITELAGCDLLTISPKLLQQLNETHTDLPIKLNAQKPLVIEEKIHLDQTSFELMMAGDKMATEKLDDGISGFSKAIDKLENQLNERLELIEGGVALTL

SEQ ID NO: 19861 - protein, 234 aa, Rosa roxburghii
AGVCYGRNGDNLPTDTEVVDLYKSNGIGRMRIYEPNQATLEALKGSNIELIVTILNNHLQELTDAAAATNWVQQNVQPYAADVKFKYIAVGNEVHPDAAEAKYLLPAIQNIQNAVTAANLQVKVSTAIDTTLQANFPPSDGAFSDAANSFITPVITFLGNNGSPLLANIYPYFAYINDPVNIKLEYALFTSPGVVVQDGSNGYQNLFDALLDTLYSALEKAGAPNMAIVVSESG

SEQ ID NO: 19862 - protein, 343 aa, Ralstonia eutropha JMP134
MSNAMAASAVPDDTAYPRLLADVGGTNVRFALETAPMQIGAVTALKVADHPSLEAAMRHYRDALSASGAKLPRHAAIGLANPVTGDHVRLTNHDWAFSIEATRQALGLQTLVAINDFTSLALGLPYLGANDLVQIRSGQAVATAPRALIGPGTGLGVSGLVPAPGGGAVALAGEGGHIELMPVTDDEWIAWRATHASLGRVSAERLLSGMGLSQIHAALSAETGTRVDVPLTPEQVTTGAFARHDPLCERTMAVFFGLLGSVAADIALVMGALGGVYLGGGILPRFVPALQASAFNARFVAKGRMRGYLDKLPVYVITASYPALPGLARALADTLSHGRPHIG

SEQ ID NO: 19863 - protein, 236 aa, Rosa roxburghii
MGVCYGMLGNLPPQTDVVALYKQYNIRRMRLYDPNQAALTALRGSNIELILGVPNDNLRTIASSQANANSWVQNNVRNYGDVRFKYIAVGNEVQPEESSAQFLVPAMRNIQTAIANAGLGNQIKVSTAIDTRGLGESYPPSKGSFKSENRALLDPIIRFLVEHRSPLLVNLYPYFSYKDNTGAIRLDYALFTAASVVVQDGQLGYRNLFDAMLDAVYSALEKAGGGSLEIVVSESG

SEQ ID NO: 19864 - protein, 234 aa, Rosa roxburghii
MGVCYGRNGDNLPTDTEVVDLYKSNGIGRMRIYEPNQATLEALKGSNIELIVTILNNHLQELTDAAAATNWVQQNVQPYAADVKFKYIAVGNEVHPDAAEAKYLLPAIQNIQNAVTAANLQVKVSTAIDTTLQANFPPSDGAFSDAANSFITPVITFLGNNGSPLLANIYPYFAYINDPVNIKLEYALFTSPGVVVQDGSNGYQNLFDALLDTLYSALEKAGAPNMAIVVSESG

SEQ ID NO: 19865 - protein, 371 aa, Zea mays
  misc_feature (15)..(15): Xaa can be any naturally occurring amino acid
  unsure (1)..(371): unsure at all Xaa locations
TRWRQLGSGPMLGQXLRRLRPAAAAEVARGYSAAAKEMTVRDALNSALDEEMSADPSVFLMGEEVGEYQGAYKISKGLLDKYGPDRVLDTPITEAGFTGIGVGAAYQGLRPVIEFMTFNFSMQAIDHIINSAAKSNYMSAGQISVPIVFRGPNGAAAGVGAQHSQCYAAWFAHVPGLKVLTPYSSEDARGLLKAAIRDPDPVIFLENELLYGESFPVSAEVLDSSFCLPIGKAKIERGGKDVTITAFSKMVGYALQAAEILAKEGISAEMINLRSIRPLDRAAINASVRKTNRLVTVEEGFPQHGIGAEICMSVVEESFEYLDAPVERIAGADVPMPYAANLERIAVPQVDDIVRAAKRACYRAVPMAAAA

SEQ ID NO: 19866 - protein, 423 aa, Methanocaldococcus jannaschii [sequence omitted]

SEQ ID NO: 19867 - protein, 232 aa, Rosa roxburghii
AGVCYGMLGNLPPQTDVVALYKQYNIRRMRLYDPNQAALTALRGSNIELILGVPNDNLRTIASSQANANSWVQNNVRNYGDVRFKYIAVGNEVQPEESSAQFLVPAMRNIQTAIANAGLGNQIKVSTAIDTRGLGESYPPSKGSFKSENRALLDPIIRFLVEHRSPLLVNLYPYFSYKDNTGAIRLDYALFTAASVVVQDGQLGYRNLFDAMLDAVYSALEKAGGGSLEIVV

SEQ ID NO: 19868 - protein, 766 aa, Aspergillus nidulans FGSC A4
MGSFLKSFRKDVGSAAPSVGAPPAKKEPQPLPMTPLEKMLTELGPIRGDGSDKFYGMENFGNTCYCNSILQCLYYSVPFREAVLNYPKRTPIEDLEAALAKALRYQDPNARLEAEALAEKQKAANSPRPGQPPNPQQKPEDKDSPEYKKKLALQTLPLLETTDNSVSYGIPESLFSSLKDMFESIVGSQSRIGIIRPQHFLEVLRRENEMFRTAMHQDAHEFLNLLLNEVVVDVEKAAAKLLESPQPASDVSDSVIPSSSSGSRTPNTTRWVHELFEGLLTSETQCLTCEKASQRDEVFLDLSVDLEQHSSVTSCLRKFSAEEMLCERNKFHCDNCGGLQEAEKRMKIKRLPRILALHLKRFKYTEDLQRLQKLFHRVVYPYHLRLFNTTDDAEDPDRLYELYAVVVHIGGGPYHGHYVSIIKTQDRGWLLFDDEMVEPVDKNYVRNFFGDKPGLACAYVLFYQETTMEAVMKEQEQENTEPPVEVNASTLKQNGFSSSATLAHAHSASQVPTYEDHDRFTGLKRAPTAPQLSTHPEHTTTDSESLPSPAPDPAPLTSLPPIPPIPETPPAPLTSRKSDLQSKKERVKEEKERKAAEKEKEKQRRKEIETRLKDRQRREDDDLKAALEASKVSKEDEDRRNHAENGTSKKNAGGLGRFRSLSQRLSTKESRTSLSRIPPLPNGNHTLSKVPDESEQTHPKSPTPPAPLSRPASQPLNDDLLGSPRADTLAVPTEQEHIKNSKHDRSSHGKWRSFSLRKKSFNILSS

SEQ ID NO: 19869 - protein, 413 aa, Coprinopsis cinerea okayama7#130
MATHGPINGVKISPIDDPHKVVRVIASDGKTGETRELSYTNCKVIGNGSFGVVFQARLLGVPKDQEDIAIKKVLQDKRFKNRELQIMRLVSHPNVVDLKAFFYSNGDKVSPYLQVSQEKFDHLNQQKDEVYLNLVLEYVPETVYRASRHYSKLKQPMPMLQIKLYMYQLLRSLAYIHSVGICHRDIKPQNLLLNPSTGVLKLCDFGSAKILVAGEPNVSYICSRYYRAPELIFGATNYTTNIDIWSTGCVMAELMLGQPLFPGESGIDQLVEIIKVLGTPSREQIKTMNPNYMEHKFPQIKPHPFSKVFRPRTAPEAIDLVSKLLEYTPGARLSAVEAMVHPFFDELRAEGAKMPNGKEFPRLFDFTREELSVRPDLIRKLVPPHAEPELASRSIALDTFVPIPLEQMKISLD

SEQ ID NO: 19870 - protein, 488 aa, Alteromonadales bacterium TW-7
MLNKLIFTAKEVRDNEALAAKNSHCELFTLMQRAGHAAFNAWQDFNAEHTLVVVGHGNNAGDAYITASLIKQAGKRVTLCAVNPEKSLTGDAAKAFKLWRDEGGEVNAYTSELLNRSDLIIDAMLGTGITSSVRDNFAKIINEINASNKPVLSIDVPSGINADTGHPLGTAIQASKTITFVGIKQGLTTAIGKQHCGELIFDDLNIRPAFFELATSSGTLININSFKKLGARSVNSHKGTHGKLLCVGGNEGTAGAIRLTSEAALRAGAGMVKVYTHSSSVVPVSIGRPELMVTSTNLKEALEWASCVVIGSGLGQDEWAQKTFEEVIYYCQTNNMPLVIDADALNLLAKQASSYTLKQCVLTPHPGEASRLLSKTIVDVESNRFENARLCAKRYNATCVLKGAGTLIDNAENTWVCEDGNAALAVGGSGDVLTGIIAALLAQGLNIDEAARYGVTLHAKAGDIASEGEGQRGMLPSDLFSIVRQLLN

SEQ ID NO: 19871 - protein, 165 aa, Magnaporthe grisea
MSKPNVFFDISFNGVTKRVEFKLYDDVVPKTADNFRRLCVGEPGVGGYKDSGFHRIIPDFMLQGGDFTRGNGTGGKSVYGEKFADENFQIKHTRPGLLSMANAGPNTNGSQFFITTVKTSWLDGKHVVFGEVVSGFEDVIKPIEALGSSSGTPKTKVTIVNAGTV

SEQ ID NO: 19872 - protein, 700 aa, Corynebacterium diphtheriae NCTC 13129
MTLSPELQALTSRHYPSDWDDLDTQAVDTARVLAADAVQNCGSGHPGTAMSLAPLAYTLFQRVMNVDPADPHWAGRDRFVLSCGHTSLTQYIQLYFGGYGLELEDLKALRTWGALTPGHPEYRHTKGVEITTGPLGQGLASAVGMAMASRRERALFDPTAADGASPFDHYIYVIASDGDLQEGVTAEACSLAGTQKLGNLIVFWDDNRISIEEDTEIAFNEKVVDRYRAYNWQVIEIDGGENVEAIEKAVAEAKADTSRPTFIRVRTVIGYPAPTKMNTGAVHGAALGAEEVAGTKKALGFNPEESFAVAPEVISHTRKLLERGAQRHAEWREHFESWAETNPENKALFDRMASRELPDGFDADLPSWEPDAKGVATRKASEATLQALGATLPELWGGSADLAGSNNTVIKGSPSFGPSTISTSTWTAEPGGRNLHFGIREHAMGAIINGISLHGGTRPYGGTFLIFSDYMRPAVRLAALMGTDAYYVWTHDSIGLGEDGPTHQPVEQLASLRAIPGVSMLRPADANETAAAWRAALLYKEGPKGLALTRQNVLVLEGTKEKARDGVSRGAYVLVEGSKKTPDVILMASGSEVQLAVEAAKTLEAEKIAARVVSVPCLDWFEEQDAAYQEEILPQAVSARVSVEAGVALSWYRHLGTHGRAVSLEHFGASAPYEKLFSEFGITTEAVIAAARESLAAAQQ

SEQ ID NO: 19873 - protein, 726 aa, Acidobacteria bacterium Ellin345
MNDRSFSFRNARWAFLLFAALFVCVLAAAQNAPRGSYVFQRDSDGGKADAGNSLTITFDESGNIQLSGSGAQSLSVTGEYQVFGETITLSIPAVSKSVSRRPFSLSGDTLTLPFKIFSDGPGTSTWKATTQTAHNGGTGKSGGSGGGSGAGSGSGSGSGGSGSGSGGGSGSGGGSGGSGGSGGGGGAGGGGGSGGSGGSGGSGGSGGNGGSGGSGGSGSGGSGGSGGSGGGKGGGKSGGKGGRPAVTAPWQDSPYAKWMGDWVGTGWGWETRFKSSDVGTNPGGGHDMMTLTVRHLTRFHYTVDKNGQIEGDGAITYDLDPNLCGVYRAAQQVNMAIDVMKSINEAPSKMRKLVEQANNLFTMKTVREYTDFQGQIEKMANSVKDEGKKRATDTVKNYVMEGLGAKAEDTQDLAKNVIYQRCMQNVPVVVFDSMVCESVKDPKAKGPSNAGEFVFKALADKAAGNPQPDYWNQAVTAISDPGPLVDEAKEALKKKTIKALNVFDVKQKPGKDECSGVPSTQKAGTSMNNVTMNDLMQSWAETMEGMATAGASGDVGGVMGSATDLIMNAPGVTKVQYDYKGLKNGPESRRFKITGYIEGDKAYLRMDGDTYGGDKELYVEYTVNWQKGGGKFPTWSPFIDEEGGDVQAKGKMKGLSRKTVACSADDLKKDPKCQPKEELVTVEENSSTPFAIYHKTGEHRGGVKPWHEYEYYWRAQRVTAPLPPSK

SEQ ID NO: 19874 - protein, 214 aa, Kluyveromyces lactis NRRL Y-1140
MSGLRTVSANGSTNKNYDSVMKILLLGDSGVGKSCLLVRFVEDKFTPTFITTIGIDFKIKTVDINGKRVKLQLWDTAGQERFRTITTAYYRGAMGIVLIYDVTDERTFENIRQWFSTVNQHASEDVVMLLVGNKKDMDTRTVSYEQGEALAKELGIPFIEASAKDDTNVSEIFFTLAKLIQEKIDDGKMEGKAEKEGNVSIRGSGSSGSKSNCC

SEQ ID NO: 19875 - protein, 129 aa, Glycine max
  misc_feature (27)..(27): Xaa can be any naturally occurring amino acid
  misc_feature (40)..(40): Xaa can be any naturally occurring amino acid
  misc_feature (95)..(95): Xaa can be any naturally occurring amino acid
  unsure (1)..(129): unsure at all Xaa locations
MHSDNDMAACGGLLRDCHGRWAASFVXKLGNTSAFVAELXGAYLGLSLAWDKGDKNLEVNIDSLVVVVSIKISKQGSASGWSLINTICWLIGRRXECYLCHIYREANGCADALANYACAMEEEYVILEQ

SEQ ID NO: 19876 - protein, 193 aa, Bacillus cereus G9241
MKKILLLLADGFEAVEASVFTDVLGWNKWEGDGSTEVVTVGLRNKLTCTWNFTVIPEKTVDDIQLDEFDALAIPGGFEEAGFYRDAYSREFSHVIQHFYAKQKPIASICVASLTLGKSGILTGKKATTYSHPTSKRKEQLKNFGAIIQNDLIVQDGNIITSSNPGTAFDVAFLLLEKLTSKKNAEHVKDLMGF

SEQ ID NO: 19877 - protein, 172 aa, Campylobacter jejuni
ACPLQLAPMSSTTATLVMGDALAAALMKARNFKPDDFALFHPGGSLGRKLLTKVKDLMVSSNLPIVHPDTEFNDLVDVMTSGKLGLCVVLENKKLVGIITDGDLRRALKASDKPRFDFKAKEIMSTNPKVVDADAMASEAEEIMLKYKIKEIIVGKEEKVVGIIQLYVIGNV

SEQ ID NO: 19878 - protein, 458 aa, Arabidopsis thaliana
MDGAGEKRVRAKGSREVDWISNLPETLLCQVLFYLPTKDVVKSSVLSSRWRNLWKYVPGFNLSYCDFHVRNTFSYDHNTFLRFVDSFMGFNSQSCLQSFRLEYDSSGYGEPKLALIRRWINSVVSRKVKYLGVLDDSCDNYEFEMPPTLYTCETLVYLTLDGLSLASPKFVSLPSLKELHLSIVKFADHMALETLISQCPVLENLNINRSFCDDFEFTCVRSQSLLSFTHVADTDEMLNEDLVVAIDAPKLKYLRLSDHRIASFILNDLASLVEADIDTVFNLICKKMFNPNDLNKRNMIRDFLVGISSIKTLIIASSTLEVIYDYSRCEPLPLFRNLSSLRVDFYGYKWEMLPIFLESCPNLKSLVVGSANYREKEGINILSVPRGFLSSLEYVKIERPLKGEAMEMKLVSYLLENSTILKKLTLCLDDSIKKEESVILKELNTIPRLSSACQVVIL

SEQ ID NO: 19879 - protein, 491 aa, Agrobacterium tumefaciens str. C58
MIFLSQLSLFDPAAMARIDAAAGQSGISLYDLMERAGHAVAASGLRHYPQALRFVVLCGGGNNGGDGYVAARALVQSGATVTVHHLGDAGTLRGDARVAFERSGLVPLPLGDYTPLAGDVVIDAVFGAGLSRDVPQELARIIEAVTSARVPVLAVDLPSGLCGRRGVPLGASFRAERTVTFMARKPGHLLMPGRELCGALEVFDIGIPLRILADHAGSVAENHPLVWRDALPASDLETHKFRRGHLTVFSGPAHATGASRMTALAALKAGAGIVTIAAPKEALDLLSVTLTAVMNAPMDNADDLRLWLDDQRHGTFVLGPGFGDLKKARQFVSLLGDKAAVLDADAITAFKDHAAALFERITSGAGKFVLTPHEGEFARLFPDLAADRTLSKIEKAQVASARSGAALVYKGADTVIAAPDGRALVSTNAPASLATAGSGDVLAGIIGALLAQGTPAFEAAAAGVWLHGEAGHRAGDGMTAEDLAHAVRPFG

SEQ ID NO: 19880 - protein, 461 aa, Kluyveromyces lactis NRRL Y-1140
MSAEPYEPEFQQAYNEVYNCLKDSTLFDKKPVYKKVLPVVSVPERIIQFRVTWENDKGEQEVATGFRVQFNSAKGPYKGGLRFHPTVNLSVLKFLGFEQIFKNALTGLSLGGAKGGLCFDPKGRSDSEIRRVCYAFMKELSRHIGQDVDVPAGDIQVGGREIGYLFGAYRHYKNSWEGVLTGKDLNWGGSLIRPEATGYGLIYYTEAMIKYASQGKESFEGKRVVISGSGNVAQYAALKCIELGATVLSLSDSKGSVISETGITAEHIYAIQDGRAAWKTLEQIVGEASVFSGSSVKYIAGARPWVHVGKVDVALPCATQNEVSGAEAEHLVANGVKFVAEGSNMGSTQEAIDVFEGVRLQTASASAPAVWYAPGKASNMGGVAVSGLEMAQNSARVSWTRETVDAELKKIMTTCFDDCVTTAKEYSNESNVEALPSLVKGANLTGFIRVADAMLHQGDVF

SEQ ID NO: 19881 - protein, 241 aa, Rosa roxburghii
VGVCYGMMGNNLPSHSEVISLYKSNKINRMRLYDSNHGALEALRGSNIEVILGVPNSLLQDFAKNPSNAQNWVKTNVLDFYPSVRIKYIAVGNEVSPVNGDTSLAQFLLPAMQHVYQAVRAANLHDRIKVSTAIDTTLIGVSYPPSQGAFRGDVRGYLDPIIGYLVYAKAPLLANIYTYFSYVGNPRDISLPYALFTSPSVVAWDGNKGYQNLFDAMLDALYSALERAWGGSLEVVVSESG

SEQ ID NO: 19882 - protein, 234 aa, Rosa roxburghii
VCYGMLGNLPPQTDVVALYKQYNVRRMRLYDPNQAALTALRGSNIELILGVPNDNLRTIASSQANANSWVQNNVRNYGDVRFKYIAVGNEVQPEESSAQFLVPAMRNIQTAIANAGLGNQIKVSTAIDTRGLGESYPPSKGSFKSENRALHDPIIRFLVEHRSPLLVNLYPYFSYKDNTGAIRLDYALFTAASVVVQDGQLGYRNLFDAMLDAVYSALEKAGGGSLEIVVSESG

SEQ ID NO: 19883 - protein, 581 aa, Oryza sativa (japonica cultivar-group)
MAAASPPASPPHPKRRKMSSSSDPDQEPTSPSAAGADGAQPRAPRYKRRKVAILLGYCGAGYQGMQKNPGARTIEGDLEEALYRAGAVPEADRAAPRRYDWARAARTDKGVSAAAQVVSGRFYVDPPVFTDRLNAQLAPQIRAFGYVRVTNSFNAKKFCDRRRYVYLLPVFALDPSAHPDREAVMASVGSGSELTKCLECSERGRKVPGVMGREGKVPDPALQEEKSVEASREEAAVGSNEDANCDPASTGDRSVDLPIPDNETNTQITEMRSNGAEKCDVQLSGGTLCSEAVPASNSETVCPILNSDSNTNSDSVDVDPSFVAEKKGSIETVVTEDGKKQAMDVVTEDEKKQDVDYEGSSLEEMPLRSAFSYTHEVKERFNRILKKYVGTHNFHNFTTRTKAEDPAAKRFIISFAADRVVNLDGIDFIRCEVVGQSFMLHQIRKMIGLAVAVMRNCAPESIYDVAFRKDVNLNVPTAPEVGLYLDECMFTSYNKKWKDSHEAVSMEPYSEEAEEFKLKYIFPHIAAMEHKEGAVALWLHSLNSRNYPDFRYMDNAGTEASIAAAVESVDEGTVPSDNISE

SEQ ID NO: 19884 - protein, 211 aa, Oryza sativa (japonica cultivar-group)
MVDLIHETDDAMAEAELLLERSRAITLNGRDKRGRALVRIVGKYFPARALGGRAEAALRGYVRRRVLPEIGEREFVVVYVHSLVDRGDNFPGVAAIRAAYEALPAAAKERLRAVYFVHPGFQARLFFATLGRFLFSSGLYEKLRYMSRLEYLWEHVSKGEMEVPECARRHDEELERRPLMDYGIEATDRRCMFDAASMDTSASLHSLRCIS

SEQ ID NO: 19885 - protein, 352 aa, Oryza sativa
MADGHHWNIVKIPPIVQELAAGVHEPPSQYMVGEKDRPAIAGSDMPEPIPVVDLSRLSASNGEDSAGELAKLRSALEDWGLFLVNKSAGLFGTIMEGSILSEMINVTRGFYKLPLEEKQKYSNLVNGKDFRIEGYGNDMVVSEKQILNWCDRFYHIVEPEDVLHEYTMRCREITSLVLARLARLLGLREGYFVDMFDEDATTYARFNYYPRCLRPEDVLGLKPHSDGSVITVVSVDDTVSGLQVLRQGVWYDVPVVPNALLINMGDGMEIMSNGLLKSPVHRVVTNAERERVSVVMFYALDPEKELEPAPELVDDEKRPRQYAKMKIKDYLSGFYETFARGTRVIDTVKMSE

SEQ ID NO: 19886 - protein, 262 aa, Pseudomonas putida KT2440
MSNLRRAAEALRRSKTVVFFTGAGISADSGIPTFRDKLTGLWAKHDPQRLETADAFRANPTLVWSWYLWRRHQVSQAKPNSAHLSIPQLADAGWDVSVVTQNIDDLHERAGSSPVVHLHGSLMDVKCFGCHRPAELSPDQLAVPLEGQLIEPPRCTRCNGRLRPGVVWFRENLPDNAWRSAVRLVRACDLLVSVGTSGVVMPAAGIPDMALAVGATVIHVNLEDVGMDGADEIMLEGPAGVVLPALLQATGVAALSPPGVPT

SEQ ID NO: 19887 - protein, 205 aa, Corynebacterium glutamicum
MKIAVIGLGSTGSMALWHLSNIPGVEAIGFEQFGISHGYGAFTGESRLFRMAYHEGSTYVPLLKRARALWSSLSEISGRELFHNFGVLSTGKEDEAPFQRLVESVERYELPHERLTAAQMRKRYPGLDFRDDEAGIVDLQGGALRPELAVFSAIETAKANGAQVRDHQKITSIEDNGDHVVIQAGEETTIVDRVIVTTGSWTSEL

SEQ ID NO: 19888 - protein, 290 aa, Oryza sativa (japonica cultivar-group)
MEDERNTESHQGGEAAEQVEVKDRGLFDNLLGRKKDDQPEEKKHEEELVTGMEKVSVEEPKKEEHHAEGEKKESLLSKLHRSSSSSSSSSDEEEEVIDDNGEVVKRKKKKGLKEKIKEKLPGHKDHAGEHAPPPAATGFPAPAPPASVVTAAPTPAPAPVVTHGDHHHDTAVPVEKIEGDHAKTEATLPRAPEEEKKGFLDKIKEKLPGGHKKPEDATAVPPPAASPAAPATTPAPAHPPPATEEVSSPDGKEKKGILGKIMEKLPGYHKGSGEEDKTAAAATGEHKSSA

SEQ ID NO: 19889 - protein, 152 aa, Medicago truncatula
MLISLCSKIIIKFTLFIFLLVIYGVISTPPEDPIKCSSNNTNCTITNSNGAFPDQSICKASEVVYPTSEVELISIVALASENNRKMKVATRFSHSIPKLTCPDDDTQNGLLVSTKFLNNVLKIDVDAMTISVESGVTLRQIISEAAICSDRQ

SEQ ID NO: 19890 - protein, 156 aa, Medicago truncatula
MESLCATLQLLVHTWETQNAVDFDITYYRSKDPLTPRLFEDIIEEIEQIGLFKYGGLPHWGKNRNLGFVGAIRKYKKAGKFLKVKEEYDSRGLFSSEWTNQVLGLKEGVTILKDGCALEGLCICSQDTHCAPKNSYFCRPGRIYKDARVCRRGVNT

SEQ ID NO: 19891 - protein, 260 aa, Corynebacterium diphtheriae NCTC 13129
MARTPLIAGNWKMNLDHLQAVATVQKLAFALPKEYYEKVDVAVTVPFTDLRSVQTLIEGDKLAITYGAQDVSQHEAGAYTGEISAQMLAKLGCTWVVVGHSERREYHGESSELVAVKAKAALNQGISPIVCVGEPLEIREAGTHVEYVVEQTRASLAGLTADDLAKTVIAYEPVWAIGTGKVASAADAQEVCAAIRNLIIELAGKEVAEGLRILYGGSVKAETVAEIVGQPDVDGGLVGGASLDGEAFAKLAANAATVVD

SEQ ID NO: 19892 - protein, 405 aa, Corynebacterium diphtheriae NCTC 13129
MAIKTLKDLLAEGVEGRHVLVRSDFNVPLNDDREITDAGRITASLPTIKALVDNGARVILMAHLGRPKGEVNEKFSLAPVAEALSEALGQYVALAGDVVGEDAHERANGLNDGDVLLLENVRFDPRETSKEEAERGEFADQLVALTAENGAFVSDGFGVVHRAQASVFDVAQRLPHYAGTLVEKELEVLGNKVASAPERPYAVILGGAKVSDKLGVIEALATKADKLIIGGGMCYTFLAAKGINVQKSLLQEEQINKCKELLEAYADKIVLPVDLVAAAEFASDAENKIVAIDEIPEGWMSLDVGPKTVEKFAEVLATSKTVFWNGPMGVFEFENFSAGTRGVAEAIIAATANGAFSVVGGGDSAAAVRLLGLDEDGFSHISTGGGASLELLEGKNLPGVSVLES

SEQ ID NO: 19893 - protein, 203 aa, Candida glabrata CBS 138
MSRNVDKSQTVLALYQEHKAESRRDYNRYKRPRVESVRDPAEAREWYKQTLREVGECTNRLYDPLLSEEQVRECNARVNQLIQESQRWSRHLRRFKQRQRPPVYGGVVVNGVRYIGRARELPEARKRPTAARQFTVKRAKYVDFSDNGDFSDNGDYRGTSERLRKAHGIAQQESVLVEPPTQQQMEEYLVERRKRQLLHQLNL

SEQ ID NO: 19894 - protein, 334 aa, Corynebacterium diphtheriae NCTC 13129
MTIRVGINGFGRIGRNFYRAITERGADIEVVAINDLTDNHTLSHLLKYDSILGRLGKEVSYDDESITVDGHRMVVTAERDPKNLKWGELNVDIVVESTGFFTDANAAKAHIEAGAKKVIISAPAKNEDATFVVGVNHTDYDPAKHNIISNASCTTNCLAPMAKVLDEKFGIVKGLMTTIHAYTGDQRLHDAPHRDLRRARAAAQNIVPTSTGAAKAVALVLPELKGKLDGFAMRVPVITGSATDLTFETTKEVSAEEINAAMKEAAEGELKGVLAYTEDPIVSTDIVTDAHASIFDAGLTKVIGNQVKVVSWYDNEWGYSNQLVSLTEYVGERL

SEQ ID NO: 19895 - protein, 265 aa, Coccidioides immitis RS
MGIEDAVYLAKLAEQAERYEEMVQNMKVVASADKELSVEERNLLSVAYKNVIGARRASWRIVTSIEQKEESKGNEAQVTLIKEYRQKIESELAEICEDILDVLDKHLIPSAQSGESKVFYHKMKGDYHRYLAEFALGDRRKKSADNSLEAYKNATEVAQTDLAPTHPIRLGLALNFSVFYYEILNSPDQACHLAKQAFDDAIAELDTLSEESYKDSTLIMQLLRDNLTLWTSSEAEPAPESAAAPPAPAEQPKEGAPAEEPKAAE

SEQ ID NO: 19896 - protein, 455 aa, Kluyveromyces lactis NRRL Y-1140
MMMKWTHHRPNTGVSMSQPKIFRKKRQESRYHGGSQSRYQPNRPNNHHNTAGNVNVNRSLGKRNPRGKFNRPSNGPETSGSRFEGHGSIPRGPRAMGSSAESAGDSHSRNIFGKKPLALISFQDVKSSFQPLAQVGEGTYGKVYKAENVHTGKLIALKRLRLEQERDGFPITSIREIKLLQQLNHPNISLIHEIIVSDKNTISMGFQYMENDLSGMLMDKSIQFSDSNIKHLMKQLFVGLQYLHQQQIVHRDIKGSNLLIDNRGNLKITDFGLAKKLTDVSSPASNTNRVITLWYRPPELLLGATDYKYEVDCWGCGCLLVELFAGAAIFPGSNEVDQFQRILSIMGSPTLEQWPKMLDMPWWFMLVPQISKTYKNVFFDEFSKVPQDALDLASKLLRYDQDTRFTTTEALQHHYFTNEPKPQPLLLGPEFKGSHEYEVKKIRRKERERQKETTV

SEQ ID NO: 19897 - protein, 325 aa, Gibberella zeae PH-1
MENYQKLEKIGEGTYGVVYKARDLANGGRIVALKKIRLEAEDEGVPSTAIREISLLKEMRDPNIVRLFNIVHSDGHKLYLVFEFLDLDLKKYMESLPISDGGRGKALPEGSSPHLQHLGLGDTVVRKFMYQLCDGVKYCHSHRVLHRDLKPQNLLIDKDGNLKLADFGLARAFGVPLRTYTHEVVTLWYRAPEILLGGRQYSTGVDMWSVGCIFAEMCTRKPLFPGDSEIDEIFKIFRTLGTPSEDNWPGVTSYPDFKASFPKWQRDYSKSLCSTLDDHGLELLEMMLVYDPAGRISAKGAFNHPYFEPHLAQKQASAQTNGYYH

SEQ ID NO: 19898 - protein, 593 aa, Saccharomyces castellii
MPRNVIQPNKEKTVDYSSTEYLPNELESPSFNLDATEESRSGLVHRFVDSFKRAQDSTENDLEDGTKPLGDASHLKKAMKSRHVIMMCVGTGIGTGLLVANASGLSYGGPGSLVIGYVLVSFVTYFMIQAAGEMAVAYPTLPGNFNSYTSMFISKPFGFATVWLFFIQWLTVFPLELITASLTIKYWNDKINADVFIVIFYVFLLFIHFFGVKAYGEAEFIFNSCKVLMIAGFIILSIVINCGGAGKDGYIGAKYWRDPGSFAEGDSVEKFKGICYILVTAYFSYGGAELFSLSVNEQENPRKSTPQAAKQSIYRILIIYLLTMILIGFNVPHNNDQLMGSGGSATHASPYVLAASIHGVKVVPHFINAVILISVISVANSALYASPRLMCSLAEQGYAPKFLDYVDREGRPLRALILCAVFGVIGFVSASSKEEEVFTWLAAIAGLSELFTWSGIMLSHVRFRQCMKLHGRSEEEIGFRAVTGIWGSMYGISFNMLVFIAQFWVALAPPSLHGKVDAESFFQSYLAAPIWLFFYFGYMLYKRDFTFLVPLDKIDLNFHRRIYDPELIRQEDEENKEKIKNSSVWVRMFHFWC

SEQ ID NO: 19899 - protein, 194 aa, Zea mays
  misc_feature (161)..(161): Xaa can be any naturally occurring amino acid
  misc_feature (164)..(164): Xaa can be any naturally occurring amino acid
  unsure (1)..(194): unsure at all Xaa locations
MQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEEVLQAMQLMTENRVRHIPVIDGTXMLXMVSIGDVLRAVVAEHREELNRLHDYIQGSY

SEQ ID NO: 19900 - protein, 359 aa, Mesembryanthemum crystallinum
MGAEAEIVCPKSVPNLDTVLSCSQLDIMTPDAVSDNSLASTMLQFVPNIRSGSFADIGPRKYMEDEHIRIDDLSVQLGSLFRCPKPSAFYGVFDGHGGSEAAAYVRENVMRFFFEDVSFPEASELDEIFLEGVENCLRRAFFLADLALADDCSISTSSGTTALTALVLGRLLLVANAGDCRAVLCRKGEAIDMSQDHRPTYPSEKRRVEELGGYVDDGYLNGVLSVSRALGDWDMKLPKGSASPLISEPELRQIILTEDDEFLIIGCDGIWDVISSQQAVSIVRWGLKRHDDPEQSAKDLVNEALRRHTIDNLTVIIVCFSSIDHQREQTGPRPRRFRCSLSAEALSSLRSLLEGNESH

SEQ ID NO: 19901 - protein, 141 aa, Ehrlichia canis str. Jake
MLERTLSILKPDVVKRNITGQVNSYIENSGLKIVTQKMCLLTRFQAEEFYAIHKSQHFFIPLVDFMVSGPIIVQVLEGENAISLYRELMGATDPKKANPGTIRGDFAENIDANCVHGSDSLDNAVREIRFFFSDYELLSLK

SEQ ID NO: 19902 - protein, 864 aa, Zea mays
MLSGIIDGLTGANKHARLKGTVVLMRKNVLDLNDFGATVVDSISEFLGKGVTCQLISSTLVDANNGNRGRVGAEANLEQWLTSLPSLTTGESKFGVTFDWEVEKLGVPGAVVVKNNHAAEFFLKTITLDDVPGRGAVTFVANSWVYPAGKYRYNRVFFSNDTYLPSQMPAALKPYRDDELRNLRGDDQQGPYQEHDRVYRYDVYNDLGEPDGGNPRPILGGSADHPYPRRCRTGRKPTKTDPNSESRLSLVEQIYVPRDERFGHLKMSDFLGYSIKAITQGIIPAVRTYVDTTPGEFDSFQDIINLYEGGIKLPKIQALEDMRKLFPLQLVKDLLPAGGDYLLKLPIPQIIQEDKNAWRTDEEFAREVLAGVNPMVITRLTEFPPKSTLDPSKYGDHTSTITAEHIEKNLEGLTVQQALDGNRLYILDHHDRFMPFLIDVNNLEGNFIYATRTLFFLRGDGRLAPLAIELSEPYIDGDLTVAKSKVYTPASSGVEAWVWQLAKAYVAVNDSGWHQLVSHWLNTHAVMEPFVIATNRQLSVTHPVHKLLSSHFRDTMTINALARQTLINGGGIFEMTVFPGKYALGMSSVVYKSWNFTEQGLPADLVKRGVAVADPSSPYKVRLLIEDYPYASDGLAIWHAIEQWVGEYLAIYYPDDGALRGDEELQAWWKEVREVGHGDHKDAPWWPKMQAVSELASACTTIIWIASALHAAVNFGQYPYAGYLPNRPTVSRRRMPEPGSKEYEELERDPERGFIHTITSQIQTIIGISLIEILSKHSSDEVYLGQRDTPEWTSDARALAAFKRFSDALVKIEGKVVGENRDPQLRNRNGPAEFPYMLLYPNTSDHSGAAAGLTAKGIPNSISI

SEQ ID NO: 19903 - protein, 149 aa, Methanosarcina acetivorans
MEQTYVMVKPDGVQRGLVGEVISRIEKRGLKILALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIGKYSRVDEVCLYE

SEQ ID NO: 19904 - protein, 133 aa, Methanococcus maripaludis
MERTFVALKPDTVERKLVGRVIQRFEDRGFEIVEMRMLTLTMEMAEEYYGEHKGKEFYERLIKFMTSGRIVAMVIKGERAISTVRKMLGNTCPCDAEPGTIRGDFGLYTPANIIHASDSLESAEREIDLFFGR

SEQ ID NO: 19905 - protein, 150 aa, Methanothermobacter thermautotrophicus str. Delta H
MEKSFVMLKPDAVKRRLAGRIIARFEDRGLKIVAFKMLQIPEDLAMEHYQEHREKPFFRDLVDYITSAPVIAMVIEGKDCISLIRKMVGATNPAEADLGTIRGDFALETGRNIIHASDSPESAEREIKLFFDESEICSYEMPDREMIYEE

SEQ ID NO: 19906 - protein, 138 aa, Picrophilus torridus
MERCLILVKPDGVERNLIGEVISRFERKGLAIKALKMMRVTREQAEDHYSVHRLKPFFDDLVSYLTSGPIVAMIVEGNNAIASSRMLAGATDGSKAAPGTIRGDFSLDIERNIVHASDSLESYEHEYKIFFNENEIMD

SEQ ID NO: 19907 - protein, 137 aa, Streptococcus thermophilus CNRZ1066
MQKTFFIIKPDAVKRHLIGQVLDRIERRGFVIERMEMLMLDEERLKEHYAQLADKPFFPSISEFMMSGPAVIGIMSGPGVIKSWRDMMGATNPGDAAPGTIRGDFATAPDGDMIPNIVHGSDSEESAAREIKIWFGE

SEQ ID NO: 19908 - protein, 924 aa, Oceanicola granulosus HTCC2516
MSETISFTLDGRAVDAAPGETIWQVAKRVGTTIPHLCHKDAPGYRSDGNCRACMVAVDGERNLVASCIRTPVEGMTVTTDGAREVQTRKLVMELLLADQPEQPAAHDRSAHLWEMADAQGLAESRFPAMDADHVPLLDDSHVAMRVNLDACIQCGLCVRACREVQVNDVIGMAGRGHQAFPVFDLDDPMGDSTCVACGECVQACPTGALMPASVLNEVQEGDSQDYDREVESVCPFCGVGCQVSLKVKDDRIVYVDGIDGPANEGRLCVKGRFGFDYVHHPHRLTKPLIRRDDAPAKGLNVDPANPLSHFREASWEEALDAAAGGLARLRETRGGAAVAGFGSAKCTNEEAYLFQKLIRQGFGHNNVDHCTRLCHASSVAALMENVGSGAVTATFNQIEHADVAIIIGANPVENHPVAATYFKQFAKRGGKLIVMDPRGVGLRKFASHMLQFRPGADVSLLNAIMHVIVDEGLYDEQYIQAYTENWEAEKAHLAGFAPEDMAGICGIDAEVIRDVARTFATAERGMIFWGMGVSQHIHGTDNSRCLISLALMCGHVGRPGTGLHPLRGQNNVQGASDAGLIPMFLPDYQPVGDDGVRSAFAEIWGGAEFSAEKGLTVTEIMDAVHDDRIAGMYILGENPAMSDPDVDHARAALAKLEHLVVQDIFLTETANYADVILPASAFAEKTGTVTNTNRQVQMGRPALPPPGEAREDWAITVDLARRLGLDWSYSHPSEVFDEMARTMKSLANITWERLEGEAVTYPSLSPDDPGQPIVFGDGFPRAGGRAKFTPAAVIPPDETPDAEYPMILTTGRQLEHWHTGSMTRRSKVLDAVEPEANCSLHPSTLRKLGVAAGEMVRLTTRRGSIELMAREDRAVAPDMVFVPFAYVEAAANVLTNPAIDPYGKIPEFKFAAVRIEKGSALAAE

SEQ ID NO: 19909 - protein, 298 aa, Vicia faba
DIQPLVCDNGTGMVKAGFAGDDAPRAVFPSIVGRPRHTGVMVGMGQKDAYVGDEAQSKRGILTLKYPIEHGIVSNWDDMEKTWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDGLMKILTERGYTFTTSAEREIVRDMKEKLAYIALDYEQELETAKTSSAVEKTYELPDGQVITIGAERFRCPEVLFQPSMIGMESPGIHETTFNSIMKCDVDIRKDLYGNILLSG

SEQ ID NO: 19910 - protein, 489 aa, Desulfitobacterium hafniense DCB-2
MNTIHTPKTKRVLTYNREYFYVTSVTLIGTEDGKLKQRRLGGKLNMTYVQEVLEQAVKRNPGEAEFHQALREVLESLEPVLEKRPDLKEAGILERIVEPERQILFRVPWVDDQGKVQVNRGFRVEYNSAIGPYKGGLRFHPSVYLGIIKFLGFEQIFKNSLTGLPIGGGKGGSDFDPKGKSEGEIMRFCQSFITELYRYLGADTDVPAGDIGVGGREVGYMFGQYKRITNRYEGVLTGKGLTFGGSLGRTEATGYGLVYFMEEALKAVGKSFSGATVVVSGSGNVAIYATQKATQLGGTVVAMSDSNGYIYDKDGINLDTVRQLKEVERKRLKDYVSIHPTAEYYEGCAGIWTIPCAIALPCATQNELDGEAAEVLVKNGCYAVGEGANMPSTPEAVDVFLQHKIIYGPGKAANAGGVAVSALEMSQNSMRYSWTFEEVDAKLKNIMVNIYHNASKAAQEFGFEGNLVAGANIAGFLKVAEAMKAQGTV

SEQ ID NO: 19911 - protein, 537 aa, Glycine max
MAALNLCRMALRSSKLLSRPYHRLSVQLQMQMQPSSPPLTRKMSMDAQSVASQLNSSGLLRTQGLIGGKWSDAYDGKTIKVYNPATGESIVDVACMGGRETNDAISAAYDAYGSWSKTTAAERSKLLRKWYDLLMVHKEELAQLITLEQGKPLKESVGEIVYGAGFIEFAAEEAKRIYGDIVPAPFSDRRLFVLKQPVGVVGAITPWNFPLAMITRKVGPALACGCTVVIKPSELTPLTALAAVELSIQAGIPPGVVNVVMGNAPDIGDALLASPQVRKITFTGSTAVGKKLMAGSAETVKKVSLELGGNAPCIVFDDADLDVAVKGTLAAKFRNSGQTCVCANRIIVQEGIYEKFANALRDAVQNMKVGDGFSEGVSQGPLINEAAVKKVESLIHDATSKGAKVILGGKRHSLGLTFYEPTVISDVNSDMHISREEAFGPVAPLLRFKTEEEAIRIANDTNAGLGSYVFTNSIQRSWRVAEALEYGLVGVNEGVISTEVAPFGGFKQSGLGREGSKYGMDEYLEIKYVCFGNMNKE

SEQ ID NO: 19912 - protein, 298 aa, Phaseolus acutifolius
DIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDFLMKILTERGYSFTTSAEREIVRDVKEKLAYIALDYEQELETARTSSSVEKSYELPDGQVITIGDERFRCPEVLFQPSMIGMEAAGIHETTYNSIMKCDVDIRKDLYGNIVLSG

SEQ ID NO: 19913 - protein, 514 aa, Triticum aestivum
MANLVQELMLETPPRAWFLFLLPLLLLSLHNWFTRKTGSTGQRLPPSPPALPIIGHLHLVGALPHVSLRDLARKHGPDVMLLRLGAVPTLVVSSPRAAEAVLRTHDHVLASRPRSVVSDVIMYGSSDIAFAPYGEYWRQARKLVTTHMLSVKKVQSFRSAAAEEVSMAMAKINEAATASGTVDMSELLNSFSNDMACRIVSGKFFLKDGRSKLFRELINDTSRLLGGFNLEEYFPALGRVGVLKRAVCAKAERVRNRWADLLDKVIDDRVSKRKSASDHKDGDFVDILLSVQQEYDLTREHMKALLTDVFFGATDTSANVLEFTLAELMRRPHFMRKLQDEVRSIIPRGQEIVNEADMNNMVYLRAVIKESLRLYPVAPLLAPHLAMADCTIHGYMVPAGTRVVVNAWAVGRDSSSWEDAEEFIPERFTDEGNATNVNFKGNDFQFLPFGAGRRICPGINLGIANVELMLANLMNHFDWELPVGVERKDIDMTEVFGLTVRRKEKLLLIPKSCM

SEQ ID NO: 19914 - protein, 360 aa, Hypocrea virens
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVAARWYRAPEIMLTFKEYTKAIDVWSVGCILAEMLSGKPLFPGKDLTFPDHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 19915 - protein, 143 aa, Rickettsia akari str. Hartford
MSLTLKYFFKPKVTINYPYEKSHVSPRFKGEHALRRYESGEERCIACKLCEAICPAQAIVIEADEREDGSRRTTRYDIDMTKCIYCGLCQEACPVDAIVEGPNFEFASLTHAALIYDKERLLQNGDRWEQALASKLHKDYEYR

SEQ ID NO: 19916 - protein, 233 aa, Arabidopsis thaliana
MTLESYAGDVHTVPQSENSMEERGGGELFVPPLNFAMVDNGIFRSGFPEPVSFSFLQSLRLKSIIYLCPEAYPEVNREFAKSNGIQVFQFGIERCKVRLVEPFVNIPDEVIREALQHRTGCLVGCVRKIQRWCLSSIFDEYQRFAAAKARISDQRFMELFDISNLKHTPLSFSCSKRGVNNDSVCCVCMGRKKGAAFIPCGHTFCRVCSREVWLNRGSCPLCNRPIIEILDIY

SEQ ID NO: 19917 - protein, 228 aa, Oryza sativa (japonica cultivar-group)
MSAHYAFGPQEDDAIIKHRLLTRTTTTRGEPPLKKLQKKFMSFATEVEKDADNISDCERLYKAFLQEINTFELPLLKSKAVVDANLREKESFNELQDEIQRQILQAQTDIEDLKKQLEQSKIERQHKEECEAIRKMISLQPPRSETEKLIADLEKEIANLEAENTACIRTLELRKKQFALLLHVVEELQISIDDEQRSIADELRAATEEQKMSIEEVSGGASDAMAVD

SEQ ID NO: 19918 - protein, 401 aa, Mesembryanthemum crystallinum
MALLNQQLQRFLLTRTDYNYAFRINKKNHIILKERNRSSPSSSTSSSSSFHCSAIAIEAPSSLAGVAGIRWGLTKLQGAREEMEDDAFIVQPDNTLDGFSFAAVLDGHAGFSTVKFLRDELYKECVAALQGGLLLREKDLKAVKTALIEAFHNVDSRLANLLETTEEVDESGATATAMFVGSDMLYVAHVGDSSVVLSRTGKAEVLTEPHRPYGRNKASLQEIKRIREAGGWIVNGRICGDIAVSRAFGDIRYKTKKNEMLEEGVKEGRWSQKFASRVKFNGNVVVARPDVFQVALGSDMEFVLLASDGLWDYINSSEAVSFVRDQLRQHGNTQLACESLAKAALDRRSQDNISIIIADLGQTNWQSLPVEKQNVLYEIGQALATVSFVSLGIWLSSLLML

SEQ ID NO: 19919 - protein, 216 aa, Bacillus anthracis str. Ames
MTNNNQIGENKEQTIFDHKGNVIKTEDREIQIISKFEEPLIVVLGNVLSDEECDELIELSKSKLARSKVGSSRDVNDIRTSSGAFLDDNELTAKIEKRISSIMNVPASHGEGLHILNYEVDQQYKAHYDYFAEHSRSAANNRISTLVMYLNDVEEGGETFFPKLNLSVHPRKGMAVYFEYFYQDQSLNELTLHGGAPVTKGEKWIATQWVRRGTYK

SEQ ID NO: 19920 - protein, 147 aa, Sulfolobus tokodaii
MSIQRTFVMIKPDGVRRNLIGEIISRFEKRGLKIIGLKMVKIDRPTAERLYEEHKGKSFFEELISYITSGPVVCMVIEGDEAVSVVRKMIGNTDPKEAPPGTIRGDYALSKAENVIHASDSEEKAKREMSIFFKEEELVTPLAQVHM

SEQ ID NO: 19921 - protein, 149 aa, Synechococcus elongatus PCC 6301
MERTFIAIKPDGVQRGLVGTIIGRFEQKGFKLVGLKQLKPSRELAEQHYAVHRERPFFNGLVEFITSGPIVAIVLEGEGVVAAARKLIGATNPLTAEPGTIRGDFGVNIGRNIIHGSDAIETAQQEIALWFSPAELSDWTPTIQPWLYE

SEQ ID NO: 19922 - protein, 345 aa, Oceanicola granulosus HTCC2516
MHLWLRAEARATERRTPLLPEGAARLIAGGVQVSVERSATRVIADAAYAAVGCTLAPPGSWASAPVEAVILGLKELPESDAPLIHRHIFFAHAYKGQPGADALLDRFRRGGGTLLDLEYLVDADGRRVAAFGYWAGYVGAAVSLLAYAAQDGQLGPVAPWADAAAMRAEVTAALGEARPATLVIGARGRVGTGAADLVTRDLGLPVTRWDMEETAGGGPFPQIAEHELLVNAVLALPGVPVFAGSELLHAPRRLRVIGDVACDPGTPYNPIPLYDAATGWDAPALRVHDTPPLDIMAIDNLPSLLPAEASTEFAADLLEHLLQLPRGGGVWARAEATFRKHLGAV

SEQ ID NO: 19923 - protein, 464 aa, Triticum aestivum
  misc_feature (382)..(382): Xaa can be any naturally occurring amino acid
  unsure (1)..(464): unsure at all Xaa locations
PRVRSCLFENSYGVEATDEGRAKVFGKEFAAWARPECGDESIWEDASDAFSPGPKGSPMPARSPMLRPLMEDFREFEEPVEEGDGSIQSLALGALDNSFLVGDSGIHVVKNFEHGIHGEGVSVKISGGGTNFTTPKKALLMRAETNMLLMSPATDGKPHAKGVHQLDIETGKVVSQWKFGKDGADINMRDITNDSKGAQMDASESTFLGLDDNRLCRWDMRDRHGIVQNLASSMESPVLEWTQGHQFSRGTNFQCFASTGDGSIVVGSLDGKIRLYSKSSMRMAKTAFPGLGSPITHVDVTYDGKWILGTTDTYLVLICTIFIDKDGKEKTGFGGRMGNRIAAPRLLKLSPLHSHLAGDNSKFREGRFSWVTDNGKQERHLXVTTVGRYSVVWNFLQVKNSHHECYQNQEGLKSCYCYKVIPKDESIVASRFMHEKYDLSDCPEAPLVVATPMKVTSFSVASQR

SEQ ID NO: 19924 - protein, 774 aa, Candida glabrata CBS 138
MASDSFDIDRHSTDDPETAAKYIDISKFNNIDETQSFDKFITIDRVADNRNVILLPNAEREFFNKKYNGYINWLWNRGKIFITLTAIAITIGCLAGFIQVFTETLVNWKTGYCTSNWLLNKSFCCSDVVDEEMATRGLRLVRRDEGACVAQGVWTNWSGKYSSFILFVSLSLLFGTISACLIRYVAPIATGSGISEIKVWVSGFEYQQEFLNVLTLIVKSVALPLTISSGLSIGKEGPSVHYAACCGFVVANYFLKDKIGFTSLSQYLTAASGAGVAVAFGAPIGGVLFGLEEIASGASFNSSTLWKSYYIALVAITTLKLINPFRNGKVVLFHVTYDRDWSTQEVPIFVLLGIFGGLYGIYVSTMNIRYVHFRKKFLSKWPIQEVVILVLFTSVISYFNEFLKLDMTEGMGILFHECQKNDNSSPFAHRLCQIDENTHVMDFIKQLLSLIIATIIRIHFTIVSYGAKVPAGIFVPSMAIGATFGRAVSLIAERFFFAPNSITPGAYAFLGAAATLCGITNLTLTVVVIMFELTGAFIYIIPTMIVVAMARIVLASFGFHGGIADQMVEVNGFPFLEESDKESFMYEFNANQIMSKDLAVLPEKLTVSELHHTVFENDKLYSGYPIVRSADLHENDKVCIGYILRRHILKKLEVIDTEETANDQREINLMEFPGSDFSRAAYQFGDIVDKYPPIVKGTIPVEQLFDTFRQMKCKIIMVEECGILQGVITRKDILRFSRGLSRELEGPKYAYDEHLNERYFAFIQKVSSLFGAKI

SEQ ID NO: 19925 - protein, 566 aa, Zea mays
  misc_feature (497)..(497): Xaa can be any naturally occurring amino acid
  misc_feature (513)..(513): Xaa can be any naturally occurring amino acid
  unsure (1)..(566): unsure at all Xaa locations
MALRDVLLSIAQTPHRLRRRALVTWTPTQELNEVRDRSGARMKRRLEWYDLVGLGVGGMLGAGVFVTTGRVARDTAGPAVFASYVVAGVSALLSSLCYAEFSVRVPVAGGAFSYLRVTFASYILSGEFVGFFGGANILMEYVLSNAAVARSFTDYLASTFGVTERNAWRIVVDGIADGYNELDVPAVALILLITVCLCYSTKESSMLNMVLTVFHLLFFAFIVAAGLWNGSARNLVRPHGLAPYGVRGVLDGAAVVYFSYIGYDSACTMAEEIRDPSRALPVGIAGSVLVVSGLYCLMSVALCVMLPYTEISEAAPFSSAFREKVGWRWASSVVGAGASIGIVASLMVAMLGQARYLCVIARARLVPLWFAKVHPSTGTPMNATIFLGFCTASLALFTELQIVFEMISIGTLLVFYLVANALIYHRYVKVGTNRPLHVLLFLLLLTLSSLGFSLSRKIDGWCQWGMTLFGAVSIAITTIFHCTARQDIAGPSLEWSXPLMPWPAAASVFLNVXLITTLKVRSYQRFGIWSLVTIVFYVCYGVHSTYSAEENEIVNAMIHHANLDIS

SEQ ID NO: 19926 - protein, 329 aa, Fritillaria agrestis
MASSLQAAATLIPAKVGAPARTHLRSNSHLSKAFGFDNSTAGRLTCSINSDLRDIAQKCTDAAKLAGFALATSALVISGASAEGVPKRLTFDEIQSKTYMEVKGSGTANQCPTIEGGTESFGYKTGKYTLKKLCLEPTSFTVKAEGINKNAPPEFQKTKLMTRLTYTLDEIEGPFEVAPDGTVKFEEKDGIDYAAVTVQLPGGERVPFLFTVKQLVATGKPESFSGSYLVPSYRGSSFLDPKGRGGSAGYDNAVALPAGGRGDEEELVKENIKDVSSSTGKITLSVTKSKPETGEVIGVFESIQPSDTDLGSKAPKDVKIQGIWYAQLE

SEQ ID NO: 19927 - protein, 459 aa, Rickettsia akari str. Hartford
MEQYDVAVIGGGPSGYVAAIRAAQLRKKVVLIEKEHLGGVCLNWGCIPTKSLLKSAEVFEYTKHAKDYGIDSEGAEINIKKIVERSREISNKLAGGVKLLLKKNKVTVIDGVASLAGNKVVNINNKSTVKAENIIIATGARSRVLKGFEPDSKQIWTSKEAMIPRHVPKSMIIVGSGAIGIEFASFYNSIGVDVTVIEAHNRILPAEDTEISGIAHKNFEKKGIKIITNAKLIKQTKSKDKIEVELELSSKTQKLQAEILLMAVGITANTESLGLEKTKVKVENGYIVTNGLMQTAELGIYAIGDVAGVPCLAHKASHEGIIAAESIAGLKPYAINKHNIPGCTYSSPQIASVGLTEEAAKALGYELKIGKFPFMANGKALVIGDSDGLIKTIFDAKTGELLGAHMIGLEVTELIQGYVVSKNLEATELDLINTIFPHPTLSEMMHESVLAAYDRVVHV

SEQ ID NO: 19928 - protein, 1107 aa, Synechococcus sp. RS9917
MPRRSDLRRILLLGSGPIVIGQACEFDYSGTQACKALRADGFEVVLVNSNPASIMTDPDMADRTYVEPLTPEVVTRVIEQERPDALLPTMGGQTALNLAVALSENGTLERYGVELIGADLQAIQKAEDRLLFKQAMERIGVKVCPSGIASSLEEADAVGAAIGSFPRIIRPAFTLGGSGGGIAYNPEDYAAICKSGLDASPVSQILIEQSLLGWKEFELEVMRDLADNVVIVCSIENLDPMGVHTGDSITVAPAQTLTDREYQRLRDQAIAIIREIGVATGGSNIQFAINPVDGDVVVIEMNPRVSRSSALASKATGFPIAKIAARLAVGYTLDEILNDITGKTPACFEPTIDYVVTKIPRFAFEKFKGSPAILTTAMKSVGEAMAIGRCFEESFQKALRSLETGLSGWGCDRDEAVWSKTDLERALRTPSPDRILAVRAAMLAGRSDGEIHELSRIDPWFLAKLRQLISAEQRLLQGQQLKQLSAEALLELKQLGYSDRQIAFAVGSDELAVRSQRDRLGVRPVFKTVDTCAAEFASTTPYHYSTYERPVQRLNAEGHLETLAPESEVQPEERAKVMILGGGPNRIGQGIEFDYCCCHASFAAQERGFATVMVNSNPETVSTDYDTSDRLYFEPLTLEDVLNVIETERPEGVIVQFGGQTPLKLALPLLRWLETEPGLKTGTRILGTSPESIDRAEDREQFEAILRQLDIRQPRNGLARSEAEAREVAAAVGYPVVVRPSYVLGGRAMEVVFDQEELDRYMAEAVQVEPDHPVLIDQYLENATEVDVDALCDASGTVVIGGLMEHIEPAGIHSGDSACCLPAVSLGAEALATIRRWSKALALALKVQGLINLQFAVQRDTSGKEVVYIIEANPRASRTVPFVAKATGQPLARIATRLMTGESLEQVGLLSEPVPPLQAVKEAVLPFRRFPGADSLLGPEMRSTGEVMGSAADFGMAYAKAELGAGDGLPTRGTVFLSTHDRDKPALVPIASRLIDLGFQIIATAGTSTVLADAGLAVTPVLKVHEGRPNIEDLIRSGSVQLVINTPIGRQAAHDDRYIRRAALDYNVPTVTTLAAARAAVEGIDALQHQQLEIHALQDVHASPAAR

SEQ ID NO: 19929 - protein, 404 aa, Staphylococcus aureus
  misc_feature (1)..(1): Xaa can be any naturally occurring amino acid
  misc_feature (21)..(21): Xaa can be any naturally occurring amino acid
  misc_feature (38)..(38): Xaa can be any naturally occurring amino acid
  misc_feature (52)..(52): Xaa can be any naturally occurring amino acid
  misc_feature (257)..(257): Xaa can be any naturally occurring amino acid
  misc_feature (271)..(271): Xaa can be any naturally occurring amino acid
  misc_feature (286)..(286): Xaa can be any naturally occurring amino acid
  misc_feature (322)..(322): Xaa can be any naturally occurring amino acid
  unsure (1)..(404): unsure at all Xaa locations
XGSSHHHHHHSSGLVPRGSHXISNKLANIPDSYFGKTXGRKIEHGPLPLINXAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSKVDSQIIDKTKLIYLTYPNNPTGSTATKEVFDEAIAKFKGTDTKIVHDFAYGAFGFDAKNPSILASENGKDVAIEIYSLSKGYNXSGFRVGFAVGNKDXIQALKKYQTHTNAGXFGALQDAAIYALNHYDDFLEEQSNVFKTRRDRFEAXLAKADLPFVHAKGGIYVWLETPPGYDSEQFEQFLVQEKSILVAPGKPFGENGNRYVRISLALDDQKLDEAAIRLTELAYLYE

SEQ ID NO: 19930 - protein, 195 aa, Roseovarius nubinhibens ISM
MRRATITRKTAETDISVEINLDGTGRYDNETGVGFFDHMLDQLARHSLIDMTLRCTGDLHIDDHHTVEDVGIALGQALAEALGDKRGIRRYGACLLPMDDALVRTALDLSGRPFLVWNLDLPTQKIGTFDTELVREFFQALSTHGGITLHVDMLHGVNSHHIAEAAFKSVARALRDAVDTDPRKSDAIPSTKGAL

SEQ ID NO: 19931 - protein, 428 aa, Oryza sativa (japonica cultivar-group)
MAGDHSSPFPPPSSTRRRRPQERDEERGEGERGSRRGGGRHLHGYTTTPTEEEQEREKSPMAHARSTGSLPVANVQALAETCNDPDQQIPERYIRADANADEVISGDDCTAAIPTVDLSKLLDPLSSDEETEKLGSACQQWGFFQLINHGVSEDVIRDARKDIAEFFRLPMETKKAYSQLPSGIEGYGQAFVVSHEQKLDWADMFYLVLRPGESRNMALWPAHPPSFRNSIDRYSSETARVARCLLEFMAKDMGVRPGSLLERFQDQPQGIRMNDYPPCREAGKVVGLSPHTDAACLTLLLQVNDVPGLQIRSPGGRWLAVGAPPDDGAFIVNVGDILEIMSNGKYRSVEHRAVVRPDRERVSAAVFHQPCQDAVVGPLPELVGEGGGDNARYTSMGYLDFMKRYYSAKLDGRNHLDGLRIKLSSSKG

SEQ ID NO: 19932 - protein, 351 aa, Glycine max
MTTRVQSLAQSGLSRVPPQYIQPPQTRPVRHTAPEPDSIPVIDLSSFDPTQRASTRDSIARACRQWGAFHVTNHGVPPSLLASLRRAGLSFFSDTPIPDKLRYSCSAAASEGYGSKMLATTTSDQNDAVQVLDWRDYFDHHTLPLSRRNPNRWPEFPADYRELVATYSDEMKILAQKLLALISESLGLRASCIEDAVGEFYQNITISYYPPCPEPDLTLGLQSHSDMGAITLLIQDDVGGLQVLKGGNKWVTVQPLSDAILVLLADQTEIITNGKYRSCEHRAITNPDRARLSVATFHDPAKTVKISPASELINDSSLAKYRDVVYGDYVSSWYTKGPGGKRNIDALLLDP

SEQ ID NO: 19933 - protein, 719 aa, Streptococcus agalactiae A909
MVRHGDHFHYIPKASLSQQKQVQASRAVSRLGNQSNSHYRVNSSKIAGLHYPTSNGFLFNGRGIKGTTPTGILVEHHNHLHFISFADLRKGGWGSIADRYQPQKKADSKKQSPSSKKPRTENTLPKDIKDKLAYLARELHLDISRIRVLKTLNGEIGFEYPHDDHTHVIMAKDIDLSKPIPNPHHDDEDHHKGHHHDESDHKHEEHEHTKSNKLSDEDQKKLIYLAEKLGLNPNQIEVLTSEDGSIIFKYPHDDHSHTIASKDIEIGKPIPDGHHDHSHAKDKVGMATLKQIGFDDEIIQDILHADAPTPFPSNETNPEKMRQWLATVTKINIGQRTNPFQRFGLSLMPNIEVLGIGFTPINDMTPVLQFKKLKQLWMTNTGITDYSFLDKMPLLEGLDISQNGIKDLSFLTKYKQLSLIAAANNGITSLKPLAELPNLQFLVLSHNNISDLTPLSNLTKLQELHLDHNNVKNLSALSGKKDLKVLDLSNNKSADLSTLKTTSLETLLLNETNTSNLSFLKQNPKVSNLTINNAKLASLDGIEESDEIVKVEAEGNQIKSLVLKNKQGLLKFLNVTNNQLTSLEGVNNYTSLETLSVSKNKLESLDIKTPNKTVTNLDFSHNNVPTSQLKLNEKNIPEAVAKNFPAVVEGSMVGNGSLAEKAAMASKEDKQVSDNTNHQKNTEKSAQANADSKKENPKTHDEHHDHEETDHAHVGHHHH

SEQ ID NO: 19934 - protein, 424 aa, Thermus thermophilus
MKSEPLSYLGKDGGPWEIFTEQVDRVVPYLGRLAPLAESLKRPKRVLIVDVPVRLDDGSVAYFEGYRVHHNTARGPAKGGVRYHPEVTLSEVMALAGWMTIKNAAVGLPYGGGKGGIRVDPRKLSPGELERLTRRYTSEIGILLGPDRDIPAPDVNTGEREMAWMMDTYSMNVGRTVPGVVTGKPIALGGSLGRRDATGRGVFITAAAAAEKIGLQVEGARVAIQGFGNVGNAAARAFHDHGARVVAVQDHTGTVYNEAGIDPYDLLRHVQEFGGVRGYPKAEPLPAADFWGLPVEFLVPAALEKQITEQNAWRIRARIVAEGANGPTTPAADDILLEKGVLVVPDVIANAGGVTVSYFEWVQDFNSYFWTEEEINARLERVVRNAFEAVWQVAQEKKIPLRTAAYVVAATRVLEARAPPGLYP

SEQ ID NO: 19935 - protein, 145 aa, Triticum aestivum
  misc_feature (73)..(73): Xaa can be any naturally occurring amino acid
  misc_feature (85)..(85): Xaa can be any naturally occurring amino acid
  misc_feature (99)..(99): Xaa can be any naturally occurring amino acid
  misc_feature (101)..(101): Xaa can be any naturally occurring amino acid
  misc_feature (103)..(103): Xaa can be any naturally occurring amino acid
  misc_feature (112)..(112): Xaa can be any naturally occurring amino acid
  unsure (1)..(145): unsure at all Xaa locations
MAPTVMASSATSVAPFQGLKSTAGLPVSRRSNGASLGSVSNGGRIRCMQVWPIEGIKNSKTLSYLPPLSTGGXLSKQVDYLIRSXKWVPCLEFNKVGFXFXRXAQRTPGYYXGRYWTMLELLCPDERHPGKWRSHKDYLLSRTKC

SEQ ID NO: 19936 - protein, 523 aa, Candida albicans SC5314
MYQHQDQTQHQYYQQYNSYNPSIEDLIASSDDKRYQNGGIGNSLQRPPVAGLPYISSQVNPNTSSANLSKLTNNINNYGYNNNNNSYIQLHTPPLSSNPSFTSFQNLNYPLSPLSKPTSPEPILSAASVTTSNFLASSFFSWLPPIDVKIVSFCIGWYLCSIISSNSTKLILNDFKFPVTLTQFQFSASFTFCLVFLNIVKVNPESISSKLPPGFIPSMTDTNRISLSEFITPTRLIIQTTLPMGMFQFIGHITSHKATSLIPVSIVHTIKSLSPIITVLIYRFLFGKSYRMRTYVTLIPLCCGIMLTCYKKSHTSNQNNVPGAGSSVINNNLDKINTNNNYSTGLIFAFISMIIFVSQNIFAKKRLTVESTNAIPMNNKSSLRINSNKVDKLTILFYCSIIGFILTCPIYFVTEWMNYNAFGAISLLQLNSYVMSLVLLNGLSHFVQSLLAFQILGMVSPINYSIANILKRIFIILISFIWESKQFSNSQSIGLVITLFGLYCYDRWGTVSNSGSASNPGKY

SEQ ID NO: 19937 - protein, 162 aa, Brassica napus
MVVTSFSSTPPIFFSSSPLSSSNLHGRFTIPSSPSSLLNGLRRHQDAKVVGTRVRGGAVRVLANPNASSPPPGRVKAKKEVIMVDPLEAKRLASKQMEEIKGKERQQRRREIEAINGAWAIIGLLIGLVIEAQTGKGILAQLAGYWSAVMHLFTSSTHNLPQ

SEQ ID NO: 19938 - protein, 586 aa, Zea mays
MCGILAVLGVVEVSLAKRSRIIELSRRLRHRGPDWSGLHCHEDCYLAHQRLAIIDPTSGDQPLYNEDKTVVVTVNGEIYNHEELKAKLKTHEFQTGSDCEVIAHLYEEYGEEFVDMLDGMFSFVLLDTRDKSFIAARDAIGICPLYMGWGLDGSVWFSSEMKALSDDCERFITFPPGHLYSSKTGGLRRWYNPPWFSETVPSTPYNALFLREMFEKAVIKRLMTDVPFGVLLSGGLDSSLVASVASRHLNETKVDRQWGNKLHTFCIGLKGSPDLKAAREVADYLSTVHHEFHFTVQEGIDALEEVIYHIETYDVTTIRASTPMFLMSRKIKSLGVKMVISGEGSDEIFGGYLYFHKAPNKKEFLEETCRKIKALHLYDCLRANKATSAWGVEARVPFLDKSFISVAMDIDPEWNMIKRDLGRIEKWVMRKAFDDDEHPYLPKHILYRQKEQFSDGVGYNWIDGLKSFTEQQVTDEMMNNAAQMFPYNTPVNKEAYYYRMIFERLFPQDSARETVPWGPSIACSTPAAIEWVEQWKASNDPSGRFISSHDSAATDHTAVSRRWPTAAARPANGTVNGKDVPVPIAV

SEQ ID NO: 19939 - protein, 505 aa, Helianthus tuberosus
MDLLLIEKTLVALFAAIIGAILISKLRGKKFKLPPGPIPVPIFGNWLQVGDDLNHRNLTDLAKRFGEILLLRMGQRNLVVVSSPELAKEVLHTQGVEFGSRTRNVVFDIFTGKGQDMVFTVYGEHWRKMRRIMTVPFFTNKVVQQYRYGWEAEAAAVVDDVKKNPAAATEGIVIRRRLQLMMYNNMFRIMFDRRFESEDDPLFLKLKALNGERSRLAQSFEYNYGDFIPILRPFLRNYLKLCKEVKDKRIQLFKDYFVDERKKIGSTKKMDNNQLKCAIDHILEAKEKGEINEDNVLYIVENINVAAIETTLWSIEWGIAELVNHPEIQAKLRHELDTKLGPGVQITEPDVQNLPYLQAVVKETLRLRMAIPLLVPHMNLHDAKLGGFDIPAESKILVNAWWLANNPDQWKKPEEFRPERFLEEEAKVEANGNDFRYLPFGVGRRSCPGIILALPILGITIGRLVQNFELLPPPGQSKIDTDEKGGQFSLHILKHSTIVAKPRSF

SEQ ID NO: 19940 - protein, 1122 aa, Synechococcus sp. WH 5701
MTSSGKVRIYELSRDLGLENKDVLDAAEKLSIAVKSHSSSISDGEAERIRSLISTPGNGGGAPAGQPARPTPPASEPAKAILSVKKAAPAAPAPPATPTSPAGSAKPKPAVRPVSSPQKPAAAAPAPAPAAKPVIVKPAPRPEIVAQAPAAATKPAAPTQPPVVRKVVPQAARQAPTTAAPARPAAPLKPTPVSAAPAKPVGAPSRPPAPPVSKPEPPQVRKPDSAAATSPSPRPATSPRPVPRGSAPAPSRPATPQRPGAPAPVRNASGGGSGRPQLVGRPQPGQPGTSNRPAPPSGRPALSQRPAGAPQRPTPQVGRPTQARSPLELVGKPIRRDAAGPGGTSRPGAPVRPGMPQGMRKPVAPGELMQLQKPGSRPIAAPPRRPERSEGSPDAPRPTATPPAAPRRPAFRTPQAAGPGRARRPEWDDSAKLEALRSKSPQKQRQKVHIIGDNDDALTAETGGFAGEHEAMVLQASLARPAKPRTRPTTPGAKPVVAMRKRKKETTRQRQRRRAMELRAAREAKATRPEMLIVPEGNLTVQELADRLGVESSEIIKSLFFKGIIATVTQTLDLSTIETVSDEFGVPVLQDDVEEAAKKTVDMIEASDFDHLIRRPPVVTVMGHVDHGKTSLLDAIRKTRVAAGEAGGITQHIGAYQVTIPHSGEDRRITFLDTPGHEAFTAMRARGTKVTDVAVLVVAADDGVRPQTLEAISHARAAEVPIIVAINKIDKEGAQPERVKQELSALELVSEDWGGTTVMVPVSATKGENIDKLLEMILLVTEVEDLQANPDRMAKGTVIEAHLDKAKGPVATLLIQNGTLKAGDVVAAGPVLGKVRAMVDDSGKRVKTAGPSSAVEALGFSEVPTAGDEFEVYPDEKIARSVVGDRANEARATRLAQQMASRRVSLASMSGQASEGELKELNLILKADVQGSVEAILGSLEQLPQGEVQVRVLLSAPGEITETDVDLAAASGAVIVGFNTSMASGAKRAADANGVDVRDYDVIYKLLEDIQLAMEGLLEPELVEEPLGEAEVRAVFTIGKSAVAGCYVTSGKLQRNCKVRIQRNKQVVFEGDLDSLRRNKDDVKEVATGFECGIGCDRFANWQDGDRVMAYKLVTQRRTLST

SEQ ID NO: 19941 - protein, 152 aa, Glycine max
MAGKLMTLQVSHLLCISLVIFFVFSVNVVSEEDYQRVVPPEDKTTTVWFSTIKQSGNDYWAKLKESLGRGHARFFPPNIDFRGKDDASMGAGGKMKEAVTRSFEHSKDTVEEAARSAAEVACDATEAVKEKVKRSFSGSETTQQQSDELIRR

SEQ ID NO: 19942 - protein, 676 aa, Ralstonia eutropha JMP134
MCGFAGFLGGIPGSLEDRAILLTRMGQRILHRGPDHGDLWCEPGAPFGFTHRRLAIVDLSPAGRQPMISASGRYVIVFNGEIYNHPEIRAELESAGAAPRWRGHSDTETLLAGIDAWGADATVRRTIGMFAFAVWDRQTHSLTLARDRLGEKPLYYGWQGSGQARAFLFGSELKALRPHPAFDGSIDRNALTLYMRYNNVGGGHSIYQGIAKLPPAHLLTVSMLAREPVLRAYWSGSAAALQGKQDPFTGGPQEAVDSLDALLRDAVARQMMADVPLGAFLSGGIDSSTVVALMQSQSTQPIRTFSIGFHDAGYNEAAHAKAVARHLGTSHTELYVSPEHAMAVIPRLPEIYDEPFSDSSQIPTLLVSGLARQHVTVSLSGDAGDELFGGYNRYQITAELWGRLARIPGPVRAAAAWGLTRLSPHQINRVAALLPMASRWSHVGEKVHKGAGVMAAHTVDELYRGMVSQWQCPDAIVMGGAEPATLPEPVARALAMLGDVERMMAADLLTYLPDDILTKVDRAAMARSLETRIPFLDHRVVEFAWRLPLAYKIRQEDAGHTTKWVLRRVLDRYVPRELIERPKMGFGVPIDAWLRGPLRDWADDLLSEERLRREGFLNPQPIRQRWTEHLSGRRNWQHPLWCVLMFQAWLGHETTERTAPPLTDIPTSDRRLACAF

SEQ ID NO: 19943 - protein, 409 aa, Pseudomonas sp.
MGERRDTTVIVGAGHAGTAAAFFLREFGYHGRVLLLSAETQHPYQRPPLSKEYLLAQHSTPSLLKGKDSYARADIELCLQDDVLSITPASRQVKSSQGSYTYDHLILATGSHPRFMATLGQADNLCYLSDWDDAGRIRQQLGEASRIVVLGGGFIGLEIASSACKMGKHVTVIERAPRLLSRVVSEAFATFIGDIHLGNGIELRLGEEVREVRRCTSGVRVDAVFLSDGQLLECDMLVIGVGSEPRMELATAAGLACASGVLVDEHCHTSDPFISAIGDCVAVCPSPGHQLPRRESVQNATEQARLVAARLSGRPVPPVQTPWFWSDQLQARINLAGERPAQGQVIVRRYGGDKVSMLYLQDQQLVAIEACNMPGDCLLARRAIGQNHSLDLARLVDADVPLKDALHFA

SEQ ID NO: 19944 - protein, 243 aa, Synechococcus sp. RS9917
MRKPVIAGNWKMHMTCAQARDWMTVFLPLIANTPEDRHLVVAPPFTAISTLAAMGQGSRLELSSQNVHWEGEGAFTGEISPTMLLEHGVRYAIVGHSEPRKYFSESDEQINHRGRSAQSHGLIPIVCVGESDEQRSRGEAERVIRRQVEQGLEGLDPAKLVVAYEPIWAIGTGKTCEASEANRICGLIRSWVGSPDLIIQYGGSVKPGNIDQLMAMSDIDGVLVGGASLDPESFGRIANYQKS

SEQ ID NO: 19945 - protein, 1298 aa, Oryza sativa
MNENKVNERERERCRTNVNEPTNVNVKCNYRQMADRDEEQILYDTIEEGSSQYWNEEEGNEDPNQYLNEEGNVERDAEGNQEGHKRARGQRGAAKKLEGQHIITEVEEDGRPSAPAEAAKNYVRHSGWVVRDNVPVSTVYWRRTRARGDHESFVPDSEKEMLWTTMLETFTLPAGTEDKVKRWTLKKMAEQFQSFKGELYKKYILKGQTPNFDTFPKLRDHWDEFVAYKTGEQGQAMMERNKENAAKKKYHHHLGSGGYSVVMPKWEEMEASLLERGIEPAIANWPERSKFWYYAHGRTLNPADGSLVFGDQIREAARRLTDAVEASSQGTFRPDRERDELSLALQTPEHPERTRGKGVIPWKIGFKEDIHTYKSRMRSKRDTEAKIADLEFRVSSYELSMQEEVARKVDERMAAHWSNDPQPTIPPAMVSPSGNRSSCASTGQVGLQSMDAMQTQDESTCPVDDIIQRTPCELHIPFKNLSIKVASGMAIPTDPSGTYHCRPIPAGYSKVEVELVEGAYEDLELDYPGGDGETHLRDTSHAIILWCRRYIILPGQQAASRAPSPPAPPSPPQDPAPSLPQDSAPSPPHAPAPSPPQAPAPTSPRSPTPTPPQAPLPAPSKSRAPQAPPPAHRRATKKAKIDAAKNKDPGYDCTQEELDAYVASEVKRQFKPRSLEKKIPIDPSVMNFFRGVAPIEKAEVKYMYELGKPLVKPELLQSLPTQMYKFHQLYMEMSATGREMIGARIRDTDFLQGDDILWINFKGIYELYQLDALDVSIMSCWILMEIQRARRRGVFDTGFIDPRKVNVVMLDQYPQATEDNLVHLLKAQHYKTFILWPYNTEFHWVFLLFDLSACTVNVYDSMDKKESTFDKVFELIDRVWYRFRHLVRGKWRERLRRKFKFPCAKQKKGTNLCGYYVCEYCHCLADQIITTRELDLLVMDPNRSSGYYDFLNDPDLAHPFGQASTQGDFSHPHNDFPYAHAQFPLFSTQPPPAAAGNGGPTAASRCGVRQRVQANPGSQDDGKARMYYTRDEDLRLVSAWLENSTDPIEGNARKGDTYWRQVADTYNATTEDDRKRDPKHLKGHWHKHTRKVSAFNGIYVQLRDNYQSGRSEEMLMDQAMELYQSREGHPFTLGYWWKAVRDSPKWNAHICLLGHGPRKIRAEFDVNAPPVEEQPAQVRPAGIKRAKKGRQSDYSAELAELIKHLCKAHASQQEETASMKDFQQKLSGEKVEAATLNLQAAKEKTKAKLIDQQTKMLDKFTQMISVDTSSMEPWAREAHIKACTLMSDQLWGKGATLE

SEQ ID NO: 19946 - protein, 472 aa, Coprinopsis cinerea okayama7#130
MPPIYDKPTTDRYDYVVIGGGSGGSGTSRRAASYGKKVAVVEATPYLGGTCVNVGCVPKKLMWNAADLQDRFRHHAPGYKFENIGEPTFNWGEFKTQRDAYIRRLNGIYANNFHKEGVEFHQGFGRLTSPNSVEVTRPDGTKYTLQADHITIAVGGSPTIPSDDVIPGASLGIDSDGFFALESQPKRVAVIGAGYIAVELAGIFNALGSETHLVIRGQTVLRTFDPTIQETLTPWMEHTGVHIHKGSNVTRIDGAKGQTLTVTTDQGEKIEVDTVLWAIGRHPCTKGLGLEEVGVKTDEKGDIIVDEYQNTNVKGVYSIGDVSGKWLLTPVAIAAGRRLSNRLFGPEKFKNDKLEYDNIPTVVFSHPPIGTVGLTEPQARKKYGDDAIKIYKTSFKSLYFSQVDQDLKEPTVYKLIVAGPEEKVVGVHIIGQGSDEAMQGFGVAVKMGATKADLDNTVAIHPTSAEELVTLR

SEQ ID NO: 19947 - protein, 151 aa, Coprinopsis cinerea okayama7#130
MSNTERTYIMIKPDGVQRALVGKIIQRFEERGFKLIALKLTQPTEAHLEKHYADLAGKPFFPGLIKYMASGPVVAMVWQGLDAVKTGRAMLGATNPLASPIGSIRGDYALAVGRNIIHGSDSVENAEKEIALWFPEGVVQYTSVAEPWIYE

SEQ ID NO: 19948 - protein, 382 aa, Candidatus Desulfococcus oleovorans Hxd3
MKDLGGIMDNQKIVLFGATGYTGKQVAQELVRRGLLPILCGRSREKLESVAAELGGLKTAVVDVADPAGLAALVGKGDILVSTVGPFAKYGTTAVSVAAEKGAVYIDSTGEPSFIARVFETYGPQARSTGATLLTACGYDYIPGNCAAGIALSASGKKAVRVDVGYYSKKKGRVQPLDMSQGTASSLRLAMIDPVKVWQSGKLVEQTGGIRTRTFDLDGQPHPGLTVSCTEHFSLPRVFPELREINTYLGWFAGKTYIMQKAALFQSVAGKIPGYRSLARAALSMLPESTGKGPSPEILQQHQTHVVAETFDEKGRLLARADLVGVDGYSFTAKMMAWAAHRAAVQGFRATGAVGPIEAFDLDGLIEGCEACGLTPSVHLGK

SEQ ID NO: 19949 - protein, 389 aa, Treponema denticola ATCC 35405
MERKDYISDSEWKHFMSFSENLETPCVVINLKTIKKNYQKLRENFPYADIFYAIKANPHEEIISMLNEMGSCFDIASRYELDKVLKLGVSPERLSYGNTIKKAKDIAYFYEKGVRMFATDSKDDLKNIAQFAPGSRVYVRILVENTTSADWPLSRKFGCHPDMAYDLCIQARDSGLIPYGISFHVGSQQRDIGQWNDAIAKTKYLMDSLEEEEEIKLEMVNMGGGFPASYVTPANDLSEYASEISRYLEDDFGEERPRIILEPGRSLVGDSGILVTEVVMISRKNNTALFRWVYLDTGLFNGLIETLNESLKYPIITDKDEGCKKWGEVVLAGPTCDSMDIMYEDYKYSLPTNLKPGDRVYFLTTGAYTSSYASVEFNGFPPIKTYIMK

SEQ ID NO: 19950 - protein, 341 aa, Silicibacter pomeroyi DSS-3
MTLKVAINGFGRIGRGVLRALVESGADDIEVVAINDLASPETLAHLLKYDSVHGRLQAPVLVEGDRMIVGRSSIRLSAIRNPEDLPWADVDIAYECTGLFTEREQAARHLKNGSKRVLISAPGKGADRTVVFGVNDGALTADDVIVSNASCTTNCLAPVAMVLDHAFGIKTGYMTTIHAYTGDQPTHDTAHRDLYRARAASVSMIPTSTGAARAISEVLPHLKGRLEGSAIRVPTPNVSLVDLSFVPERPATREAVNAAIRTAAQGPLAGILAYEEDPLVSIDFNHDSHSSCFAAAQTSVTADGLVRVVSWYDNEWGFSNRMLDTGRRIGALLITPQRLAG

SEQ ID NO: 19951 - protein, 233 aa, Brassica rapa
MGRKKLELSERHSVAMAASLQSAATFLQSAKISTAPSRGSAHLRSTQTVGKSFGLETSSARLTCSFQSDIKDFAGKCSDAVKIAGFALATSALVVSGASAEGAPKRLTYDEIQSKTYMEVKGTGTANQCPTIDGGSETFSFKPGKYAGKKFCFEPTSFTVKAESVSKNAPPEFQNTKLMTRLTYTLDEIEGPFEVSSDGKRELQERRRNRLRCSHCSASRRRACAVPLHSQAA

SEQ ID NO: 19952 - protein, 566 aa, Cornus sericea
MAQYGNPTEGLYKQPTDVYGNPISRTHESGNPVQRTADAQYGNPTEGVYKQPTDVYGNSISRTHESGNPVQKTADAQYGNPTEGVYKQPTDAHGNPISRTHESGNPVQKTADAQYGNPTEGVYKQPTDAHGNPVSRTHESGNPVQKTADAQYGNPTEGVDKHPADAHGNPAFRTRESGNPVQKTADAQYGNPTEGVYKHPTDAHGNPVSRTHDFGNPVQKTADAQYGNPTEGVDKHPADAHGNTAFRTRESGNPVQKTADAQYGNPTEGVDKHPTDAHKNSISRTHDFGNPVQKTVDAQYGNPTEGVYKHPTDAHRNSISRTHNSGNPIQKTADAEYGNPTEGVHKHPTDAHENPLSRTHESDNPIQKTAGAQNRNPTEGVHKHPTDAHRNPVSRTHESGNPIQKTADAQYRNPTEGVHKHPTDAHGNPVSRTHEYGNPIRKIADGQGVHPTGGTTEGYITTSGTSTGIGNGGAIGGQQHGGVLQRSGSGSSSSEDDGQGGRRKKKGLTDKKKEKLSGGRKPAQASHPTATTTTTTGHDIYKGGQQNQEKKGVMEKIKEKLPGQHN

SEQ ID NO: 19953 - protein, 440 aa, Cornus sericea
MAQYGDQYGNPVRPTEKVYRSPTDAYGNSFPPTDEYSNPIHQTDAYGNSNRKTDEYGNLVHPLEKVYGSPTDAYGNPLPPTDKYGNPLHQTDAYGKPIRKTGEYGDPTDAYGNPLPSTDKYGNPIHQSIRRTDEYGDPVHPIEKVYRSPTDAYGNPLPTTDKYGNPIRKTDEYGDPVHPIEKVYGSPTDAYGNPLCRTDKYGNPIHQTDTHGNPIRKTDKYGDPIHPIEKVYGSPTDAYMNPLPQTDKYGNSIHQTDAHGNPIRKTDKYGNPVHPTQEAYRSPTDAYGNPLPPTDEYGNPIHQTDAYGKPIRKTNEYGNPVHHTVPMGDYGISGATGAYGTGTGVTGVGGQHHGGILHHSDCFSSSSSEDDGYGGRRTKGLTDKIKDKLRGGKKTEQLHTTATSTTTGYGYEGEEHRYYKKKGVMEKIMDKLPGQESQHY

SEQ ID NO: 19954 - protein, 329 aa, Xanthobacter autotrophicus Py2
MSELVTLKTYLGTWAGADTGRTAVAQAVTAIAEAGVGIADLVARGPLEEGLASIRGVDPNAGGDAQKELDVVAEERIKAALLPTPTAFLASEESEELIPLNPDGRLVIAVDPLDGSSNIDTNVSVGTIYSILPYDAAVHTDPVSAVMRPGVNQVASGFLAYGPATILVATFGEGTQVFVHDRQTGEFVLARTNVEIPAETKEYGVNQSNVRHWAEPMSAYIADCLAGKDGPRGKDFNMRWVGSMVADAFRIFTRGGVYVYPGDKRKGYENGRLRLIYEANPVAFLTEQAKGAATDGKTRILDIQPHHIHQRIPLVFGSKAEVEKIASYY

SEQ ID NO: 19955 - protein, 452 aa, Mycobacterium avium subsp. paratuberculosis K-10
MSSTKHREVAKLDRVPLPVEAARVAATGWQVTRSAARVLTKLPAKGPWQQKVIKQLPQTFADLGPTYVKFGQIIASSPGAFGESLSREFRGLLDRVPPADPDEVHKLFLEELGADPSELFASWDETPFASASIAQVHYATLHTGEEVVVKIQRPGIRRRVAADLQILKRFAQAVELAKLGRRLSAQDVVADFSDNLAEELNFRLEAQSMEAWVSHLHASPLGKNIRVPQVYWDFTTDRVLTMERVSGIRIDDVAAVRKAGFDGVELVKALLFSLFEGGLRHGLFHGDLHAGNLYVDEAGRIVFFDFGIMGRIDPRTRWLLRELVYALLVKKDHAAAGKIVVLMGAVGTVKPEAQAAKDLEKFATPLTMQTLGDMSYADIGRQLSALADAYDVKLPRELVLIGKQFLYVERYMKLLAPKWQMMSDPQLTGYFANFMVEVSREHSSEFESDVEV

SEQ ID NO: 19956 - protein, 312 aa, Synechococcus sp. WH 5701
MGAAAVLVVAGTHGNERNAPWLLEHWLAHPGALDAAGLALQLVIGNPGALAAGRRYLDRDLNRSFTSALLEAPGPADREVQRARELLALHGPAGSRPCALVLDLHSTTAAMGNSLVVYGRRPVDLALAAGIQALLGLPIYLHEADASQQGFLLECWPCGLVIEVGPVPQGVVNAAICHQTQRALEAALAVLASARRGDLALPRGLTVHRHLGSLDLPRHPDGRPAACLHPLRQHRDWQVIRPGDPLFVTAGGETLRYEPTDPEPLWPVFINEAAYGEKGIALSLTRRERWPCEAAWAEDLQQLAKHLTLSTG

SEQ ID NO: 19957 - protein, 730 aa, Mycobacterium sp. JC-1
MRPPEADEPKGRNRDSDSRCDPCRAQFDTVGVELDNRGPACRGHRPGAGRGCVEKVGNGHPGTAMSLAPAAYLLFQKLMRHDPRDPDWVGGDRFILSPGHSSVTLYIQLFLAGYGLELEDLKSFRTWGSLTPGHPEYKHTKGVEITTGPLGQGLASSVGFAYSQRRMRGLLDPDAAPGTSPFDHTIWVIASDGDLQEGVTSEASSLAGHQELGNLVVVYDENHISIEDDTDISFTEDVLGRYESYGWHVQRVDWTRTGEYREDVEELFAALLARRRKPRSRPSFVRTIIGYPAPKKQNTGKIHGSALGAEEVAAVKEVLGFDPAKSFDVDPAILAHARAAIDRGAAARSEWDESFQSWQAANPDAAALLRRIEARQLPDGVDAVLPVFEAGKDVSTRAASGKVLNALGPVLPELWGGSADLAESNNTTIEGSPSFIPVSRSANAWKGNPYGRVLHFGIREQLPRSIVNGISLHGPTRAFSGTFLIFSDYQRPAIRLSALMGVPSVYVWSHDSIGLGEDGPTHQPVEQLSTLRAIPGLDVVGPGDANEVGIAWKTILENHENPAGVVLTRQNIPTFARGEGAAEGDTFASAAGVAKGGYVLAEASRDGATVPAQVLLIATGSEVQLAVQAREALQAEGIPTRVISMPCVEWFNKQDAAYRESVLPAAVTARVSVEAGLALGWKEFVGDAGRSVSLEHFGASADYKRLFQEFGITADAVVAAAKDSITAAGN

SEQ ID NO: 19958 - protein, 591 aa, Chlamydomonas eugametos
MAAKFVEGTLDVTLKSASDLREDMSVKLDAYCVVSCASTAHRSNTVTDAGKTMNWEQTFHFDKVASTSVLKLESSMRRTPSDRSSCACKIPLTRACTSGSDEVCVPVLDKKGKPIGETHVSMTFKATSMADGPTKGNWILPTYANKDCWKDYEQGKVVGKGSFGTTYLVTKKDTQEQYAVKVISKRKLTTMEEVEDIQREVRIMHHLAGHPNVVQLKNVYEDKSYVYLVMDACMGGELFDAIVERGTYSEKDARALMRTIVSVVAHCHDMGVIHRDLKPENFLLLDKSANPVLKSIDFGLSSFYQEGQVFHDIVGSPFYVAPEVVRRSYGKEADIWSCGVILYILLCGYPPFHGDNETKIFEAIMNKSLDFQSDPWPKVSEPAKECIRRMLDRNPKTRASAQQTLEHEWMRENGVATEKRLEMEVLTSMKKFSAGNRLKKEAAKIIAANLPTDEICGLREMFIAIDVDHSGSITAEEFANALRMKGNSLPEDEVQRLVSNADVDGDGTCDYEEFLAATINQSKLEREDRLKIAFEHFDLDHDGSITHDELMQSLANLGINDAGIKEIIADVDRDGNGQIDYNEFCLMMRNL

SEQ ID NO: 19959 - protein, 406 aa, Xanthobacter autotrophicus Py2
MTTDFHRIRRLPPYVFEQVNRVKAAARNAGADIVDLGMGNPDLDAPAHVIEKLKETIGKPRTDRYSASKGIPGLRRAQAAYYERRFGVKLDPDKHVVATLGSKEGFANMAQAITAPGDVILTPNPSYPIHAFGFLMAGGVIRSVPVEPGPEFFHAMERAVQHSIPKPIAVVLCYPSNPTACVADLEFYKDVVAFAKKNDLIVLSDLAYAELYFDDTPPPSVLQVPGAMDVTVEFTSMSKTYSMAGWRMGFAVGNERLIAALSRVKSYLDYGAYTPIQVAATAALNGPQECIAEMRETYKKRRDALVESFGRAGFPVPSPRASMFAWAPIPEPFRAMGSVEFAKLLIEKADVAVAPGVGFGEHGDDFVRIAVVENEQRIRQAARNIRRFFEQAGTTLHNVVPLSAAR

SEQ ID NO: 19960 - protein, 548 aa, Magnaporthe grisea 70-15
MTLLEFSPWAPAILVPVALIVLYTFLAAPRLKRNGIPLKTPRDSLPFVGNGIVFLQPRQKLFAWFHQREREFGLETYQITVPTLPPGVVISDPVCLEYVFKNETLFNKGAFFKERSDDLFGHGIINVDGEPWRAQRKAGLNFLNTTNLRVLTDVALPRYLNENIGWLKNKADGETVADLQEVFHRITSQLMGKMAYNMEMHAGDDFSVAFDYASGATAERFQNPLWFITEFFTGSRLRRSLAIVKEHGRKIVANATCDRKAAEKLSATLPGVDADSEHDGLEEISGSLIQSLLDCIGDEKLVADAALNYLSAGEMLFSCSKTRTYPLTAIHQQRNSWIANQFAGRDTVAQALTWTSYLLMQHPEAIERIRAETAELISPMDGSAGNHTTLLKPPSAPYTMAVFYETMRFYPPIPFEIKQCVRETTLPDGTFLPASSVVVWCPWAMNRSKAIWGSDVDEFRPERWLSLDGKSFASRSAAEYPVFNGGARMCLGKKMADIIAVQVLPSIVTNFDFRPAYEKQQERVSKSSLTLPMQDGLPVFVKRRDVAR

SEQ ID NO: 19961 - protein, 187 aa, Synechococcus sp. RS9917
MAAMMTGLWPLRHLSLDLRQLIRDIPDFPKPGILFRDISPLLRDPAGWSEVMRRLGGVCDQLQPDLIVGIESRGFIVGTALATDRKLGFVPVRKPGKLPGEVIAIDYSLEYGSDRLEMHADALRDGARVLIVDDLLATGGTASATASLVQQAGGQLVGCGFVVELAGLDGRRRLPDQTPVESLIIYS

SEQ ID NO: 19962 - protein, 348 aa, Mannheimia succiniciproducens MBEL55E
MKILLKLTALLLSLGVALNVAADGGKNHPSYPLLASEFRDLSLLESVRFTPEQLQDKAKLTELNAAFLQAAEQSEVQPNEKITAPAQGAQPAVDLYIYRPATAKNEKLPVIYFMHGGGYLFGNARQNNAALAELADLNKAVVISVEYRLASQTPYPADIDDAYHGLAYLFKNGQKLNADTNKVVIMGESAGGGLAARLALKVRDKGEFKLAGQVLIYPMLDYRTGTSQSLYNTPYTGGYVWTAEYNRIGWETLRGGQTIAQAEMPYYSAATATDLAGLPPTYMMVGSLDLFANEDMDYANRLVQAGVPTDLQLVSGVYHAFEIFNPNASQTLAYKLARTNAIQQMLAK

SEQ ID NO: 19963 - protein, 449 aa, Penicillium chrysogenum
MVKQIAGSKALLLGSGFVTKPTVEVLSKADVEVTVACRTLESAQALASGFKNAKAISLDVNDDAALDAALNQADVVISLIPYTFHATVIKSAIRTKTNVVTTSYVSPAMMELDEQCREAGITVMNEIGLDPGLDHLYAVKTIHEVHAAGGKVTGFVSFCGGLPAPECSNNPLGYKVSWSSRGVLLALRNAAKIYQDGKIVSIDGPDLMATAKPFFIYPGFAFVGYPNRDSTPFRERYGIPEAQTVIRGTLRYQGFPEMIKVLVDIGFLNDAPNSVFDKATSWKEATKQVLGATSSDEKDLHWAIASKTKFPNNDERDRLLSGLRWIGLFSDEQIIPRGNALDTLCATLEQKMQYGPGERDLVMLQHKFEIENKDGSKETRTSTLCEYGNEVSSAMARTVGIPCGVAVKQVLDGTISKTGVIAPVTWDICAPLIKTLKEDYGMELIERTL

SEQ ID NO: 19964 - protein, 686 aa, Coprinopsis cinerea okayama7#130
MASFAPHQNDDVAVATIRILSVDTVAKANSGHPGAPMGLAPAAHILFSRFLNANPKNPNWFNRDRFVLSNGHGCALQYVLLHLLGYNLTLDDLKAFRQLDSKTPGHPEAGHTEGIEVTTGPLGQGFANAVGLAIAQAHLGAVFNKDGFDLINNYTYVFTGDGCLMEGVAAEAASLAGHLKLGNLVVIYDDNHISIDGDTNVAFTEDVEQRFLSYGWQVLHVHDGDTDLASIYASIAAAREEKDKPTIIKLRTTIGYGSKEQGTHGVHGSPLKADDIVSLKQKFGFNPEEKFAVPQGTYDLYSEFGKRGAALEEQWNALLAAYAEKYPQEHAELTRRIAGKLPEGWEKALPVYKPTDAAVASRKLSEIALTALAPVLPELIGGSADLTGSNLTKVKNSTDFQHPSTGLGNYAGTYIRYGVREHGMGAIANGISAYGGAIPYVATFLNFVSYASGAVRLSALSQHHVIWVATHDSIGLGEDGPTHQPVETQIALRATPNLAFWRPADGNETSAAYLVALKSNKTPSVLSLSRQNLPQLDGSSIEKASRGGYVLVEEDNEDLTIVSTGSEVSIAVDAAKKLKEQGIKTRVVSLPCWLVFDQQPLEYRLSVLRSGAPILSLEAASTAGWAKYSHEQWGLPAWGGSAPYQKLYERFGITGSNIAEVGKKVVDFYKQRGGKLASPLEKAVNL

SEQ ID NO: 19965 - protein, 491 aa, Solanum tuberosum
MANTKDSYHIITMDTKESSIPNLPMKEIPGDYGVPFLGAIKDRYDFHYNQGADEFFRSRMEKHDSTIFRTNVPPGPFNARNSKVVVLVDAVSYPILFDNSQVDKENYFEGTFMSSPSFNGGYKVCGFLGTTDPKHTTLKGLFLSTLTRLHDKFIPIFTTSITQMFTSLEKELSEKGTSYFNPMSDNLSFEFLFRLFCEGKNPVDTSVGTNGPKIVDKWVFLQLAPLISLGLKFVPNFLEDLVLHTFPLPYFLVKGDHQKLYNAFYNSMKDILDEAEKLGVKREEACHNFIFLAGFNSYGGMKVFFPSLIKWIGTSGPTLHTRLVKEIRTAVKEAGGVTLSAIDKMPLVKSVVYETLRMDPPVPFQTVKARKNIIVSNHEASFLIKKDELIFGYQPLATKDSKVFKNAEEFNPDRFVGYGEKLLKYVYWSNGKETDNPTVNDKQCPGKDLIVLLGRLLVVEFFMRYDTFEIEFGKLLLGSKVTFKSLTKATS

SEQ ID NO: 19966 - protein, 117 aa, Brassica napus
MGPKAGTLVIFLLGLTLLSDARSFLHSSLDSEKVIKNEKVCTLCEEYVNVAISYLENNQTQAQIIEDLHDRCSRMRGFAQQCVTLVDYYVPLFFIQLESFQPEDFCKRMNLCDKVTA

SEQ ID NO: 19967 - protein, 451 aa, Candidatus Desulfococcus oleovorans Hxd3
MSVIKSVIDKVKHMDPDQKEFHQAVIEVMETLEPTAERHPEFVKNGIYERIVEPERAVQFRVPWVDDKGQVQVNRGFRVQFNNAIGPFKGGIRFHPSVNLGIIKFLGFEQIFKNSLTTLAMGGGKGGSDFDPKGKSDGEIMRFCQAFMRELFRHIGPETDVPAGDIGVGGREIGYMYGYYKKIRNEHTGVLTGKGLEYGGSLIRPEATGYGTVYFASEMLATRGLDFKGKRVAVSGAGNVAQYAIEKVNEMGGTVISVCDSGATIIDEAGIDNDKCCYLMELKNVRRGRVNEYADQYKTVCVESKNVWDVIREQGIKVDVALPCATQNEIDGANAEALVKNGCICVAEGANMPSSPEAVRIFQANNVLYGPGKAANAGGVATSGLEMSQNSSKLSWTREEVDSRLLLIMKGIHKSCLDAAEAYGKKGDYVTGANIAGFVKVAKAMLAYGIV

SEQ ID NO: 19968 - protein, 457 aa, Roseovarius nubinhibens ISM
MLKNDQLDQWDRDNFFHPSTHLAQHARGEAANRVIKTASGVFIEDRDGTKLLDAFAGLYCVNVGYGRQEIAEAIADQARELAYYHAYVGHGTEASITLSKMILDRAPKGMSKVYFGLGGSDANETNVKLIWYYNNILGRPEKKKIISRWRGYHGSGLVTGSLTGLELFHKKFDLPVEQVIHTEAPYYYRRKDLGQSEAEFVAHCVAELEALIAREGADTIAAFIGEPVLGTGGIVPPPSGYWEAIQAVLEKHDILLVADEVVTGFGRLGTMFGSDHYGMRPDLITIAKGLTSAYAPLSGSIVGDKMWKVLEQGTDENGPIGHGWTYSAHPIGAAAGVANLKLIDDLGLVQNAGAVGTYLRDQMQAALGDHAHVGEVRGEGMMCAVEFVRDRDDRVFFDAAEKIGPQVSAKLLEQDKVIARAMPQGDILGFAPPFCLSREEADQVVAATMRAVKTVLG

SEQ ID NO: 19969 - protein, 784 aa, Bacillus anthracis str. Ames
MKGVILAGGKGRRLRPLTCNTPKPMLPLLEKPVLEYNIELLRQHGIREIAITVQYMSTAIKQYFGDGSKWGVNLYYFEDSPPLGTAGSIKQAEKFLDETFVVISGDALTDFQLSKGITFHEQQKRMVTMFVKEVENPLSFGLVVMNKEQEVTRYIEKPSWNEVVSNIVNTGIYIMEPEIFSYIPPREFFDFSQDVFPLLANKNALFAYLSEGYWLDIGTFDQYRQAQFDLLTKKLQVPIPYTEVLPMVWMGEGVTIGKGTKIHGPSFIGEGAKIGAGAVIEPYSIIGKNSIVSSYSHLQKSIVFANAHIGQYCELLETTIGEHTMVEDDVTLFQKSIVADHCHIGKSTVIKQKGKLWPYKAIDSYSVVGSAGVQESEKSAGWLQKSRIVGRGNVEITPQFIVKVAMAYGSLFTKGESILIGSQEHIETTSYKNLFLHAIHGIGIHTMECKEMNESLFQYSIQDLQCAGGVFIQVENEKEVIIKLYAQDGAQLTYKQQKAIEQVYMSESFYYVCEKEMGRNKLVHVSLHDYIEAVLERIDIEKIQKQKFHLLINKRNDMLQHLLMLFLQRLGCTVTWIYAGEQKDHVKALMKSSKANMALMFSEQGNYFELYDNHSNIYQGTDFEEVDIPDLLLESTGNIYLMSLKLGECYLLFYTQDEKKSFQARWKRDILYRIGKLFELIALQGKTFLSIVEQSPPLYLLCDEVVCSWNEKGKVMRKLLADMERKEEGIFEGVQFKYTEKEWSYIVSDTKQPKFLVYSHARNPVIARENMKNLIEKIRQYQKV

SEQ ID NO: 19970 - protein, 228 aa, Brassica napus
ARSRVRPVAQSRLAFGSSTSGRAADPELHSGNDGADPAVYPRDPEGMDDVANPKTAAEEIVDEQPRSSLEQQPLNPPKSPPATAHKLESTPVGRPSEPNFQQKRRRSTEASPPSLDCAGCVSLDEGEEEERRRRENETESDEEYYAHHKASPLSEIEFADTRKPITQATYGTAYAAGKDVIGWLPEQLDTAEEALQRATMIFKRNAERGDPETFPHSRILREMRGEWF

SEQ ID NO: 19971 - protein, 255 aa, Brassica napus
  misc_feature (172)..(172): Xaa can be any naturally occurring amino acid
  unsure (1)..(255): unsure at all Xaa locations
MARKFFVGGNWKCNGTAEEVKKIVNTLNEAQVPSQDVVEVVVSPPYVFLPLVKSTLRSDFHVAAQNCWVKKGGAFTGEVSAEMLVNLDIPWVILGHSERRALLNETNEFVGDKVAYALAQGLSVIACVGETLEQREAGSTMDVVAAQTKAIADRVSNWSKVVIAYEPVWAIXGTGKVASPAQAQEVHDELRKWLAKNVSADVGATTRIIYGGSDDGGNCKELGGQADVDGFLVGGASLKPEFIDIIKAAEVKKSA

SEQ ID NO: 19972 - protein, 377 aa, Bacillus cereus ATCC 14579
MKAVTYQGPNQVQVKQVDDAKLEKKDDIIVKITSTAICGSDLHLYQGNMPLPQGYIIGHEPMGIVEEVGPDVTKVKKGDRVVIPFNVSCGHCFYCQHEMESQCDNSNPHYDSGGYFGYTEKFGNHPGGQAEYLKVPFGNFTPFVIPESCELEDESLLFLSDVLPTAYWSVINAGVRPGDTVIVLGCGPVGLMTQKFAWMQGAKRVIAVDYLDYRMNYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 19973 - protein, 100 aa, Oryza sativa
LLWFLQDDLDDYVDVTNSRLQVYFWYFFIQSSGKFHCYIVISSLCELNFDINLSLIQRVQKRLAILNKRVKGGCSCMALLISVVAIVFLAVIAWLLIKHL

SEQ ID NO: 19974 - protein, 223 aa, Oryza sativa
  misc_feature (50)..(50): Xaa can be any naturally occurring amino acid
  misc_feature (115)..(115): Xaa can be any naturally occurring amino acid
  misc_feature (124)..(124): Xaa can be any naturally occurring amino acid
  unsure (1)..(223): unsure at all Xaa locations
MALVEDNNAVAVSFSEEQEALVLKSWAILKKDSANIALRFFLKIFEVAPXSASQMFSFLRNSDVPLEKNPKLKTHAMSVFVMTCEAAAQLRKAGKVTVRDTTLKRLGATHLKYGXVGDAHFEVXKFALLDTIKEEVPADMWSPAMKSAWSEAYDHLVAAIKQEMKPAGVIDRHASCSTSMILASRVRLAFVAFKCSFHIHRVPQKKECVCGVRLVHAPAVFFS

SEQ ID NO: 19975 - protein, 160 aa, Neisseria meningitidis
MPEGAEQDILKGMYLLKAGGKGDKKVQLMGSGTILQEVIAGAELLKADFGVEADIWSCPSFNLLHRDAIEAERFNRLNPLETAKVPFVTSQLQGHDGPVIAATDYIRSYADRIRAYIPNDYHVLGTDGFGRSDSRANLRSFFEVDRYNVAVAALSALADQ

SEQ ID NO: 19976 - protein, 160 aa, Neisseria meningitidis
MPEGAEQDILKGMYLLKAGGKGDKKVQLMGSGTILQEVIAGAELLKADFGVEADIWSCPSFNLLHRDAVEVERFNRLHPLEAEKVPFVTSQLQGHDGPVIAATDYIRSYADRIRAYIPNDYHVLGTDGFGRSDSRANLRRFFEVDRYNVAVAALAALAEQ

SEQ ID NO: 19977 - protein, 323 aa, Saccharomyces cerevisiae
MSGSFWTSTQRHHWQYTKASLAKERQKLWLLECQLFPQGLNIVMDSKQNGIEQSITKNIPITHRDLHYDKDYNLRIYCYFLIMKLGRRLNIRQYALATAHIYLSRFLIKASVREINLYMLVTTCVYLACKVEECPQYIRTLVSEARTLWPEFIPPDPTKVTEFEFYLLEELESYLIVHHPYQSLKQIVQVLKQPPFQITLSSDDLQNCWSLINDSYINDVHLLYPPHIIAVACLFITISIHGKPTKGSSLASAASEAIRDPKNSSSPVQIAFNRFMAESLVDLEEVMDTIQEQITLYDHWDKYHEQWIKFLLHTLYLRPASAI

SEQ ID NO: 19978 - protein, 175 aa, Arabidopsis thaliana
MGKKRKSEATRLDEVDRTMYGAFRGAANSLSQLYTHAMNHQRVSFLAGERRGMEKLYQWIVRQEEQGTRVSTADITTYLQNALEYEPEETSIPLPMQEFYQHQFAPPNVNTSVAHVPSSHIAQQQHYDCNQEKLLIPPNGLSSPVRRTLQDFNLCEAESGNNNYNPNSTGEHLSY

SEQ ID NO: 19979 - protein, 490 aa, Saccharomyces cerevisiae
MNFYRDATWVLEDIEKEAAKERISGSMQTLVLKSCKRYKLKSNPKHIYAVLDSCWKYKPYLEKVMKKAHILEDIPKKKGKPLFSRLTLLLLCHDLLLSKQKRIQMGKHPIKDYVLKFKSPLHSEMVKLKLKLKVRELSELVLSEDISNDLPPVRWIRINPLKCHPNGETEPVLAELRKKFTLKVDKWSELVPGSIYYDEFIPNLFGIHPSDKITAHELYKHGKIIIQDRASCFPAHILNPGPSDIVIDSCSAPGNKTTHTASYIYPEPPKDNNTRIYAFEKDPERAKVLQKMIKIAGCSPNISVNVGDFTKLATPEKYKDVTCFIVDPSCSGSGIFGRKFFDSFNRRKIDDKDDDGGIVPDEQEEFIAKEELQTRLAKLSSFQFQMVKHAMSFPAAKKIVYSTCSIHAEENERVVIDLLLDKSVREWGWKVAPKREVIPSWPRRGKVEEFEEVFRDGVTYDPQQLAEGCIRALPKSDGGIGFFAVCFERD

SEQ ID NO: 19980 - protein, 160 aa, Neisseria meningitidis
MPEGAEQDILKGMYLLKAGGKGDKKVQLMGSGTILQEVIAGAELLKADFGVEADIWSCPSFNLLHRDAVEVERFNRLHPLEAEKVPFVTSKLQGHDGPVIAATDYIRSYADRIRAYIPNDYHVLGTDGFGRSDSRANLRRFFEVDRYNVAVAALSALAEQ

SEQ ID NO: 19981 - protein, 158 aa, Triticum aestivum
  misc_feature (119)..(119): Xaa can be any naturally occurring amino acid
  misc_feature (139)..(139): Xaa can be any naturally occurring amino acid
  misc_feature (142)..(142): Xaa can be any naturally occurring amino acid
  misc_feature (149)..(149): Xaa can be any naturally occurring amino acid
  unsure (1)..(158): unsure at all Xaa locations
MAAAGDAGEKKMITLKSSDGEEFEVEEAVAMESQTIRHMIEDDCADNGIPLPNVNSKILSKVIEYCNKHVQAKPADGAAAGAGAGASDAAPAAPAEDLKNWDAEFVKVDKPPLRLILAXNYLNIKGCWTDCKLFYMIKXRPXEIARLKXEDLPERESR

SEQ ID NO: 19982 - protein, 503 aa, Glycine max
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLLMATWKVAPALAAGCAAILKPSELASVTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 19983 - protein, 135 aa, Zea mays
MRKHRIVSLVAALLVLLALAAVSSTRSAQKESVADNAGMLAGGIKDVPANENDLQLQELARFAVNEHNQKANALLGFEKLVKAKTQVVAGTMYYLTIEAKDGVVKKLYEAKVWEKPWENFKQLQEFKPVEEGASA

SEQ ID NO: 19984 - protein, 120 aa, Brassica napus
EKASNDNNGHVEHERCPVGEGALVVPETDNPTLPVMTFRAWFLGLSSCVLLIFLNTFFTYRTQPLTISAILMQIAVLPIGKFMARTLPTTSHRLMGCEWSLNPGPFNIMEHVIITIYANC

SEQ ID NO: 19985 - protein, 344 aa, Cryptococcus neoformans var. neoformans JEC21
MSQNKDIEASIPLSAMPRASDVEHDLTHGEHVEVNISDDGPPPNQQKKIVIPAIIIIPIWMACSISVILYNKYVFSGLNFEYPTFLTTWHLIFSTIATRVLQRTTTLVDGAKDIEMTRQQWMRTILPIGALFSGSLILSNYAYLTLSVSFIQMLKAFNPVAILLISFAFKIQEPSGRLIVIVLLISCGCFLAAYGEVQFELFGFLCQCAALAFEASRLVMIQILLHGMKMDPLVSLHYYAPVCAVINACIIPFTDGMAPIWNLHKVGILVLFTNAGIAFALNVAAVFLISVGSGLILTLAGVLKDILLISGSVLAFGSPITGMQVFGYSISLSGLILFKTTGGK

SEQ ID NO: 19986 - protein, 483 aa, Roseovarius nubinhibens ISM
MTFRDKAFINGQFVAAQSGETFDSINPATGEVLAQVASCDAADVDRAVAAARTAFDAGHWSRSDPGHRKSVLLKLADLIRDNLAEFALLDSLDMGKLVQDAVTVDAPGSAHFFQWYAEAIDKIYDEVAPTGPGDLALVRRVPLGVVGAVTPWNFPLDMATWKAAAALAAGNSVVLKPAEQSPLSALRLAELAMEAGLPEGVFNVVPGMGATAGRALGLHNDVDCLAFTGSTAVGKMFMQYSGQSNLKPVWPETGGKSPNLIFADCADLDRAADMAAFGIFFNQGQVCSANSRLYVERAIHAEFVERMIARAEATPPGDPLDPASKLGAIVDEKQTRSIEAAIAAGRNSANLVAGGNRVTLNGKGCFIEPTIFDDVRHDDALARDEIFGPVLSIIPFDTEAEAVAMANDSIYGLAASVWTDNLSRAHRVSEAIHAGTVSVNTVDALSAQTPFGGMKQSGFGRDLSLHSFDKYTALKTTWIKYQA

SEQ ID NO: 19987 - protein, 631 aa, Robiginitalea biformata HTCC2501
MGKVIPHSFFTEFDINLFKSGKHYRLYEKMGSHLTEVDGEKGVYFAVWAPSAKSVSVVGDFNYWLEGEHPLNVRWDESGIWEGFIPGLDQGTLYKYKIHSHVNDVKTEKADPFARYSEHPPKTASVVWADDHKWKDGTWMKNRAGHNGLDKPYSVYEVHLGSWRRNADNEFLTYLELADQLVEYVKEMNFTHVEFMPVMEFPYDPSWGYQLTGYFAPTSRFGKPEDFKVLVDALHRAGIGVILDWVPSHFPEDAHGLGNFDGSHLYEHPDRRKGYHPDWKSLIFNYGRNEVRAFLISNALYWLDHFHVDGLRVDAVASMLYLDYSREEGEWEPNMYGNNEHLEAISFIRELNAQVYGNYPGVQTIAEESTAFSKVTKPVDVGGLGFGMKWMMGWMHDTLEYFKKEPVYRKHHQNDITFSMTYAFTENFMLPFSHDEVVYGKQSLLYRMPGDEWQRFANLRLLFGYMFTHPGSNLLFMGGEFGQSSEWNFQQSLDWHLLQYDFHKGVQQVVRDLNTLYREQPALYEKQYSHEGFRWIDYGDAENSVLTYMRMGNEPKDYLIIACNLTPVPREGYRIGVPKTRQLKELFNSDAEKYGGSGMENGVAKISKTPWHGFDRSVEINLPPLSVVVFR

SEQ ID NO: 19988 - protein, 474 aa, Anabaena azollae
MTTSQEVLKRIQDEKIPLIHLKSIDTVGTWQHLTLYQNQIDESSFTDGVPFDGSSIRGWKAINESDMTMVLDPNTAWIDPFMEVPTLSIVCSIKEPRTGEWYNRCPRVIAQKAVDYLVATGIGDTAFFGPEAEFFIFDSARFAQTANEGYYFLDSVEGAWNSGKEGTADKPNLAYKPRFKEGYFPVSPTDSFQDIRTEMLLTMAKLGVPIEKHHHEVATGGQCELGLRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 19989 - protein, 160 aa, Neisseria meningitidis
MPEGAEQDILKGMYLLKAGGKGDKKVQLMGSGTILQEVIAGAELLKADFGVEADIWSCPSFNLLHRDAVEVERFNRLHPLEAEKVPFVTSKLQGHDGPVIAATDYIRSYADRIRAYIPNDYHVLGTDGFGRSDSRANLRRFFEVDRYNVAVAALAALAEQ

SEQ ID NO: 19990 - protein, 160 aa, Neisseria meningitidis
MPEGAEQDILKGMYLLKAGGKGDKKVQLMGSGTILQEVITGAELLKADFGVEADIWSCPSFNLLHRDAVEVERFNRLHPLEAEKVPFVTSKLQGHDGPVIAATDYIRSYADRIRAYIPNDYHVLGTDGFGRSDSRANLRRFFEVDRYNVAVAALAALAEQ

SEQ ID NO: 19991 - protein, 160 aa, Neisseria meningitidis
MPEGAEQDILKGMYLLKAGGKGDKKVQLMGSGTILQEVITGAELLKADFGVEADIWSCPSFNLLHRDAVEVERFNRLHPLEAEKVPFVTSKLQGHDGPVIAATDYIRSYADRIRAYIPNDYHVLGTDGFGRSDSRANLRRFFEVDRYNVAVAALSALAEQ

SEQ ID NO: 19992 - protein, 161 aa, Musa x paradisiaca
SSMMVSSAATVSRASPAQSSMVAPFTGLKSTSAFPVTRKANADLSHLPGNGGRVQCMKVWPIEGKKKFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 19993 - protein, 83 aa, Triticum aestivum
  misc_feature (38)..(38): Xaa can be any naturally occurring amino acid
  misc_feature (50)..(50): Xaa can be any naturally occurring amino acid
  misc_feature (72)..(72): Xaa can be any naturally occurring amino acid
  unsure (1)..(83): unsure at all Xaa locations
LRYTNTVWKTGIKVDSTKEMLGTFSPQPEPYAYVTPEXETTPSGMFARGXSYSAKTKFLDDDRKCYLQIKLXTSDIRREWRSS

SEQ ID NO: 19994 - protein, 160 aa, Neisseria meningitidis
MPEGAEQDILKGMYLLKAGGKGDKKVQLMGSGTILQEVVTGAELLKADFGVEADIWSCPSFNLLHRDAVEVERFNRLHPLEAEKVPFVTSKLQGHDGPVIAATDYIRSYADRIRAYIPNDYHVLGTDGFGRSDSRANLRRFFEVDRYNVAVAALSALAEQ

SEQ ID NO: 19995 - protein, 161 aa, Musa x paradisiaca
SSMMVSSAATFTRVSPAQSSMVAPFTGLKSASAFPVTRKPNADLSHLPSNGGRVQCMKVWPIEGLKKLETLSYLPTLKDEALLKQIEYLLRSKWIPCLEFSHEGFVGRENHRSPGYYDGRYWTMWKLPMFGCTDAVQVVKEVEECKKEYPKAFIRIIGFDN

SEQ ID NO: 19996 - protein, 171 aa, Bacillus halodurans C-125
MDFKQHITIVENFPKEGIRFKDITTLMQNGEVYKRAIDEMARFAKEKEVDLVVGPEARGFVVGCPIAYAIGKGFVPVRKAGKLPREVISVDYGLEYGKDRLTIHRDAIQKGQRVLIADDLLATGGTIEATVQMVEQLGGEVVGIAFMIELGYLNGRDKLVTYDVFSLTTYE

SEQ ID NO: 19997 - protein, 251 aa, Cryptococcus neoformans var. neoformans JEC21
MARKFFVGGNFKMNGSLESVEKIVRSINDANLDGTNEVVIAPPALYLLKVQSELNAPTQVSAQNAFTESSGAFTGEIAPQQLKDANVHWVILGHSERRSLFGDTDKLVADKTKAAINAGLSVIACIGESLEERESDKTMTVVERQLEAIAAAIDVDAWKRIVIAYEPVWAIGTGKVATVSQAQEVHAAIRSWLSRRASPEIADSTRIIYGGSVNGKNCGKLSAAKDIDGFLVGGASLKPEFIDICKSGKKA

SEQ ID NO: 19998 - protein, 178 aa, Triticum aestivum
  misc_feature (47)..(47): Xaa can be any naturally occurring amino acid
  misc_feature (51)..(51): Xaa can be any naturally occurring amino acid
  misc_feature (92)..(92): Xaa can be any naturally occurring amino acid
  misc_feature (116)..(116): Xaa can be any naturally occurring amino acid
  misc_feature (133)..(133): Xaa can be any naturally occurring amino acid
  unsure (1)..(178): unsure at all Xaa locations
HLKVPERAQNPRVFYPSKTKKNRFPKWVLKDKYLILDGEFLNLVKPXDPLXIFEDQKVISGLWTTKDHMQWRKYPRKENLEMPLRKWTHSPXKVGDLDRETRASVMMMIFHHRQKXWACQRCDGIDNTHRLKXVMGENQVMEFSNTNPGGRQLMNCVVVTLAVRFKNSVLLLKLTIIT

SEQ ID NO: 19999 - protein, 471 aa, Bacillus cereus ATCC 14579
MSNLLKKKSVTQLLEHNQSKTLTKTLGAFDLIMLGVGSIVGTGVLVLTGLVAARNAGPAVVFSFILAAIICGFIALCYAEIASTLPASGSVYTYSYATIGEFVAHLVGWSLLLIYIVATAAVAAGWTGYFHNLIKGFGLEIPKALVTIPSHGGIVNLPAVIITLILAWMLSRGTRESKRINNIMVLIKIGMILLFITVGIFYVKPMNWIPIAPYGLSGVFTGGAAILFAFTGFDILATSAEEVKDPKRNLPIGIIASLIICTIIYVMVCLVMTGMVSYKELNVPEAMAYVMEVVGQGKVAGAIAAGAVIGLMAVIFSNMYAATRVFFAMSRDGLLPKSFAKVNKKTGAPTFITGLAGIGSSIIAGFIDLKELVNLVNIGSLVTFALVCLSVIILRKSHPNLKRGFMVPFVPVLPCVAIVCCVFLMLNLPLRTWVYFSIWITIGVVVYFLYSIKYSNLNEETISKLHDKIAR

SEQ ID NO: 20000 - protein, 174 aa, Triticum aestivum
MAAAAPALPTFLRPRPRPPPPFPSSTPPLHRRRPPPSRLHPARPAVPLSPVSAVEKTKGAAAAADEVQLEGMPSEFYDEEWQANQRERTKEWHAYRQKEEAEEEAKSSEYREIGMRMKAYPQEEVCKARVLVSSFIRAGEDVENVIENAAERGELTELVLMVIWNRLDVARRDD

SEQ ID NO: 20001 - protein, 330 aa, Oryza sativa (japonica cultivar-group)
MTSGGDSFVRMMSEDTDVEVLMPNEDLRTSTNGAKGSAKRSSNYTRKEDIQLCISWQSISSDPIIGNEQPGKAYWQRIAEHYHANHDFKSDRNANSLEHRWGNIQKEVSKFQGCYNQTERRHPSGIPHQELVLEAEALYSSTAPKNRAFQFNHCWLKLRNSPKFQTLESHKRPRSRKSSTPIERAGEEDEGDDASKSTAPDLSQPSAKKRPIDRKQAKEKLKNGGEDGPYKEAMKDLLDAKEKEAKLKEERWKGTKEIQERKLLFAERKLVWDQEQKIMFCDVSTLEPDVRTYVLAMRAQIAASKVAALNGGFDGSSGFGGEFGGGNGEV

SEQ ID NO: 20002 - protein, 326 aa, Bacillus cereus ATCC 14579
MIKDSSVQVEGQEKVCLDQWVAHYRAYAAKGRSASYIPALGEINVSQLGICIVKPDGTMIKSGDWEIPFTLQSISKVIGFIAACLSRGISYVLERVDVEPTGDAFNSIIRLEIHKPGKPFNPMINAGAITIASLLPGTSVQEKLESLYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSRKDLSFQDGCGIGIYGPAIDEYGNSLPGIMLLEHIAKEWDLSIF

SEQ ID NO: 20003 - protein, 398 aa, Mycobacterium avium subsp. paratuberculosis K-10
MSSDASASNGIVIVGGGLAAARTAEQLRRSEYSGPITIVSDEVHLPYDRPPLSKEVLRKEVDDTALKPRQWYDDNDITLRLGSAARSLDTAAQTLTLEDGTTLGYDELVIATGLVPRRIPTIPDLDGIRVLRTFDESLALREHASAAQRAVIIGAGFIGCEVAASLRSLGVDVVLVEPQPTPLAAVLGEQIGELVARLHRAEGVDVRLGVGVAQVRGDTHVEAVVLTDGTELAADVVVIGIGSRPATDWLEGSGVAIDSVDRGVLCDEAGRTSAPNVWALGDVASWRDATGHQGRVEHWSNVADQARVVVPAMLGKEVPPVVVVPYFWSDQYDVKIQCLGEPEADDIVHIVEDDGRKFLAYYERDGALVGVVGGGMPGKVMKTRAKIAAAVPIAEMLG

SEQ ID NO: 20004 - protein, 303 aa, Saccharomyces cerevisiae; identical to SEQ ID NO: 860

SEQ ID NO: 20005 - protein, 279 aa, Campylobacter jejuni subsp. jejuni NCTC 11168
MQNILSSFAQEKNVCVFANTLKTSIEELEKEFLKQNLKFKKINVYCYLFDAKDKAILSSMKAFNEAHFYIQNYSSYLCALNLEVKAGQSVLDMCAAPGGKSINLANFMQNTGYLACNEMSRDRFFILQKNLKNYGVNAKVFMKDGKNIGNLCPLKFDKILLDAPCSTFAKIGFDLEKSYKEIKNIAKTQKKLLHSALKALKIGGELVYSTCTFTKEENEEVIENALKSEFKLELLDIDLENVEAKAGQSEEFAEISKCRRILPSLDYDGFFIAKLRKLC

SEQ ID NO: 20006 - protein, 227 aa, Oryza sativa (japonica cultivar-group)
MDATLLRSADAAVAVRSTTTAPPPRPRLHRPSTLPLPSSCACGPLRAYAAPAAPAPAAHNNGVYTVGDFMTKRPNLHVVTPATSVDEALETLVQHKISGFPVVDDTGKLVGVVSDYDLLALDSISGSGLTGTNTSMFPEVDSTWKTFREIQRLLSKTNGKVIADVMTYSPLAVRESTNLDAATRLLLETKYRRLPVVDSTGKLVGMITRGTVVRAALKIKKTAEETA

SEQ ID NO: 20007 - protein, 579 aa, Schizosaccharomyces pombe 972h-
MSAKDYDFDIESVLPEEKAPQVSEAKKDYISQESTVLSGQVDFVEPEHKGFFQNLIDGFKPAREADGNGGPALKRGLSTRHMQLMSIGGAIGSGLYVGSGSALADGGPASVIINYILIGIMMFFVIYALGEMAVAYPVAGSFNTYATRFIDPAWGFAVSWNYFFNYFVTFPFELTTCAITFTFWTDVNCAVWISIFLVVVIGINLFGVRVFGEVEFVLALIKVVATVGFIILAIIINCGGVPTDHRGYIGGSIIKQKPFRHGFKGFCSVYTTAAFSFSGTEIVGLAAAEVGDPRKTLPGAVKQVFWRVAIFYIVSLILIGLLISPDDPKLMGNGSASVSPFVLAIQEANIKGLPSVFNAVIIISVISVTNSSTYTAGRTLHGMANLKQAPAFFKYTDRLGRPLIAMIVVLSFGFFAYINEANNNGNDISDTVFDWLLAISGLSNFFTWGSICLSHIMFRLAFKKQGHSLKELGFVSPMGIWGSVIGLGFNILCLMAEFYVSLFPIGGSPNANDFFQGYLAACITLVFFIGYKIYDRSHIPSLDKLDITTGLKTYEYEETKDSSDTGRFRFFKKIINTVC

SEQ ID NO: 20008 - protein, 161 aa, Musa x paradisiaca
SSMMVSSAATVSRASPAQSSMVAPFTGLKSASAFPVTRKPNADLSHLPSNGGRVQCMKVWPIEGVRKFETLSYLPTMKDEALLKQIEYLLRSKWIPCLEFCPKGFVWRENHRSPGYYDGRYWTMWKLPMFGCTDAVQVAKEVEECKKEYPHAFIRIIGFDN

SEQ ID NO: 20009 - protein, 479 aa, Saccharomyces cerevisiae
MSAILSTTSKSFLSRGSTRQCQNMQKALFALLNARHYSSASEQTLKERFAEIIPAKAEEIKKFKKEHGKTVIGEVLLEQAYGGMRGIKGLVWEGSVLDPEEGIRFRGRTIPEIQRELPKAEGSTEPLPEALFWLLLTGEIPTDAQVKALSADLAARSEIPEHVIQLLDSLPKDLHPMAQFSIAVTALESESKFAKAYAQGVSKKEYWSYTFEDSLDLLGKLPVIASKIYRNVFKDGKITSTDPNADYGKNLAQLLGYENKDFIDLMRLYLTIHSDHEGGNVSAHTTHLVGSALSSPYLSLAAGLNGLAGPLHGRANQEVLEWLFKLREEVKGDYSKETIEKYLWDTLNAGRVVPGYGHAVLRKTDPRYTAQREFALKHFPDYELFKLVSTIYEVAPGVLTKHGKTKNPWPNVDSHSGVLLQYYGLTEASFYTVLFGVARAIGVLPQLIIDRAVGAPIERPKSFSTEKYKELVKKIESKN

SEQ ID NO: 20010 - protein, 393 aa, Chara vulgaris
MAKTKQIKNLTFNFGPQHPAAHGVLRLVLEMNGEVVERAEPHIGLLHRGTEKLIEYKTYLQALPYFDRLDYVSMMAQEHAYSLAVEKLCNCEVPLRAQYIRVLFCEITRILNHLLALTTHAMDVGALTPFLWAFEEREKLLEFYERVSGARMHASYIRPGGVAQDLPLGLSEDLFLFSQQFASRIDEVEEMLTNNRIWKQRLVDIGTVTAQQAMDWGFSGVMLRGSGVSWDLRKAAPYDVYDKVEFDVPVGTRGDCYDRYCVRIEEMRQSLRIIVQCLNQMPSGMIKADDRKLCPPSRSQMKQSMESLIHHFKLYTEGVSVPASSTYTCVEAPKGEFGVYLVSNGTNRPYRCKIRAPGFAHLQGLDFMSKHHMLADVVTIIGTQDIVFGEVDR

SEQ ID NO: 20011 - protein, 161 aa, Musa x paradisiaca
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 20012 - protein, 114 aa, Synechococcus sp. WH 5701
MAESETIFARILRGEIPCDQVHADELCLAFRDIQPQAPVHVLVIPREPLVNLADAEPRHQALLGHLLLVAAQVAKQEGLSSWRTVINNGAEAGQTVFHLHVHVIGGRPLLWPPG

SEQ ID NO: 20013 - protein, 161 aa, Musa x paradisiaca
SSMMVSSAATVSRASPAQSSMVAPFTGLKSTSAFPVTRKANADLSHLPSNGGRVQCMKVWPIEGKKKFETLSYLPTLVNEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 20014 - protein, 136 aa, Mannheimia succiniciproducens MBEL55E
MILKETIMATTIHTENAPAAIGPYVQAVDLGNLVLTSGQIPVNPATGEVPADISAQARQSLENVKAIIEQAGLTVADIVKTTVFVKDLNDFATVNAEYERFFKENDHPNFPARSCVEVARLPKDVGLEIEAIAVRK

SEQ ID NO: 20015 - protein, 451 aa, Mycobacterium sp. MCS
MARDAAEVEVMAKQLKEDGVRFSIAAYTDLHGNIKGKMVPIDHFVQMAGGSELFTGAALDGLPQDVSDEELSAHPDLDRGFVLPWRKDIALFLSDLYVGGEPFEASTRNILGRQMKAAEELGFVFNLGVETEFFVLEDGPVGPSALSERDTLEKPCYAVPMLLDNFGWLQELVDYMNELGWDVYSFDHEDAQGQFEIDFAYADGLSMADRVSFFRLMANEVARRHGAYVSFMPKPFADRTGSGAHFNMSLAGLDDGHNVFESADDPRAAGLSDIGYHFAAGIVRHAAAICAVIAPTVNSYKRLVRQGSMSGSTWAPIFASCGNNNRTNMLRIPLGGGRVECRAVDSAANPHLAAALLLAAGLEGVREQLELEHFHTDNLYEVDAGEYEKRGLSLLPRTLEEAVDAFEADPFTKQVCGEKLWQSFIDYKRSEWTSYATAVTDWERDRYLKFF

SEQ ID NO: 20016 - protein, 351 aa, Streptococcus agalactiae A909
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGPIGLSALLTAQFYCPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 20017 - protein, 456 aa, Crocosphaera watsonii WH 8501
MVAQSDSSNLHHVVIVGGGFGGLYAAQKLAKAPVKVTLIDKRNFHVFQPLLYQVATGGLSPADISSPLRALLSKNKNTEVLMGEVTEIDPEQQTVKLRYRDVKYDSLILATGVTHQYFGNDWEKNAPGLKTIENALEIRRKVFIAFESAEKEPNPERRKDWLTFVLVGGGPAGVELAGALAELAHGTLKEDFRNIDTSEAEIILLQSREHILPVYPPHLSLKARKSLEKLGVTVKTGVRVDDIRGQLVTYRDGDKLEQIRTRTVLWTAGMKASPIANMLAECADAQLDQAGRVIVEPDFHLAKYKNIFVVGDLAHYPDGEGGILPGIAPVAMQEGFYVARFIRNGIQNRPLKPFKYTDWGNLAVIGKHQAVVDMGWLKLSGFLAWFVWLFIHVFYLLEFDNKLIVMIQWAWSYFTDSKGARLITTPGKDPEIKLEDDHETIIYEATLNPTETSISL

SEQ ID NO: 20018 - protein, 108 aa, Lactobacillus reuteri
TDIAEVIGAAIALNLLFHIPLIPSVFITVLDVLVLLLLTKIGFRKIEAIVACLILVILFVFAYQVALSNPNWGGVFMGLLPSAKAIAQHPEIGGITPLTGTLGIIGAT

SEQ ID NO: 20019 - protein, 132 aa, Lactobacillus reuteri
IRQTVRFTTWDSNIQLSLAFIVNSLLLIMGVAVFKTGAVQDSSFFGLYDALNNTSMLSNPVLIAVAKSGVLSTLFAVALLASGQNSTITGTLTGQVIMEGFIHMRMPLWARRLVTRIISVIPVIACVAMTSG

SEQ ID NO: 20020 - protein, 1023 aa, Neurospora crassa
MTRRDAEVKDRCDTGRESPSTDGTGKSIFHVKPPALAALRFLHLLHLALTCFASAATVTTPSLYRPIRGYRFQHLLSISHVPVQHFPEGIQSRIFVAATSGHTEQTQPGVFGCLQRLDHACLQGHAQPTRPDPTRTHHPDPPPTVHGSVKAPAVCNGIHSRRQNSEKTPLARGKDTDTHSDTLLHHGQAALETAIPRLPKPARQALPVSPWTVLMSGATAPRLQNVLSRPVLSSKRDAGRTSSHHLLKSLLLASRFAASTLVATTSSAGASRSTGTSSPDPGPTINKSQTNRNPSTYTSPPNSLSRTFSASNLLAWYRTLPSPYFNLSGHLDDLSSLIRPFLAFLDPSSLSSPYSMASTSYAFSTSSGSDFSTPRSSSPHSSASVASARSSHSSTFSAGKRLSMSSVRRTSASNPMSSVDLSTIEEALKMANLDTLKGYCQKTYGEVHQETTTEYISQEEARGYQVLNQPHWNKVADFRISPKGTSFTPEERVAKNLTGLIPHVMEDSEKQVERALKMIRTRQTDIDRYLYLSTIKSQNVDLFYRLLMDHAKEMMPLVYTPTIGDVCLQYSTLYTRPEALYISIKQRKSIRTILRNWPYPQPEICVVTDGSRILGLGDLGVNGVGIPIGKLALYTAAAGIHPDKTLPIVLDCGTANETNLKDPLYLGLRQKRIPVAEQQEFMDEFMEAAAEVFPDMVVQFEDFESEKAFNYLDRYRDQYKCFNDDIQGTGAVVLAGYIGAVNLSNVPIEEQRLVFMGAGSAGVGVAKQLVEYYTKRGLSEQQAKDKFWLVDTKGLVTKDRGDKLAEHKKYFARTDNNGHQFRTLEEVIEYVKPSALVGLTATHGVFTESVVRALKASVDAGGLGRRPILFPLSNPLTKAECTFKEAIDWTDGTVLFASGSPFSSYTTNGVTYHPNQGNNVYVFPGIGLGAILAKATRVTDDMIYTSAAALANSLNADEVKQGLIYPRIDRVREASVIVAREVMKSARREGVSTLPEEQWLEWEEWGDVDLERYIKQHIYDPKF

SEQ ID NO: 20021 - protein, 1040 aa, Ostreococcus tauri
MLRRLDPLAPQDAHSKLFLCLLVLLNVVDAFHLNVVWPMLPFLVRDARGVVERDVGLYVGVIGAASPLGALCTSYVWGKVADARGRRPALIAGCAASTASVFVFGTAKTISQAFVGRFLSGCVNSNAQIVKTYLGETCTKQAQAEAFGVLALGYGLASALAPVAGGWLSRPAERWERLRGTIFETYPYLLPMLVAAMLTGLGAVLGWFFLPETASFVKRREAETNAKTEEEEKRLVKLASAGELRDIEMRQVGEWDDDACDAESSPKEVLFTPNTMRAAVCYATLAAIAIGYDEMLPVFLKTTRELGGCEFNSRDIGALLIVGGFTLLIFQLTIYKRICHALGAVRAFRLGVTLFAVVCMLAPFASVMPNDTALWIVALISQCTKICALGIGFVSITIVVNNSCEDAVKARVNGIAGTMAAFARIVAPVMCGSIFAATMRLSGKVPAHQFLPFAFVSAVTLALRVVAEKLPQCLDAPQISMPAPVREELIDIVDVDEKHRAPRRPAVSCNAPGAHYYPKHDANADDPPPTSNVEHGCRTSTTVARWIVAHDFDRVALQLPDDALPRAASLVRALDAAVRARRLEGETELCVLADTTFGSCCVDEVAASHRGAKAVVHYGRACCSPTSRVPARFVFDKRAIDVKTCARALRAHARTLGGRDAGTSPRCVVAVADQAYAHATAALREELRRDGDAASGVEIVIAESTTVEVDPRRDGAIETRVVDEGRERVGSASFERPPGVATDACAFVWIGGAGPSMTHAMLVLGERAERFGGVAQYDPEVDDEVRVEADGSSEAARALKRRRFLIAKAKEANVVGIVAGTLGVAGYREMIANLRKMIANSGRKSYTIVAGKPNPQKLANFPEIEVYIMVSCELTALMDSREYLQPIITPYEASIAFTSGKMWMGEVKLDFASVPKPDNASTSAGDDGDAGEPEFSLISGSLDVRNPVEHARAMTEEDTDAPNGLELARRAEDALALRASGAAAAVVTSGAEYLMSRRTYVGLEPGPKRDEETGELADAPLEAARGLSGRAAGYSDERAS

SEQ ID NO: 20022 - protein, 507 aa, Rhodococcus sp. RHA1
MLSDKTPLAGTTLGEVHHVAAPASQTSLPVRPRPESRPERHLVMTSTTATVTSRHRVAVIGSGFGGLFATKALRRAKVDVTVIDRTTHHLFQPLLYQVATGILSEGEIAPSTRMVLKDQPNATVVLGEVTTLDLSARTVTSVQDGRPTVTEYDSLIVSAGAQQSYFGNDHFAEHAPGMKTIDDALELRGRILAAFDHAELATDPDERAKLLTFVVVGAGPTGVEMAGQLTELAHRTLVGAYRNFDTRDARIILVDAAATVLPPFGTNLGTKAAAVLEKLGVEIRLGSTVTDVDADGLTVRDTAGENHRIDAVCKVWSAGVAASPLGAQLAEQAGAELDRAGRIAVEEDLTVPGHPNVFVVGDMMSRDRLPGVAQVAIQGGCYAAKQITYQVKALAEDRPVPDRTPFRYRDKGSMAIIARFKAVTKIGRLELTGFLAWVLWLAVHVVYVVGFRSRLATLLSWTWTLLGSWRGQLTSTHQQITARNAIAYLHYLERRIEDTDTEVAQAS

SEQ ID NO: 20023 - protein, 673 aa, Cryptococcus neoformans var. neoformans JEC21
MAQSADSACGPSNMVGSVHLADVQGVSREINPYDRNGMFVGAHTICRMFPSSLVPSFTHPAIVFQRPTPPPLAVPSSVQHASSATNSLSASQASQATSVLTDDEEDLEDYRPGGYHPVNIGDEFNNGRYRIVRKLGWGHFSTVWLARDNVANRHVALKVVKSDGHYTETALDEIQLLQRVVSSAPGHAGRHHVLDLLDSFRHTGPNGSHVCMVFEVLGENLLGLIKRYQHRGVPQHIVKQIAKQVLLGLDYLHRECRIIHTDLKPENVLICIDDVESVVQAELASCPAAVPTKLVGVPPSQGRLGNQTPRKDGIFIVGSQPLPSPSSSYSSSPMLDKYGFGMSKISGASAAKAGNQPSGVGGPSYPPTQPKKSATTEAIGTDLENVKLGEGSSLKWEKTATPAPAPPKGPSLLSQQLHHPPASPPLNPSVPSGSASVSTNHTINTATDETEVSTPATTPDHVTRLSDERAPEAGDPTTLPPPFPYDPVSLERITVKIADLGNACWVDHHFTNDIQTRQYRCPEIILGTRWDESVDMWSAACLFFELLTGDYLFDPQPGVKYDKDDDHIAQIMELLGEMPRSLALSGKYSHEIFNRRGELRHINRLRFWPLTSVLKEKYLMEHEDAELLSSFLMPMLAYLPGQRAKASDLLNHPWLEGVVVQGELEMAQSLHKS

SEQ ID NO: 20024 - protein, 227 aa, Shewanella sp. MR-4
MREQIKAIAFDLDGTLIDSVPDLAVATQASLAELGLATCTEAQVRTWVGNGAEMLMRRAMSHALGTDVEQTALDEAMPIFMHHYQENLEKHSALYADVHQVLQILFDAGFKLAVVTNKPYRFTLPLLEAFKINDFFSIVLGGDSLAKMKPDPLPLQHLLAEWQLDKSELLMVGDSKNDILAAKAAGVASIGLTYGYNYGEDIGLTGPDAVCEQFVEILRWLNLAQPV

SEQ ID NO: 20025 - protein, 254 aa, Robiginitalea biformata HTCC2501
MKQPKDLFSEQAADYRRFRPSYPANLLEDIIALVPDRQRALDCATGNGQVARALSPYFQQVNAIDISEEQLRQAPSAPNITYSRQRAEATGFANGTFDLICVAQAIHWFDIPAFHNEARRLLKPGGVLAVWGYGLLKTDPETDAWLDRYYRQVVGPYWEPERRYVEAAYANLPFPWEEIEMPGPYSIRREVALEDIAGYLYSWSATRHLLHTERDPVPEWMDQLAARWIPGSTREARHEIFLRAGRADVPDGDG

SEQ ID NO: 20026 - protein, 313 aa, Glycine max
MAPPRGRGGFGGGGGFRGGGRGDRGRGRGGGGRGGDRGTPFKARGGGRGGGGRGGGRGGGRGGGRGGMKGGSKVVVQPHRHDGIFIAKGKEDALVTKNLVPGEAVYNEKRITVQNEDGSKDEYRVWNPFRSKLAAAILGGVDNIWIKPGARVLYLGAASGTTVSHVSDVVGPTGVVYAVEFSHRSGRDLVNMAKKRTNVIPIIEDARHPAKYRMLVGMVDVIFSDVAQPDQARILGLNASYYLKAGGHFVISIKANCIDSTVPAEAVFESEVNKLKADQFKPFEQVTLEPFERDHACVVGGYRMPKKKKDAAE

SEQ ID NO: 20027 - protein, 323 aa, Saccharophagus degradans 2-40
MSTFDFIKSAQRTISMEVAAVTAMAQRIDSSFSQACEIILACQGRTVVTGIGKSGHIAKKIAASLASTGTPAFFVHPAEASHGDLGMITSNDVVIALSNSGSSSEMVALLPTLTRVGAKIISLCGKADSPLAQAANVNLDIWIESEACPLDLAPTSSTTASLVMGDALTVALLEARGFSAEDFAFRHPGGTLGRKLLLRVSDVMHAGDQVPKIHRAASLGETLSMMTAKGFGMTAVMDDSDKLVGIFTDGDLRRCVDKGINIGSAIVGDVMTPNPRTVQSRMLAAQALNLMETNKITALIVEDENQKAVGVLHMHDLLRAGLV

SEQ ID NO: 20028 - protein, 157 aa, Musa acuminata
VSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 20029 - protein, 520 aa, Lilium longiflorum
MSRHESRKLSDDYEVVDVLGKGGFSVVRRGISKSRGKNNDVAIKTLRRYGYTLPGAQRSQPGQRGLSPLGMPTLKQVSVSDALLTNEILVMRRIVEDVSPHPNVIHLHDVYEDANGVHLVLELCSGGELFDRIVAQDRYSESEAAEVVQQIASGLAALHKSTIIHRDLKPENCLFLNQEKRSTLKIMDFGLSSVEDFTDPIVALFGSIDYVSPEALSQRQVSSASDMWSLGVILYILLSGCPPFHAPSNREKQQRILAGDFSFEEHTWKTITSSAKDLISSLLSVDPYKRPTANDLLKHPWVIGDSAKQELIEPEVVSRLRSFNARRKLRAAAIASVLSSKVLLRTKKLKNLLGSHDMKSEELENLRAHFKRICANGDNATLPEFEEVLKAMKMNSLIPLAPRVFDLFDNNRDGTIDMREILCGLSNLRNSQGDDALQLCFQMYDADRSGCISKEELASMLRALPEDCVPADITEPGKLDEIFDQMDANSDGVVTFDEFKAAMQRDSSLQDVVLSSLRTI

SEQ ID NO: 20030 - protein, 756 aa, Haemophilus influenzae R2846
MSEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKDYAIEDNGWRKLGDAIPNADIFLGCSAAGALTQDMVKSMAAHPIILALANPNPEITPPEAKAVRPDAIVCTGRSDYPNQVNNVLCFPFIFRGALDVGATTINEEMKRAAVYAIADLALEEQNEVVTSAYGGEGATFGGDYVIPRPFDPRLIVRIAPAVAKAAMESGVATRPIQNWDAYVEKLTQFVYKTSLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKEHNPHLMIDGEMRGDLAMNEAHRKELMPDSPLKGSANLLVFPDLSASRISYSLLRGTTTAITVGPILMGMNKSAHILNPGASVRRIINMIAYAAVKAQQE

SEQ ID NO: 20031 - protein, 557 aa, Schizosaccharomyces pombe 972h-
MGRTLTSVLVVFISMAGWLGGADTGSISGILGMRDFQSRFADRYNPITNSYSYSAWRQALLTGTVNAGCLFGAMLSSPFTEAIGKKYSIAFFSGCYIIGQILLVTAVPSWVQIMVGKLFTGLTIGALSVLSPGYQSEVAPPQIRGAVVSTYQLFQTCGTLIAACINMGTHKLRKTASWRTSFGINILWGIFLMVGVLFLPESPRYLIYKGRDEEALRIMCQTAELDPESEIIQTNFNTIKSDIEMEMAGGKARWPEVFGKEVRYRTVLGFLTMLLRELIGNNYYFYYATQVFKGTGMTDIFLPAVILGAINFGTTFGALYTIDNLGRRNPLIFGAAFQSICFFIYAAVGDRKLIYKNGTSDHRAGAVMIVFSCLFLFSYCCSWGPMGWVIVGETFPIRYRSKCAAVATSGNWLGNFMVSFFTPFISNSIGFKLGYIYACINMTSAFQIFLMAKETKGLTLEEVNELYESDIKPWDSYKYVRQIESRRIHFSKEEEKREREKSKGYRGQEERFIENADGADNDDSSASSESFASAGAHSRSVFPRRSNVSEESHPTWV

SEQ ID NO: 20032 - protein, 161 aa, Musa acuminata
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDK

SEQ ID NO: 20033 - protein, 527 aa, Pisum sativum
MEYGTRKLSDVYEVSEILGRGGFSVVRKGTRKSNNDDEKSQSQSKSQSQSQVAIKTLRRLGTSNNLPRKKDGGENSTETMMKFPTMRQVSVSDALLTNEILVMRRIVENVSPHPNVIDLYDVYEDTNGVHLVLELCSGGELFDRIVAQDKYSETEASTVVHQIVAGLEAIHRANIIHRDLKPENCLFLDVGKDSSLKIMDFGLSSVEEFTDPVVGLFGSIDYVSPEALSQGKITTKSDMWSLGVILYILLSGYPPFIAQNNRQKQQMILNGNFSFYEKTWKGISQSAKNLISSLLTVDPAKRPSAQELLSDPWVKGEKAKDDQMDPEIVSRLQRFNARRKLRAAAIASVWSSTIFLRTKKLKSLVGSYDLKEDEIENLRMHFKKICADRDNATLCEFEEVLKAMKMPSLIPFAARIFDLFDNNRDGTVDMREILCGFSSLKNSKGEDALRLCFQMYDTDRSGCITKEEVASMLRALPYDCLPTDITEPGKLDEIFDLMDANSDGKVTFDEFKAAMQRDSSLQDVVLS

SEQ ID NO: 20034 - protein, 628 aa, Coccidioides immitis RS
MADKEAIRHDSVSGFDRRESVAAMSQNLTGEIRNPLSDIPKDQLLRDVENFASKKNMTDILPLLQKGALVAQNPADFENIPELDESDREALRNEVTHRWRHPWALYYTIGLNSIAAAIQGWDQTGSNGANLSFPVEFNIPDSGCSDEALCDRNAWIVGFVNSIPYISIALFAGWLSDPINDWIGRRGTIFIAAIFSLLAPIGSAVTQNWPQLVVCRIMLGIGMGLKEVTVPVFSAENTPANVRGGLVMSWQVWTAFGIFLGTCANLAVVNVGAITWRLQLGSAFIPAVPLVLGIYFCPESPRWLLKKDKYAQAYASLLRLRNTPLQAARDLYYVHAQLVHEEVVLEESGLSKRNNMLTRFIELFTIPRIRRATQASGIVMIAQQMCGINIIAFYSASIFEQAGASNIEALLASFGYGLINFLFAWPAVWTIDTFGRRGLLLFTFPQMFWTLLAAGMCFFIPESSKAHLGLIAFFIYLFAAFYSPGEGPVPFTYSAEVFPLSHREIGMSWAVATNNFWASVLALTFKRLIRAFTPPGAFGFYAGLNIVALILIFLFLPETKQRTLEELDYVFAVPTRTHAKYQLTKVLPWWFKRYILMRKHAVCPELYHLDAPGHVNQRREEHAGVSKA

SEQ ID NO: 20035 - protein, 184 aa, Oryza sativa (indica cultivar-group)
MRGGEMLTASRGAGASSSTAAAAATVDLAGRAGAGAGGGGGNFPLAVALIAFAFANFLNLLAIWLKEKRWDARKFLTSAGIISSLSATVGSLAVAVGQQEGGDSSSFALALVFAAVVMYDASGIRFHTGRQAALLNQIVSDFPPEHPIISSFRPLREPLGHSPFQVFAGALVGCSIAYLMGKSV

SEQ ID NO: 20036 - protein, 406 aa, Oryza sativa (japonica cultivar-group)
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 20037 - protein, 435 aa, Rickettsia akari str. Hartford
MTNDNDSDSEFAELKIRGKIFQLPILKASIGEDVIDISRVSAEVNCFTYDPGFMSTASCKSTITYIDGDKGILRHRGYNIKDLAEKSDFLEVAYLLIYGELPSIEQYNNFTKQVAHHSLVNERLHYLFQTFCSSSHPMAIMLAAIGSLSAFYPDLLNFKEADYELTAIRMIAKIPTIAAMSYKYSIGQPFVYPDNSLDFTENFLHMMFATPCTKYKVNPIIKNALNKIFILHADHEQNASTSTVRIAGSSGANAFACISTGIASLWGPAHGGANEAVINMLKEIGSSENIPKYIAKAKDKSDPFRLMGFGHRVYKNYDPRASVLKETCKEVLKELGQLENNPLLQIAIELEAIALKDEYFIERKLYPNVDFYSGIIYKAMGIPSQMFTVLFAIARTVGWMAQWKEMHEDPGQKISRPRQLYTGYVHREYTGIGER

SEQ ID NO: 20038 - protein, 653 aa, Neurospora crassa
MDAKPQRPLWAPPVRYGDENIPPADPTHQSKRSDSKIKAMMAVNGTLNAPPKRAACFDKSNTSKPLADGGNKDMLKNRVKPMVTTSSTRDLRSDGRENNRSAAEEHYMRPTATSKAASHGHQKYSSTAPLSSHAASGAYGGIRSHNAIAKLSAPVKKTTNVYRDNKVKEESTSHAPTSSSVDDLVAMVDKHIKDPRHYKSQPQLKSDQQHTLHRNQSKYVPNYENLNDVDDPDDSNADYAESYEDAVEQLSRDLDIPANTDPAAIVHANHMSIAQASYDSMPQGAPLAPSKPVRALPLPPNVSDPEEYSEDDDDQDLYDDQGYTTAHSYRSHCDNTTGGPPTLVAPKFTADIQKELDIAKAWVLEHQTEEEVEEENWDVSMVAEYGDEIFEYLRELEERMLPNPHYMDIQTEIRWSMRSVLMDWLVQVHHRFSLLPETLFLTVNYIDRFLSVKVVSLGKLQLVGATAIFVAAKYEEINCPSIQELVYMVDQGYSVEEILKAEKFMLTMLNFELGWPGPMSFLRRISKADDYDLETRTLAKYLLEVTIMDERFVGCPASYLAAGAHCLSRFFLQRGPWTHAHVHFSGYTLAQLRPLIISILDCCQEPRKHHGAVYDKYSHQRFKSASTFVEGKIANGFVLPIRTNASISDSAQS

SEQ ID NO: 20039 - protein, 190 aa, Oryza sativa (japonica cultivar-group)
MEADKSGEGEKAGGKTISFRCSDGQAFHMPVAAAMLSTAIRKMFDKYPSIDHGGVIELPHQISSGIFPKVKEYCTKHAKVDDKGNPTVSTNTGAAAAASSSSTDDEEEDLKNWDKEFVNMEVKPLHDLLLVAHLLDIKGLFHITCRKVADMLKGKTSEEMRQILNIRNDFTEEEDKAIKEQNPWVFPDPE

SEQ ID NO: 20040 - protein, 291 aa, Methanococcoides burtonii DSM 6242
MFEGVLPALITPFTKDDTIDRTGLIKNIEFAENGKVTGVVVCGTTGESATLSTAEHMEVIDIAVECANVPVVAGTGSNNTAEAVELTKHAEEAGASGALVISPYYNKPNKAGLISHFRTIAEAVEIPIVLYNVPSRTGQDISLEVITELAKIDNIVGIKEASGNLDKASQIIENTMDEDFKVTSGDDGLTLPIMSIGGCGVISVVANIVPDRMSRLVNAFNEGDTATAQQLHYEIAPLIRALFTETNPVPIKRAMNLVGLNAGHLRPPLAPISAENNKLLANCLKELGCLQ

SEQ ID NO: 20041 - protein, 248 aa, Bacteroides thetaiotaomicron VPI-5482
MEKYGLIGYPLRHSFSIGYFNEKFRSEGINAEYVNFEIPNINDFMEVIEENPNLCGLNVTIPYKEQVIPFLNELDRDTAKIGAVNVIKIIRQPKGKVKLVGYNSDIIGFTQSIQPLLQPQHKKALILGTGGASKAVYHGLKNLGIESVFVSRTHKTDDMLTYEELTPEIMEEYTVIVNCTPVGMYPKVDFCPNIPYELLTPNHLLYDLLYNPNVTLFMKKGEAQGAVTKNGLEMLLLQAFAAWEIWHR

SEQ ID NO: 20042 - protein, 382 aa, Haemophilus influenzae R2846
MAKKDYYEVLGLQKGASEDDIKRAYKRLASKHHPDKNQGSKEAEEKFKEINEAYEVLGDDQKRAAYDQYGHAAFEQGGGTGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKTCRSCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVTSTRSGYAGDLICRIVVETPVNLTSEQKELLQKLEESLQGKDLSKHAPKSSGFLDGVKKFFDNLGKSDK

SEQ ID NO: 20043 - protein, 985 aa, Oryza sativa
MTRVIHDSGEGMQKEALAMVSSDVNFPKGHFPDYKIGPNNQIIDPEEIHEAVPLKEIVAKETAQLLEQRRRLSVRDLKEKFEKGLSGASKLSEEAKRREAASLDRQVLLKKLRDVLDTLKGRVAGRNRDDADEAISLVEALAVQLTQREGELIYEKAEVKKLASFLKQATEDARKVAEEERALALAEIEKARTAIAIVEKGLQEHDAASSSREKEEIEGLRKEVREARRIKMLHQPSKVMDMEFELKALRTLIAEKNQLCNQLMKELAMIKRLEEDSSDLYDLEGSDILGSQFCIIPRFDDAPDISSCPTQWYRVISGGNRNLILGATKPTYAPEPFDVGRLLQAEIVLNAEKVTIQTMGPINPAAGLEHYVESLMKRADVEFNVVVTQMNGNDYSSNSVHAFHIGKMRIKLRKGWSTKARESYSTTMKLCGSRGGGNAAATAVFWQARKGLSYTLAFETDRDRNAAIMLARKFASNCNITLTGPGDEVHAELAGAAVAAALDGGEEGSRAARLHSFFASVISGIFGQGEEEEEGEMATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 20044 - protein, 423 aa, Schizosaccharomyces pombe 972h-
MEYLTNLKTNIMDKQLGHREVSEGSTQPKPDPSGATMKACVWDGPLNVKIAEVPKPTITHPKDVIVKTTACTICSGSDSHIFSGEMPGIEKGAILGHESCGIVAEKGDEVNNLEIGDRVVIAFDLACGQCSFCKRHEYAACDTTNDSKLMDVNYGSHHSAIFGYTKLLGDVPGCQAEYIRVPFAEINCCKLPDDIPDSEGLFMSDVLCTSLHACTLGEVKKGDTVAIWGMGPIGLYAGRWAQILGASKVIGIEVVPERIELARQKFGFTVIDRNEVSDVPKKIMELVSNGVDCAIEASGFRFSTSILHKVERAVGLETDSPDMITECLNAVRKYGHVSIIADYVGTSNQFPIGHVVMKHLTIRSGQCPCQNYFGYVIDNIRSGKIDPRWMVTNKIKFDDLPDAYNKLFYKEDGYVKVYCDMTE

SEQ ID NO: 20045 - protein, 201 aa, Triticum aestivum
DGAAKAASRILPENVAKILSQKGTIERVLTCGNASDVLKCAFDLTEAALNHQYEGCTATALLIWFDQNKDCFAQCANLGDSACIMNVDGKPIAMTEDHRVVSTTERARIAKLGNPLKDGESRICGLNLCRMLGDKFLKEQDPRFSKEPYVSPVVQISKSCSAFALIASDGLWDVITAKKAAQLVLDYKERNLGPRNLKRTE

SEQ ID NO: 20046 - protein, 232 aa, Saccharomyces cerevisiae
MSLFEWVFGKNVTPQERLKKNQRALERTQRELEREKRKLELQDKKLVSEIKKSAKNGQVAAAKVQAKDLVRTRNYIQKFDNMKAQLQAISLRIQAVRSSDQMTRSMSEATGLLAGMNRTMNLPQLQRISMEFEKQSDLMGQRQEFMDEAIDNVMGDEVDEDEEADEIVNKVLDEIGVDLNSQLQSTPQNLVSNAPIAETAMGIPEPIGAGSEFHGNPDDDLQARLNTLKKQT

SEQ ID NO: 20047 - protein, 400 aa, Staphylococcus aureus subsp. aureus Mu50
MRIVQPVIEQLKAQSHPVCHYIYDLVGLEHHLQHITSSLPSNCQMYYAMKANSERTILDTISQYVEGFEVASQGEIAKGLAFKPANHIIFGGPGKTDEELRYAVSEGVQRIHVESMHELQRLNAILEDEDKTQHILLRVNLAGPFPNATLHMAGRPTQFGISEDEVDDVIEAALVMPNIHLDGFHFHSISNNLDSNLHVDVVKLYFKKAKSWSEKHRFPLKHINLGGGIGVNYADLTSQFEWDNFVENFKTLIVEQEMEDVTLNFECGRFIVAHIGYYVTEVLDIKKVHGAWYAILRGGTQQFRLPVSWQHNHPFEIYRYKDNPYSFEKVSISRQDTTLVGQLCTPKDVFAREVQIDAISTGDVIVFKYAGAYGWSISHHDFLSHPHPEFIYLTQTKEDE

SEQ ID NO: 20048 - protein, 161 aa, Musa acuminata
SSMMVSSAATVSRASPAQSSMVAPFTGLKSTSAFPVTRKANADLSHLPSNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 20049 - protein, 180 aa, Musa acuminata
MVSSMMVSSAATFTRASPAQSSMVAPFTGLKSASAFPVTRKPNADLSHLPSNGGRVQCMKVWPIEGVKKFETLSYLPTLKDEALLKQIEYLLRSKWIPCLEFCPKGFVWRENHRSPGYYDGRYWTMWNLPMFGCTDAVQVAKEVEECKKEYPHAFIRIIGFDNNRQVQCVSFIAYKPTGY

SEQ ID NO: 20050 - protein, 401 aa, Triticum aestivum
MVVVMEKGMEMERRAYARVGLLGNPSDVYGGRAVSFAVAGLWATVRLRPSDQLLVQPHPRHDLVAFPSLHALVERLDGGGYYGGVRLLLAICRIFHNHCKHNGIALEDKNFTLSYDTNIPRQAGLSGSSAIVCAALSCLLDFYGVRDKIRVEVRPNLILNAEKELGIVAGLQDRVAQVYGGLVYMDFSQEHMDKLGHGVYTPLDVDLLPPLYLIYAENPSDSGKVHSSVRQRWLDGDEFIISSMKEVAQLAYDGHNALLQKNYSELARLMNKNFDLRRKMFGDDALGELNIKMVEVARSIGAASKFTGSGGAVVAMCPDGDAQAELLKTACQEAGFGWSRLSRPVGADKGGAGKLIKSPVAKRISYIQIYALPPELVVLDSSRYVCIRHVLVSGTFVSRQI

SEQ ID NO: 20051 - protein, 337 aa, Zymomonas mobilis
MKAAVITKDHTIEVKDTKLRPLKYGEALLEMEYCGVCHTDLHVKNGDFGDETGRITGHEGIGIVKQVGEGVTSLKAGDRASVAWFFKGCGHCEYCVSGNETLCRNVENAGYTVDGAMAEECIVVADYSVKVPDGLDPAVASSITCAGVTTYKAVKVSQIQPGQWLAIYGLGGLGNLALQYAKNVFNAKVIAIDVNDEQLAFAKELGADMVINPKNEDAAKIIQEKVGGAHATVVTAVAKSAFNSAVEAIRAGGRVVAVGLPPEKMDLSIPRLVLDGIEVLGSLVGTREDLKEAFQFAAEGKVKPKVTKRKVEEINQIFDEMEHGKFTGRMVVDFTHH

SEQ ID NO: 20052 - protein, 180 aa, Musa acuminata
MASSMMVSSAATVSRASPAQSSMVAPFTGLKSTSAFPVTRKANADLSHLPSNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDNNRQVQCISFIAFKPPGY

SEQ ID NO: 20053 - protein, 371 aa, Bacillus anthracis str. Ames
MSKRDYYEVLGLSKGASKDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLEFEEAIFGKELNVEIPVEDPCDTCKGSGAKPGTSKETCKHCSGSGQVSVEQNTPFGRIVNRQACSHCSGTGQMIKEKCTTCHGSGKVRKRKKINVKIPAGIDNGQQIRVSGKGEAGVNGGPAGDLYVVVHVRSHEFFEREGDHIICEMPLTFAQMALGAEVEVPTVHGKVKLKIPAGTQTGTEFRLKGKGAPNVRGYGQGDQYVVVRVVVPTKLTSHQKDLLREFAGQEEQDDSLFGKLKRAFKGE

SEQ ID NO: 20054 - protein, 125 aa, Zea mays
MGFIMDFAENLILRLMEDPDKRDQVRREHVYKMKERCERTKAAWSLPLRPYGFWTFDRFNSQLSWDPQISQAAGRRDPYDDLIARHSGLAAVFLNTRSVCCLGNQMVAFEFSEAEFIHDDGALKL

SEQ ID NO: 20055 - protein, 454 aa, Clostridium difficile 630
MGVITLSKYQKNVSMFDIDGRPPILKCLPLSMQHILAMIVGTVTVPIVVGGAVGVSPTQITLLVQYALIIAGISTLIQLYPIGNIGSRLPIIFGVGFTYVPTLVAVGGNYGLASILGAQLIGGVATVLIGIFIKKIRKFFPNIVAGTVVFTIGLSLYPIAINYMAGGVNSPTYASMQNWAVAAITLVVVIGLSQFAKGYAKLAAIFLGIIVGYCVSLVLGIINFDPIREATWFAIPKPLEFGMEFDMPVIISVVIVSIINAVQAIGDLSATTMGGMDRNITDKELSSGVIGSGICTMIGALFGGLPPSSYSQNVGMVAMNKVISRFVLGIAGIFMLLSGFVPKFGALMTTIPYSVLGGATISIFSMITMTGIKLIITEELSSRNITIVGLAIALGMGITSVPAAQEAFPSFVKLVFGESPIVIATLVAFVLNLIIPNKSLEDEAKERAVMEETN

SEQ ID NO: 20056 - protein, 346 aa, Oryza sativa
  misc_feature (220)..(220): Xaa can be any naturally occurring amino acid
  unsure (1)..(346): unsure at all Xaa locations
MKYILYIPVFVIGMILEGLEIEGQTVWKNPTGYLPGRMAPLKNFFAIMSFAFVVLGIYWFYQYMKFWREVLPLQNCITLVITLGMLEMSLWYFEYAEFNETGVRPKGITFWAVTFGTVKRTVARVIILIVSMGYGVVRPSLGGLTSKVVMLGGTFFLATEILELVENLGAVNDLSGKARLFLVYPVAILDAAFVVWIVISLAKTLDKLQARRSMAKLDIXYRKFTIALAVTVLVSIGWIGYEIYFKSTDVFNERWQYAWIIPAFWHVLSFSLLCVISYLWAPSQNSMRFTYDASENFDREDSLSLIRPGPIASKNGWSLSSSPDTKATKNVTVTSFDGDDEENKRE

SEQ ID NO: 20057 - protein, 115 aa, Salmonella enterica subsp. enterica serovar Typhi str. CT18
MSNIIKQLEQEQMKQNVPSFRPGDTVEVKVWVVEGTKKRLQAFEGVVIAIRNRGLHSAFTVRKISNGEGVERVFQTHSPVVDSIAVKRRGAVRKAKLYYLRERTGKAARIKERLN

SEQ ID NO: 20058 - protein, 86 aa, Bordetella pertussis Tohama I
MQKVVMYSKDYCPYCARAQALLKQRGVADLEIIRIDQDPSQRDIMIERTGRRTVPQIFIGETHVGGSDDLQALDRSGGLLPLLNGG

SEQ ID NO: 20059 - protein, 63 aa, Zea mays
QKKIWDALRVPPESDLALAQPFVDSAGIIVSNPDMTLCYAKKGPKSHLPKFVLSEPATLIPAG

SEQ ID NO: 20060 - protein, 163 aa, Zea mays
MAMGLINANPIIHEKKERRARQAPETTDENAAEPIDQLEIFDILLNDFFKYIKDPEHPYSLEQLNVVTEDSIELNDESNYVRVTFTPTVEHCSMATIIGLCIRVKLVRSLPPRYKVDIRVAPGSHATEAAVNKQLNDKERVAAALENPNLLDMVEECLSPTFD

SEQ ID NO: 20061 - protein, 321 aa, Silene conica
RKFKTIIHPGEVNRIRELPQNSNIVATHTDSPDVYIWDLESQPNRPVNLGTPASRPDLTLTGHQDNAEFALAMCSSEPLVLSGGKDKSVVLWSIHDHISTLATEPGSAKSTNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADNSINLFDRRNLTASGVGSPAHKFQGHDAPVLCVQWSPHNKSIFGSAADDGLLNIWDYEKVSKMETEIGGKKSNHPAGLFFRHAGHRDKVVDFHWNSIDPWTLVSVSDDCSSSAG

SEQ ID NO: 20062 - protein, 314 aa, Oryza sativa
MGVYLSTPKTEKYSGEGGNDRLRYGLASMQGWRTTMEDAHTALPRLDECTSFFGVYDGHGGKAVSKFCAKHLHLQVLKNEAYSSGDLATSVLKSFFRMDEMMKGQRGWRELAELGDKGQKFTGMLEGIIWSPKPGESDKPEDTWTEEGPHSHFPGPTSGSTACVAIIRNDELIVANAGDSRCVLSRKGRAYDLSKDHKPDLDAEKERILNAGGFIVAGRVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPK

SEQ ID NO: 20063 - protein, 250 aa, Bordetella pertussis Tohama I
MYKLVLMRHGESQWNLENRFTGWTDVDLTETGREQARKAGELLKREGYAFDLAYTSVLKRAIRTLWIALDAMDAMYTPVGINWRLNERHYGQLQGLNKAETAAKYGDEQVLIWRRAYAIAPEPLDLEDPRHPRFDGRYAKIPADQLPATECLKDTVARVLPFWNESIAPAIRAGRRVLVAAHGNSLRALIKHLDNVSDDDIVGVNIPTGQPLVYELDEDLKPIRHYYLGDAAEIEAAMAAVAAQGKAKKD

SEQ ID NO: 20064 - protein, 600 aa, Zea mays
VYPTRDDNGNLLVTEYGMCEYKDHQTLSMQEVPENSAPGQLPRTVDVIVEDDLVDCCKPGDRVSIVGVYKALPGKSKGSVSGVFRTVLIANNVSLLNKEANAPVYTREDLKRMKEISRRNDTFDLLGNSLAPSIYGHLWIKKAVVLLMLGGVEKNLKNGTHLRGDINMMMVGDPSVAKSQLLRAVMNIAPLAISTTGRGSSGVGLTAAVTSDQETGERRLEAGAMVLADRGVVCIDEFDKMNDQDRVAIHEVMEQQTVTIAKAGIHASLNARCSVIAAANPIYGTYDRSLTPTKNIGLPDSLLSRFRLLFIVLDQMDPEIDRQISEHVARMHRYCTDDGGARSLDKEGYAEEDDGDANAAIFIKYDRMLHGQDRRRGKKSKQDRLTVKFLKKYIHYAKNLIQPRLTDEASDHIATSYAELRDGSANAKSGGGTLPITARTLESIIRLSTAHAKMKLRHEVLKSDVEAALQVLNFAIYHKELTEMEEREQKEMEMKQQAEHDAGATGGTVDGHGSSGNDPMDVDVGSNDQNVSAERIEAFEALLGQHVLANHIDQMSIDEIEQMVNRESTAPYTRSQVEFILERMQDANRVMIRDGVVRII

SEQ ID NO: 20065 - protein, 94 aa, Arabidopsis thaliana
  misc_feature (10)..(10): Xaa can be any naturally occurring amino acid
  misc_feature (24)..(24): Xaa can be any naturally occurring amino acid
  misc_feature (33)..(33): Xaa can be any naturally occurring amino acid
  misc_feature (77)..(77): Xaa can be any naturally occurring amino acid
  unsure (1)..(94): unsure at all Xaa locations
KGASEVVSVXAPTAAARELLFEEXEDVFEEERXMEREKEEEKEREFVVHVPLPDEKEIEKMLLEKKKMDLLSKYASXDLLEHQTEAKSILNIHR

SEQ ID NO: 20066 - protein, 570 aa, Aspergillus nidulans FGSC A4
MVGSTLAMRSNAMQLSSLSRRSLTTRSPVQALRSSQSLSLRTARRPYSDAAPLPAPKPKKRFRFLRWTWRLTLLAGVGLAGNLAYNIYDQRHPTEQFVPDPSKKTLVILGTGWGSVSLLKKLDTENYNVVVISPRNYFLFTPLLPSCTTGQVEHRSIMEPIRSILRHKKAHVKFYEAEATKVDYEKRIVYISDDSEIKGDISHTEVPFDMLVMGVGAENATFGIKGVKENSCFLKEVGDAQRIRKRIMDCVETAMFKDQSEEEIKRLLHMVVVGGGPTGVEFAGELQDFFEHDLRKWVPEIQENFRVTLVEALPNVLPMFSKQLIDYTESTFKEESITIRTKTMVKNVTDKYIEAEVTKPDGTKELETIPYGLLVWATGNAIRPIVRDLMSQLPAQKNSRRGLAVNEYLVVNGTENVWAVGDCAITNYAPTAQVASQEGAFLARLFNTMAKTEAIEKELQRLSEAQSAAKSEEERNKIFDEIRDHQRQLRRTKQIGPFQYSHQGSLAYIGKERAVADISWLSGNIASGGTMTYLFWRSAYLSMCFSTRNRVLVALDWVKAKLFGRDVSRE

SEQ ID NO: 20067 - protein, 344 aa, Schizosaccharomyces pombe 972h-
DLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 20068 - protein, 181 aa, Musa acuminata
MASSVMVSSAAAVVSRASPAQSSMVAPFTGLKSTSAFPVTRKANADLSHLPSNGGRVQCMKVWPIEGKKKFETLSYLPTLVDEVLLKQIEYLLRSKWIPCLEFSHEGFVWRENHRSPGYYDGRYWTMWKLPMFGCTDATQVAKELEECKKEYPRAFVGIIGFDNNRQVQCISFIAHKPDGH

SEQ ID NO: 20069 - protein, 273 aa, Schizosaccharomyces pombe 972h-
MSVYQTREGLPSGWVAQWDAEYGTYFYVNESAQNPQPQWEPPVENLKLAPPPGATSVNTAVYNNNNNTSAANTNAAYNANTAANANANTATTTNAAATTSAAYNPNAPANTNAAYYPNAAATTTTNADGSDKGLFSGLTSSNGYTTGNSYSRPSYVAPVAAGLGGLALGGLASHALGNLFHHRGHNGGGFGGFGGGSGGPPPGPGGFGGFGGFGGEGHHHGGHGGFGGGPGGFEGGPGGFGGGPGGFGGGLGGFGGGPGGFGGGPGGHGGPGW

SEQ ID NO: 20070 - protein, 1579 aa, Saccharomyces cerevisiae
MSHSDYFNYKPYGDSTEKPSSSKMRQSSSSSSSRLRSESLGRNSNTTQARVASSPISPGLHSTQYFRSPNAVYSPGESPLNTVQLFNRLPGIPQGQFFHQNAISGSSSSSARSSRRPSNIGLPLPKNPQQSLPKLSTQPVPVHKKVEASKTESEIIKKPAPVNSNQDPLLTTPTLVISPELASLNTTNTSIMSTPQNITNQTSNKHIPTRSQPNGSTSSSTLQDIVTTNSSQRSVGHHGGSTTSLRTYKKQYVLNEQLYLRKMRNRANDDYYTRGIVASSNFEDDEENFSNKGEDDLELEMDDLLKVEGEDKDNDFNFGYNFITSSTKNNENVVSMSLNYLKGKLDWLRDVNNDQPCEIEDEEWHSILGSEDLLSKLLQNPMVNNRFEWQTMLSKVLKGDIVRNEKTKIANQGKGPGFNTQFSDDIWIELKAWMNGRTVEDQNKSLRIFRDSTDSVFQEIMAFKLEDNMSADEAAETIKSLVDKYYRVLNLWPNIKRMHAEKPITKTEAFRNRIDTLNSWLNFKFNFDTNIAYLKKWIVGNKELESTTEVDNTTVNLDDPAVFATNCKRFAEQIMKEKDIELIFQKKIFFPLAPWILKAKFFFLKYQKTWNELNLSYLDQDLEFLLMFPMRLVKDIILIRLSYAKKIQNPTLMMIDQMMDDFSTYIKLAVQMKFTVASYCNDWFFKVKIDPEFDHTVVEGLEYFFSILELRILYSGKNSFKTSKEPDLLLKYWEMFRNVGYYIDDAGELIAAEFTKLTLRLVHRLHAYLLRQQNTPPKLENEAAAEKWLVQIFEILGSMKRKLNRFTNILTKAFQNFVRYKIEDHNYLLKQLKETGHFLIYTGGYLEQNGTYLIGSPELLGCKDDDILRIIKNSDIGCDLVPKLEINNSLTIYNALDDNWNSNSSLGSDISNDGTPFYYIKNDLTTQPRSYNGNRVNREPDFENSRSTEEEFYELETRLNSLGYVLVLTPQEPLLWEGEMYNLSDNKTIKPEGLNLKVIPNSIDLMCQGSSYALEYQCDRFQQISGSSVSFLEKKSSSETVKNNLQRINKAYFRCTYSVLKNYTKIVTTFKKVSPVNDLLNNIFLFGRDFGLNFLRINVANNEKRSIIILLMMRLSIGWLKFLAEDCDPTDQRVFRWCVTSMEFAMHMVSGWNILALDECQFSSLKQKISECMSLLISHFDIIGARSIEVEKINQQARSNLDLEDVFDDDMMLQVNSEFRVQSIMELEERIKRNPHQTGKVIDDSDKGNKYLVSLASSISNVSMRWQKRNFIGGGTFGRVYSAVDLDNGEILAVKEINIQDSKSMQKIFPLIKEEMSVLEILNHPNIVSYYGVEVHRDKVNIFMEYCEGGSLAALLEHGRIEDEMVTQVYTLQLLEGLAYLHESGIVHRDVKPENILLDFNGVIKYVDFGAAKKIANNGTRLASMNKIENADGEHEDVTHVSDSKAVKNNENALLDMMGTPMYMAPESITGSTTKGKLGADDVWSLGCVVLEMITGRRPWANLDNEWAIMYHVAAGHTPQFPTKDEVSSAGMKFLERCLIQNPSKRASAVELLMDPWIVQIREIAFGDDSSSTDTEERE

SEQ ID NO: 20071 - protein, 428 aa, Zymomonas mobilis [sequence omitted]

SEQ ID NO: 20072 - protein, 271 aa, Streptococcus agalactiae A909
MKKKLKTFSLILLTGSLLVACGRGEVSSHSATLWEQIVYAFAKSIQWLSFNHSIGLGIILFTLIIRAIMMPLYNMQMKSSQKMQEIQPRLKELQKKYPGKDPDSRLKLNDEMQSMYKAEGVNPYASVLPLLIQLPVLWALFQALTRVSFLKVGTFLSLELSQPDPYYILPVLAALFTFLSTWLTNKAAVEKNIALTLMTYVMPLIILVTSFNFASGVVLYWTVSNAFQVFQILLLNNPYKIIKVREEAVRVAHEKEQRVKRAKRKASKKRK

SEQ ID NO: 20073 - protein, 162 aa, Triticum aestivum
MLQVEDVPGELRASSSSTVAAAGTGECSLQKSVSSGCLNSGDWMNGSAVRPNFLDFQGLDFEAAFGLRRAYSEGDIQKLGANNPRPGIAGNVQASGERLVTISDLKSEERKQKLNRYRKKKIQRNFGRKIKYACRKALADSQPRVRGRFAKMDDGDMLKPRK

SEQ ID NO: 20074 - protein, 175 aa, Triticum aestivum
MVPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVAEVKKEYPDAYVRIIGFDNMRQVQCVSFIVFKPPGCEKSGKA

SEQ ID NO: 20075 - protein, 950 aa, Shewanella sp. MR-4
MRLTRKTDQVVEPKVPALGLNRRQFLKSAGLATGGIAAASMLGTGMMRKAQAQEHIPHNAPTEVKRTICSHCAVGCGIYAEVQNGVWTGQEPAFDHPFNQGGHCAKGAALREHGHGEKRLKYPMKLEGGKWKKISWDQAINEVGDKMTAIRQESGPDSIYFMGSAKFSNEQAYLYRKLAALWGTNNVDHSARICHSTTVAGVANTWGYGAQTNSLNDIRNSKCVMFVGSNPSEAHPVAMQHILVAKERGAKIIVVDPRFTRTAAKSDEYVHIRPGTDIPFIYGLLWHIFENGWEDKEFIKQRVYGMERIRDEVKKYTPEEVENVAGVPKAQMYRIAKMLAETKPGTIVWCMGGTQHHVGNANTRSYCILQLALGNMGVSGGGTNIFRGHDNVQGATDFGLLFDNLPGYYGLTSGAWAHWSNVWDLDPKWVAGRFDQGEYLGQTPQTSTGIPCSRWHDGVLEDKTKIAQKDNIRLAFFWGQSVNTETRGREVREALNKLDTVVVVDPIPTMAGVMHQRKDGVYLLPASTQFETYGSVSATNRSIQWRSKVIEPLFESLPDHVIMYKLAKKLGIEKEFCKHIQVNGEEPLIEDVTREFNKGMWTVGYTGQSPERLKMHQENWGTFDVNSLTAPGGPAKGEVYGLPWPCWGTPEMKHPGTQILYDQSKEVKDGGGNFRARYGVEHNGVNILADGSFSKGSEIQDGYPEFTADMLKQLGWWDDLTEEEKKYAEGKNWKTDISGGIQRVAIKHGCIPFGNAKARCIVWTFPDDIPLHREPLYTPRRDLVAKYPTYEDRMVARLPTLYKSIQDKDFTQGFPLTLTSGRLVEYEGGGEESRSNPWLAELQQEMFIEMNPADAADRGIRDGDNVFVHGPEGAKITVKAMVTPRVVPGECFMPYHFAGIFEGENLAKNYPEGTVPYVQGESANTILTYGYDVVTQMQETKSSLCQVSKA

SEQ ID NO: 20076 - protein, 331 aa, Zea mays
MGSSNDVTAIPLIDVAPLVKKIDDPDMANDKDLLRVVLTLDYACKEVGFFYVKGHGICEMLMREVRDVSHKFFQLPHEEKMKIKMTRQSGYRGYQKLGENVTKEKRDMHEAVNCLTPIAPGKYGDLGKTLEGDNLWPEYPSNLKVVLENYISLVKDLSRKIMRGIALALGGPADAFERGIAGDPYWALRLVSYPVSSSDEKRTDDTGMMGSHTDYGLVTLVNQDDDICALEVQNRSGVWIRANPIPETFLCNIGDMLQVWSNGIYQPTVHRVINSSHQRRVSAVFFYETDFDAAVEPVELCVEKTGGVAKYDKVVYGERLVRKAFCCFGHL

SEQ ID NO: 20077 - protein, 90 aa, Glycine max
MADTGGGDAVRPVVICDNKCGCTLPCTGGSTCRCTSAGTATGGGATGGGDHVTCSCGEHCGCNPCSCPKIAAAGSGCRCGTDCACASCRT

SEQ ID NO: 20078 - protein, 446 aa, Zea mays
  misc_feature (62)..(62): Xaa can be any naturally occurring amino acid
  misc_feature (111)..(111): Xaa can be any naturally occurring amino acid
  misc_feature (243)..(243): Xaa can be any naturally occurring amino acid
  misc_feature (251)..(251): Xaa can be any naturally occurring amino acid
  misc_feature (292)..(292): Xaa can be any naturally occurring amino acid
  unsure (1)..(446): unsure at all Xaa locations
SESEAASGRQGEMGKGAQGSDAAAAGGEVEENMAAWLVAKNTLKIMPFKLPPVGPYDVRVRXKAVGICGSDVHYLREMRIAHFVVKEPMVIGHECAGVVEEVGAGVTHLSXGDRVALEPGVSCWRCRHCKGGRYNLCEDMKFFATPPVHGSLANQVVHPADLCFKLPDGVSLEEGAMCEPLSVGVHACRRAGVGPETGVLVVGAGPIGLVSLLAARAFGAPRVVVVDVDDHRLAVARSLGADXAVRVSPRXEDLADEVERIRAAMGSDIDVSLDCAGFSKTMSTALEATRPXAGKVCLFGMGHNEMTLPLTAAAAREVDLVGRVPVLWRPRSSLSFFCSFFFASSSCFLLLCLSRFLVSFPLFFSFFCFSPPSSAVSFPPFFSSLSFVSVSLVPVCSLSFSSGCCVLLCLSLFLLLCCQCFLALGSLSPFWWFAVIRCCPLVALFF

SEQ ID NO: 20079 - protein, 469 aa, Bordetella pertussis Tohama I
MASTMETDLLVLGGGPGGYTAAFRAADLGLSVVLVEQRPTLGGVCLNVGCIPSKALLHCAKALDEARAMSELGIEFSEPRIRLDKLRAHKEALVAKLCGGLGGLARQRKVEVVTGTGRFDGPHSLAVSDGSRVAFKQAVIAVGSRPVRLPFLPDDPRIMDSTGALELKEIPRRLLVIGGGVIGMELATVYAALGARVTVVELTDGLLPGCDRDLVKPLAQRVASRYEAVLLGTRVSAAQARDDGIHVSFDGPQAPGPQVYDQVLVAAGRRPNGAAIDAERAGARVDEGGFIRVDAQQRTNVGHIYAIGDVVGEPMLAHKAAHEGKVAAETAAGMRVANDARVIPAVAYTDPEVAWVGLTETAAQRDGIAYEKAAFPWAASGRALSLGRGEGLTKILVDPATHALLGVGMVGPQAGDLIAEAALAIEMGAEPGDIALTIHPHPTLSETLAFAAEAYEGTLTELYLTRKKS

SEQ ID NO: 20080 - protein, 584 aa, Vicia faba
MGSVEDDSSRLEEALIQDEESKLYTGDGSVDFKGRPVLKKNTGNWKACPFILGNECCERLAYYGIATNLVKPILLAKLHEGNVSAARNVTTWQGTCYLAPLIGAVLADSYWGRYWTIAIFSMIYFIGMGTLTLSASIPALKPAECLGAVCPPATPAQYAVFFIGLYLIALGTGGIKPCVSSFGADQFDDTDSRERVKKGSFFNWFYFSINIGALISSSFIVWIQENAGWGLGFGIPALFMGLAIGSFFLGTPLYRFQKPGGSPLTRMCQVVAASFRKRNLTVPEDSSLLYETPDKSSAIEGSRKLQHSDELRCLDRAAVISDDERKRGDYSNLWRLCTVTQVEELKILIRMFPVWATGIVFSAVYAQMSTMFVEQGTMMDTSVGSFKIPAASLSTFDVISVIFWVPVYDRFIVPIARKFTGKERGFSELQRMGIGLFISVLCMSAAAIVEIKRLQLAKELDLVDKAVPVPLTIFLQIPQYFLLGAAEVFTFVGQLEFFYDQSPDAMRSLCSALSLLTTSLGNYLSSFILTVVLYFTTRGGNPGWIPDNLNKGHLDYFSGLAGLSFLNMFLYIVAAKRYKSKKAS

SEQ ID NO: 20081 - protein, 843 aa, Arabidopsis thaliana
MGASRKLQGEIDRVLKKVQEGVDVFDSIWNKVYDTDNVNQKEKFEADLKKEIKKLQRYRDQIKTWIQSSEIKDKKVSASYEQSLVDARKLIEKEMERFKICEKETKTKAFSKEGLGQQPKTDPKEKAKSETRDWLNNVVSELESQIDSFEAELEGLSVKKGKTRPPRLTHLETSITRHKDHIIKLELILRLLDNDELSPEQVNDVKDFLDDYVERNQDDFDEFSDVDELYSTLPLDEVEGLEDLVTAGPLVKGTPLSMKSSLAASASQVRSISLPTHHQEKTEDTSLPDSSAEMVPKTPPPKNGAGLHSAPSTPAGGRPSLNVPAGNVSNTSVTLSTSIPTQTSIESMGSLSPVAAKEEDATTLPSRKPPSSVADTPLRGIGRVGIPNQPQPSQPPSPIPANGSRISATSAAEVAKRNIMGVESNVQPLTSPLSKMVLPPTAKGNDGTASDSNPGDVAASIGRAFSPSIVSGSQWRPGSPFQSQNETVRGRTEIAPDRREKFLQRLQQVQQGHGNLLGIPSLSGGNEKQFSSQQQNPLLQQSSSISPHGSLGIGVQAPGFNVMSSASLQQQSNAMSQQLGQQPSVADVDHVRNDDQSQQNLPDDSASIAASKAIQSEDDSKVLFDTPSGMPSYMLDPVQVSSGPDFSPGQPIQPGQSSSSLGVIERRSNSELGAIGDPSAVGPMHDQMHNLQMLEAAFYKRPQPSDSERPRPYSPRNPAITPQTFPQTQAPIINNPLLWERLGSDAYGTDTLFFAFYYQQNSYQQYLAAKELKKQSWRYHRKFNTWFQRHKEPKIATDEYEQGAYVYFDFQTPKDENQEGGWCQRIKNEFTFEYSYLEDELVV

SEQ ID NO: 20082 - protein, 317 aa, Vicia faba
FGADQFDEFEPKERSYKLSFFNWWFFSIFVGTLFSNTFLIYIQDRVGWAVGYGLPTAGLTISVLVFLIGTPLYRHKLPSGSPITRMLQVFVASIRKVEGTSPDDPKELHELSIDEYAYNGRNRIDHSSSLRSFLDKAAMKTSQTSSWMLCTVTQVEETKQMTKMIPILITTIIPSTLIVQSTTLFIKQGTTLDRSMGPHFDIPPACLTAFITIFMLISIVVYDRAFVPMVRRYTKNPRGITMLQRLGIGLVLHIAIMVTACLAERKRLRVARENNLFGRHDTIPLTIFILLPQFALGGVADSFVEIAKLEFFYDQSP

SEQ ID NO: 20083 - protein, 245 aa, Populus tremuloides
MGRGRVELKRIENKINRQVTFAKRRNGLLKKAYELSVLCDAEVALIIFSNRGKLYEFCSTSNMLKTLERYQKCSYGAEEVNKPAKELENSYREYLKVKARFEGLQRTQRNLLGEDLGPLNTKDLEQLERQLESSLNQVRSTKTQYMLDQLADLQNKEHLLQEANRGLTIKLDEISARNSLRPSWEGDDQQNMSYGHQHAQSQGLFQALECNPTLQIGYNPVGSDQVSAITHATQQVHGFIPGWML

SEQ ID NO: 20084 - protein, 105 aa, Brassica napus
GDMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 20085 - protein, 585 aa, Oryza sativa (japonica cultivar-group)
MNPATILGHIQLVHMHPDVSCGVHFVTCFQEPRDKAGRNPNRSEMICRSLLLLRSNAASKASNIVKHVAATGCLPKYSSEAPARYFSSEPSLQVDSTEENGFKGHGMLAPFTAGWQSTDLHPLVIDRSEGSYVYDINGKKYIDALAGLWSTALGGNEPRLIKAATDQLNKLPFYHSFWNRTTKPSLDLANEILSMFTAREMGKIFFTNSGSEANDSQVKLVWYYNNALGRPNKKKFIARSKSYHGSTLVSASLSGLPALHQKFDLPAPFVLHTDCPHYWRFHLPDETEEEFATRLATNLENLILKEGPETIAAFIAEPVMGAGGVIPPPKTYFEKIQAVLKKYDILLIADEVITAFGRLGTMFGCDMYDIKPDLVSIAKALSSAYMPIGAILVSPEITDVIYSQSNKLGSFAHGFTYSGHPVSCAVAIEALKIYKERNIIEHVQKIAPRFQEGIKAFSGSPIVGEIRGLGLILGTEFVDNKSPNDPFPAEWGVGSLFGAECEKRGMLIRVAGDNIMLSPPLIMTPDEVEEIICKYGDALKATEERIAELKAKRVIDDGDDKLTMFNVYRVVSSVDANNELYGLNL

SEQ ID NO: 20086 - protein, 300 aa, Saccharophagus degradans 2-40
MVQKYILDAISQHALPQDFTSAVSDHYAPVAASIAKRYQTKGTPLLVGIQGTQGSGKSTMADFTQLLLQHEHNLNVAVVSIDDFYHTAATRQQLAGEVHPLLATRGVPGTHDLALAFSTLHALSRLESGETLAIPRFNKAIDDRAPQAQWPQVNGPVDVIIFEGWCIGIGPQTDSEVIHPMNKLELEEDPDGTWRQYVNNQLASDYAKLFNMLDYLVVITAPSFDVVFEWRSLQEQKLAAKLKNAPPEQQAKIQTEAQLRRFIAHYQRLTCHGLQHLPAQADWVLHLDEHHRITGSQHNS

SEQ ID NO: 20087 - protein, 474 aa, Schizosaccharomyces pombe 972h-
MGGSDFEDDELFKDLYGEENEKKVESASGNQETSNVTPTKENEGYEELEKSGEAGAERTKENPFREEPGADFDRSGSDQQYSAEAEANQEDDLNETSQQAPDPSSYDIRGQALSSATWDNAEDGENSKNDNYNENQSALTGSGAMESNEDNAEETSPFNREDGKMFIGGLNWETTDDSLRDYFEQFGEVLDCTVMRDSTTGRSRGFGFLTFKNPKCVNEVMSKEHHLDGKIIDPKRAIPREEQEKTAKMFVGGVPGDCTEEEFRNFFNQFGRVLDATLMMDKDTGRPRGFGFVTYENESAVEATMSQPYITIHGKPVEVKRATPKASLRDSHDRHQHGYHGNANPYYAQNMNMYGGMTPAMMAQYYRQMQQYMEAMRNMPAAAGAVPYPQPVMPAGMADWQQQQQQGAAYFDPSKMNQGTGDGVPFSPSMPSGSSRGGYHGRNPGGPNRQRYRGRRDGRGGNTGGGHSFHPYRR

SEQ ID NO: 20088 - protein, 161 aa, Musa acuminata
SSMMVSSAATVSRASPAQSSMVAPFTGLKSTSAFRVTRKANADLSHLPSNGGRVQCMKVWPIEGKKKFETLSYLPTLVDEPLVKQIEYLLRSKWIPCLEFSHEGFVWRENHRSPGYYDGRYWTMWKLPMFGCTDAVQVVKEVEECKKEYPKAFVRIIGFDN

SEQ ID NO: 20089 - protein, 563 aa, Synechococcus sp. WH 5701
MTSSASSDAPAAAMDTSPSPSVRQVLLSAPFTDQKPGTSGLRKSSRQFEQPHYLESFVEAVFRVMPGVAGGTLILGGDGRYGNLRAIDVIARMAAAHGVARLITTTGGILSTPAASNLIRKHQAIGGIILSASHNPGGPEGDFGVKVNGANGGPAPESITDAIYSATTQLEGYRILDAETPSLKGTGTYALGGLRIEVIDGVDDYVALLQGLFDFDAISEMLRGDFPIAFDAMHAVTGPYASRLLEGMLGAPAGTVRNGTPLEDFGGGHPDPNLTYAHDLAELLLDGDDYRFGAACDGDGDRNMILGHRCFVNPSDSLAVLTANATLAPGYAGGLSGVARSMPTSAAVDVVAKELAIPCFETPTGWKFFGNLLDAGRITLCGEESFGTGSDHIREKDGLWAVLFWLQILARRRCSVAEVMASHWSRFGRHYYSRHDYEAIASDRADGLYGRLKGLLPSLAGAGFAGRSIATADDFSYTDPVDGSLTSGQGLRLLLDDGSRVVFRLSGTGTQGATLRLYLESYVGAGGNLDQDPQQALADLITAADHLAEIRGCTGMERPTVIT

SEQ ID NO: 20090 - protein, 161 aa, Musa acuminata
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVWRENHRSPGYYDGRYWTMWKLPMFGCTDAVQVVKEVEECKKEYPKAFVRIIGFDN

SEQ ID NO: 20091 - protein, 950 aa, Shewanella sp. MR-4
MKLTRKSDVAQVADKPTLGISRRQFMKQAGITTGGIAAASLMGTGMMRRAEAKDVPHDAPIEVKRTICSACAVGCGLYAEVQNGVWTGQEPAFDHPFNAGGHCAKGAALREHGHGEKRLKYPMKLVDGKWKKISWEDAINEVGDQMLNIRKESGPDSVYFMGSAKFSNEGCYMYRKLAAMWGTNNVDHSARICHSTTVAGVANTWGYGAQTNSFNDIQNANAIFLIGANPAEAHPVSMQHILIAKEKNNAKIIVVDPRFSRTAAHSDLHCAIRPGTDIPFIYGMLWHIFENGWEDKTFIQQRVFEMETIREEAKKFPPKEVANITGVSEEVIYQAAKLMAENRPGTVIWCMGGTQHHVGNANTRAYCILQLALGNMGVSGGGTNIFRGHDNVQGATDLGLLFDNLPGYYGLTSAAWTHWTHVWDLDMEWVKSRFDQNAYLGKDPMTTPGIPCSRWHDGVLEDKSKLAQKDNIRMAFFWGQSVNTETRQREVRDALDKMDTVVVVDPFPTMAGVMHRRKNGVYLLPAATQFETQGSVSNSGRSIQWREQVIQPLFESKTDIEIMYRLAQKLGIAEQYTKRIAKENGLPVIEEITREINRGMWTIGMTGQSPERIKLHTQNWGTFSNKTLEAVGGPAKGETYGLPWPCWGTPEAKHPGTQILYNQSKHVKDGGGNFRARYGVEYNGKNLLAEGSFSKGAEIQDGYPEFTDKLLKQLGWWDDLTAEEKAEAEGRNWKTDLSGGIVRVAIKHGCIPFGNAKARCIVWTFPDQVPVHREPLYTARRDLVAKYPTYDDMQVHRLPTLYKSIQEKDFSGKYPLVLTSGRLVEYEGGGEESRSNPWLAELQQEMFVEINPGDAADRGIRNGEFVWLEGAEGGRIKVQAMVTPRVKPGVTFMPYHFAGVMHGESLAPNYPEGTVPYVIGESANTALTYGYDPVTQMQETKASLCQIVKA

SEQ ID NO: 20092 - protein, 765 aa, Arabidopsis thaliana
  misc_feature (738)..(738): Xaa can be any naturally occurring amino acid
  unsure (1)..(765): unsure at all Xaa locations
MELVSGKVVPGCSNAGNPFHECTAICFERVNSPDVHKKEKKLFGFGKRTPSRDQTPPASPARGSRSPLASYFAKKKVESSAESSPSSYDHTNGNFLSRLSPLQGRKIEPSSNVDSLPVSPSLALYSGGDYFARRADQRGDEDDDVSPRPFGTQPKTPEHPLRTPQHRPRTPQHRSAHQEDAFSLETRPRTPERRSNTSDTRPRTPIHESAATGRRPQTPETRPRTPDHRYATYDNRPRTPIHESAATERRPQTPETRPRTPEHRSAIPDTRPRTPIHESAATGRRPQTPETRPRTAQRRGRSPEFMERSPGPRSKTPEPQPTYFEPSSRTPKQRSKTPEPSPRIPQTQPMSHRSLDNAALKMPRTVETRPRTPEHQPRTVETKPRIHESRPKTAVYGGRSPDHREKISQEMGQRSSHAYNYLGSKAESVYIEKNEESVLLFPELILSPQERPPSRLITLNHRGYETPNKQKEHCDEMDDSASTDDDKFSFVDDHDEHTVSIYAETTSKSGSSEQEEQHKANNEPPELPDESQSFSLAEISRMKGIITNNEIRDVMQSILSESYVSVGQYKVRASVSTTLQHILQKHGDIASGSKLQSLATRSYYLDMLASVVFELQTTPLKYLKESRVVEMVAIVKDIESVKIKAGWLKPVLEEIVEAVKHYDEHKMSVVEKEVWERDVLLAKQETEKQVKELGEKEKKIKEWRAKMTEMAAKLGDLDMKRARLHKSFTFLSSKVDKXKGNPFFKASCNQPISLNILLFILLPAK

SEQ ID NO: 20093 - protein, 383 aa, Medicago truncatula
MAATSSEGEGKPIRCKAAVARRPGESLVIEEIMVAPPMPREVRIRIICSSICHIDLTFSDMQDPPGFFPRILGHEAIGVVESVGKNVTEVTKGDVVIPIFLPDCGECIDCKSTKSNLCTNFPFKVSPWMPRHENTRFTDLNGEIIHHFMYVSSFSEYTVVTFANVTKIDPEIPPNGACLLSCGIGAGVGAAWRTAGVEPGSTVAIFGLGSIGLAVAEGARLCGATKIIGVDVNPEKFEVGKKFGLTDFVHAGECGSKPVITEMTDGGADYCFECVGMASLVQDAYASCRKGWGKTIVLGLDKPGSRISLSCSEVLHGGKTIQGNLFGGLKPKSHVSILLKRYMDKELQLDEFVTHEVSFKDINKAFDLLRNGQCLRCMIWMDN

SEQ ID NO: 20094 - protein, 129 aa, Triticum aestivum
  misc_feature (127)..(127): Xaa can be any naturally occurring amino acid
  unsure (1)..(129): unsure at all Xaa locations
MAMSWTRALKRGVIPRDAAQLVGIRGFAAQPKGKKGGKGGAADAKPVLSKEMKSTTVFGANILKEGSDPKIQPDSEYPDWLWHLIDKRPVLSELRRKDAKTLPYEDLKRFVKLDNRARIKENNALTXKN

SEQ ID NO: 20095 - protein, 197 aa, Pseudomonas putida KT2440
MVERKASVERNTLETQVKCSINLDGSGKARFDIGVPFLEHMLDQIARHGLIDLDIECKGDTHIDDHHTVEDVGITLGMAFAQAIGDKKGIFRYGHAYVPLDEALSRVVIDFSGRPGLQMHVPYTRASVGGFDVDLFQEFFQGFVNHALVTLHIDNLRGHNTHHQIETVFKAFGRALRMAITLDERMAGQMPSTKGCL

SEQ ID NO: 20096 - protein, 950 aa, Robiginitalea biformata HTCC2501
MPKRKDLETLLIIGSGPIIIGQACEFDYSGSQALRSLREDGIKTVLINSNPATIMTDPSMADHVYLLPLTTKSILEVLKKHPEIDAVLPTMGGQTALNLCIEAGDKGIWEDFGIEIIGVDIDAINITEDREKFRDLMSRIGVAMAPQATATSFLQGKEIAQEYGFPLVIRASYTLGGAGASIVYKPEDFDNLLSVGLETSPIHEVMIDKAMMGWKEYELELLRDKNDNVVIICTIENMDPMGIHTGDSVTVAPAMTLSDRTFQRMRDMAIHMMRSIGDFAGGCNVQFAVSPDEKEDIIAIEINPRVSRSSALASKATGYPIAKVAAKLAIGYHLDELDNQITQSTSALFEPTLDYVIVKIPRWNFDKFEGADRTLGLQMKAVGEVMGIGRSFQEALHKATQSLEIKRNGLGADGKGYRDYDKIIDKLTHPSWDRVFVIYDAIQLGIPLSRIHEITKIDMWYLKQYEELYELEKEIGNYTVETLPKALLLEAKQKGFADRQIAHMLDCWESEVHAKRMALDIKRVYKLVDTCAAEFQAVTPYYYSTFEEEIETADGKRYVANDSEVTDRKKIVVLGSGPNRIGQGIEFDYCCVHGVLAAAECGYETIMINCNPETVSTDFDTADKLYFEPVFWEHIYDIILHEKPEGVIVQLGGQTALKLAEKLDKYGIRIMGTSFASLDLAEDRGSFSRLLKDNDIPYPQFGVAESADEALQLADELKFPLLVRPSYVLGGQGMKIVINKEELEAHVVDLLRKIPNNKLLLDHYLDGAIEAEADAICDGEDVYIIGIMEHIEPCGIHSGDSNATLPPFNLGEFVMQQIKDHTRKIALALNTVGLINIQFAIKDDMVYIIEANPRASRTVPFIAKAYGEPYVNYATRIMLGKNKLKDFKFNPKLEGFAIKQPVFSFNKFPNVNKNLGPEMKSTGESILFIESLKDDEFYNLYSRRKMYLSK

SEQ ID NO: 20097 - protein, 324 aa, Bordetella pertussis Tohama I
MAELRFAHAINRALAECMEEDPMVFLFGEDIAEAGGPFGVTRGLHDRFGSDRIRDTPISEATMANAAVGAALSGLKPVLEIMFMDFMTLTMDALVNQAAKARFMFGGQASVPMVVRTPHGGGISAGPQHSQCLEAWFAHIPGLKVVCPSNPADAYGLLKSAIRDPDPVVFVENKALYAAKGEVPDDVGPIPLGQARIARAGRDLTVVSYGAMVHKVERAAEALARDGIEAEVLDLRSIQPWDEAAVLASLRRTHRLLIVHEAVEAFGVGAEIAARMADIGFDELDAPIVRVAAPFVPVPFAPSLEAQYQPQEADIIAAARKLCA

SEQ ID NO: 20098 - protein, 433 aa, Ostreococcus tauri
MDNVLSIILGGGAGTRLYPLTKKRAKPAVPLGANYRLIDIPVSNCINSDINKVYCLTQFNSASLNRHLAQAYNTNIGTHTRQGFVEVLAAQQSPVNKAWFQGTADAVRQYLWLFEESKCEEYLILSGDHLYRMDYRPFIMKHRETEAAITVAALPCDEKRASSFGLMKIDNTGRVIEFAEKPKGAELQAMKVDTTVLGLDADKAQEMPFIASMGIYVFDAKKMRECLLENFKEADDFGGEIIPMAAQMGLKVQAFLYEGYWEDIGTVDAFFHANLSCNDPNPAFNFHEMNAPIYTQSRFLPPSKVQDCEIERSTIGDGCFITKAKLKNVMVGLRSTVNANCDLEDTLVMGADYYETYDEAKTSALPGGVPIGIGAGTKIRKAIIDKNARIGENCQILNEAGVMDKDCENEGYIIRDGIIVVIKDAVIKPGTVI

SEQ ID NO: 20099 - protein, 323 aa, Bordetella pertussis Tohama I
MARANKEQLLDAYQRMLGIRLVELRLGRLFADGEVPGFIHLSVGQEAVAAAMGMVLRPDDTVASTHRGHGHALAKGIDMDDFFLELMAREEGICKGRGGSMHVANMSIGMLGANAIVGASIPIALGSALAHQVRKTDALAVAFFGDGAMAEGGLHESLNLAALWQLPLLFLCENNGWAEFSPTHKQFVAPLDKLSAAFSIPHAKVDGNDVLAVMDAAQAAVADIRAGKGPRVLECITHRWRGHYEGDPQKYRDSDEISGLDEHDPVARFEAVLDSKGVSQAQRQKVRDAVQAQVDQAVERARKGRPPVWETARTDVYTQAEAR

SEQ ID NO: 20100 - protein, 327 aa, Ustilago maydis 521
MSGKASSSNVRLASASYGKDLVRIFRIVRDSKDPSSHRVAEYTVRCLLHGESLTPSYTEADNSPVVATDTVKNTLNYLAKVLPAEDVLCPERYALNVVNHFLTTYSHIEKTEVDLIQHKWTRIVLDQKDGGAHKHSFVRDGEEKRTVRALGERSGSEINVTTLEGGIKGLLVLKSSGSAFYGFHRDSFTTLKEVHDRIFSTEVECSYSIGLPSGGLTAVLKNPSSLPQFCDIHSSVKSHVLRVFALDDSASVQATMYRMGEAILGDATNKTVKDVSFALPNKHYIPIDLGFKGLSNLDEKNAEVFLPTAHPSGYIKAKIARLSAAKL

SEQ ID NO: 20101 - protein, 157 aa, Triticum aestivum
  misc_feature (88)..(88): Xaa can be any naturally occurring amino acid
  misc_feature (104)..(105): Xaa can be any naturally occurring amino acid
  misc_feature (121)..(121): Xaa can be any naturally occurring amino acid
  misc_feature (123)..(124): Xaa can be any naturally occurring amino acid
  misc_feature (129)..(129): Xaa can be any naturally occurring amino acid
  misc_feature (136)..(137): Xaa can be any naturally occurring amino acid
  misc_feature (153)..(153): Xaa can be any naturally occurring amino acid
  unsure (1)..(157): unsure at all Xaa locations
MAAGRELVVSFGEMLIDFVPTVAGVSLAEAPAFLKAAGGAPANVAIAVSRLGGGAAFVGKLGDDEFGRMLAAILRDNGVDGGGVVFDXGARTALAFVTLRADGXXIHFYRNPNAESPHCRXLXXRLIRXGCVFHYXXISLIADLAGNNLRAMXIAKR

SEQ ID NO: 20102 - protein, 124 aa, Glycine max
MNARRDNRNNRVSLFDGIEEGGIRASSVYSSSHEIDEHDNEQALDGLQDRVNLLKRLSGDINEEVDSHNRMLDRMGNDMDSSRGVLSGTMDKFKMVFETKSNQRMFTLVASFVVLFLIIYYLTR

SEQ ID NO: 20103 - protein, 893 aa, Saccharomyces cerevisiae
MAGHHHEHEQERDHEQEHEHDSLQRPTTGSERTRSISFSKLLTRSWKRNASSSNNMSVSSVNLYSDPENSRESDHNNSGSEGQSSRFSKLKSMFQSGNSSKNASAHNSSQSSLEGDSASSSSKLRYVKPMTSVANASPASPPLSPTIPETDVLQTPKMVHIDQHEHEREHSNCGSPIMLSSSSFSPTVARTGTGRRRSPSTPIMPSQNSNNSSSTSAIRPNNYRHHSGSQGFSSNNPFRERAGTVRSSNPYFAYQGLPTHAMSSHDLDEGFQPYANGSGIHFLSTPTSKTNSLTNTKNLSNLSLNEIKENEEVQEFNNEDFFFHDIPKDLSLKDTLNGSPSRGSSKSPTITQTFPSIIVGFDNEYEEDNNNDKHDEKEEQQTTTDNKTRNLSPTKQNGKATHPRIKIPLRRAASEPNGLQLASATSPTSSSARKTSGSSNINDKIPGQSVPPPNSFFPQEPSPKISDFPEPRRSRRLRTKSFSNKFQDIMVGPQSFEKIRLLGQGDVGKVFLVREKKTNRVYALKVLSKDEMIKRNKIKRVLTEQEILATSNHPFIVTLYHSFQSEDYLYLCMEYCMGGEFFRALQTRKTKCICEDDARFYASEVTAALEYLHLLGFIYRDLKPENILLHQSGHIMLSDFDLSIQAKDSKVPVVKGSAQSTLVDTKICSDGFRTNSFVGTEEYIAPEVIRGNGHTAAVDWWTLGILIYEMLFGFTPFKGDNTNETFTNILKNEVSFPNNNEISRTCKDLIKKLLTKNESKRLGCKMGAADVKKHPFFKKVQWSLLRNQEPPLIPVLSEDGYDFAKLSSNKKRQTSQDSHKHLDEQEKNMFEERVEYDDEVSEDDPFHDFNSMSLMEQDNNSMIYGNTNSYGKIAYTPNSNRSRSNSHRTFFKR

SEQ ID NO: 20104 - protein, 161 aa, Musa acuminata
SSMMVSSAATVSRASPAQSSMVAPFTGLKSTSAFPVTRKANADLSHLPSNGGRVQCMEVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 20105 - protein, 193 aa, Populus x canadensis
MEAAATFTGHKRSSSFSLRCPSLNFLRLRRIFDLFDKNGDGMITIEEISQALSLLGLDADFSDLEFTIKSHIKPGSSGLSFEDFVSLHQSLDSSFFGYDNIASEEEAANDIGDQARMRQEESDLSEAFKVFDEDGDGYISAHELQVVLRKLGLPEAKEIDRIHQMITSVDRNQDGRVDFFEFKDMMRSVLVRS

SEQ ID NO: 20106 - protein, 373 aa, Zea mays
MAMEAEEDGGGIEGELIPGLPDDVAMECLARVPSRSHRRMRRVCRRWRGTVGSAEFRRRRMAAGASEDMVFLVQTAPARGDGKGSTSECALVAANLTTGEWRRVEGPAETWRPVPLFAQCAAAGDGRHVAVVGGWDPDTLRPTSDVRLLDVPAGTWRRGPKMPDSRSFFGCAGGGGNVYVAGGHDECKNALRSAFAYSVAADAWRALPDMLEERDEPQLVVATPGRVLAASGYPTEAQGAFKDTAEWYNAGGGAWTSECDVVPDGDTAGTCLASVRGTVWAVGAGNGGVREWDGAARAWKDVADGPPGMKACLKAVGVGNGGAVLVFGTVADAAAEGVNYSAWVMEASSGAWKRVPVPSGFGGFVYSAAAVPV

SEQ ID NO: 20107 - protein, 388 aa, Triticum aestivum
  misc_feature (258)..(258): Xaa can be any naturally occurring amino acid
  misc_feature (268)..(268): Xaa can be any naturally occurring amino acid
  misc_feature (287)..(287): Xaa can be any naturally occurring amino acid
  unsure (1)..(388): unsure at all Xaa locations
SKLELQRRADDTSTASAMAAEYDRTADLRALDATCSGVRGLVASGVTHLPRIFRVSDGVHQPQPPPPQVPSQELPSSSAPSVPVIDLSGSDHAAVVAAVRRAAAEWGFFQVTGHGVPEAAMAAATDAVRGFHEADGGEGSDKARLYSREPARAVKYHCNFDLYQSPVANWRDTLYLRMAPDQPDAGDLPDSCRDALFEYAEQVKNLGSTLFELLSEALGLKPSYLTDIECNQGQIILCHYYPPCPQPELAIGTSRHSXTPGFLTILLXQDEIRGLQDFSQRRTNWVXVTPTPGAFIVNIGDFLQLISNDGFRSVEHRVVAKNATPRVSIACFFSTHFHPASTRMYGPIKELLSDENPPLYRETLVRDYIKHYYSIGLDAKTAISDFRL

SEQ ID NO: 20108 - protein, 446 aa, Saccharomyces cerevisiae
MGKNVLLLGSGFVAQPVIDTLAANDDINVTVACRTLANAQALAKPSGSKAISLDVTDDSALDKVLADNDVVISLIPYTFHPNVVKSAIRTKTDVVTSSYISPALRELEPEIVKAGITVMNEIGLDPGIDHLYAVKTIDEVHRAGGKLKSFLSYCGGLPAPEDSDNPLGYKFSWSSRGVLLALRNSAKYWKDGKIETVSSEDLMATAKPYFIYPGYAFVCYPNRDSTLFKDLYHIPEAETVIRGTLRYQGFPEFVKALVDMGMLKDDANEIFSKPIAWNEALKQYLGAKSTSKEDLIASIDSKATWKDDEDRERILSGFAWLGLFSDAKITPRGNALDTLCARLEELMQYEDNERDMVVLQHKFGIEWADGTTETRTSTLVDYGKVGGYSSMAATVGYPVAIATKFVLDGTIKGPGLLAPYSPEINDPIMKELKDKYGIYLKEKTVA

SEQ ID NO: 20109 - protein, 714 aa, Arabidopsis thaliana
MGCVNSKQTVSVTPAIDHSGVFRDNVCSGSGRIVVEDLPPVTETKLLSWWSKSGKKSSSKKSGSELGSDFGELSESGRASSNCRSESVSFRLGNLSKYLEAEQVAAGWPAWLSNVAGEAIHGWVPFRSDAFEKLEKIGQGTYSSVFRARETETGRIVALKKVRFDNFEPESVRFMAREILILRKLNHPNIIKLEGIVTSKLSCSIHLVFEYMEHDLTGLLSSPDIDFTTPQIKCYMKQLLSGLDHCHARGVMHRDIKGSNLLVNNEGILKVADFGLANFCNASGNKQPLTSRVVTLWYRPPELLLGATEYGASVDLWSVGCVFAELLIGKPVLQGRTEVEQLHKIFKLCGSPPEDYWKKSKLPHAMLFKPQQHYDGCLRETLKLKGLSDADINLIETLLSIQPHKRGTASTALVSQYFTSKPFACDPSSLPVYSPSKEIDAKHREDTTRKKISGNGRRGTESRKPTRKPPAFAKLAPAEDVRHHSQKFQKRNGHSVHNSIDSDSTLFEKMQKPSNHEKDEASHVKNASQGDVPFSGPLQVSVSSGFAWAKRRKDDICVRSHNRSLSRGHIPNLLGPSPAFSENTDVDSKNNEKEKEEKHGERTDSQDREAYEMLKLSMLKKWRQLERPDSFGGSDEYHSQELSLELYQREEKAAKLGHLGRVDNDEKIEFSGPLLSKSYGVDELLERHERQIRQLVRKSWFQKVWFLRISAISS

SEQ ID NO: 20110 - protein, 295 aa, Schizosaccharomyces pombe 972h-
MSTVYKLKTSERAPKNEDEDEEYVPVQNGQGNKHSAGFVPIKQKVLVLSSRGVTYRQRHLLNDLVSMMPHSKKDSKLDSKDRLYQLNELAELYNCNNIFFFESRRREDLYLHIARAPNGPTVKFHVENLHTMDELNMTGNALKGSRPILSFDKTFDTAPHLKVVKELLQQTFGIPKGARRSKPFIDRVCTLTIADGKIWFRNYEIRENEDKSKDPVTLIEIGPRFVMTIINILEGSFGGPVIYKNDTFVSSTMVRAAIRNQAAQRYVNRQESKLERQVRAQQNVIPEDPLDNVFA

SEQ ID NO: 20111 - protein, 1100 aa, Mannheimia succiniciproducens MBEL55E
MAMSTKPSGASKFVYKTANNFLKVLSRENNMPKRNDINTILIIGAGPIVIGQACEFDYSGAQACKALREEGYKVVLVNSNPATIMTDPNMADVTYIEPIHWQTVEKIIEKERPDAILPTMGGQTALNCALDLSKNGVLKKYGVELIGATEDAIDKAEDRGRFKEAMAKIGLNTPKSFVCHSFDEAWKAQEEVGFPTLIRPSFTMGGSGGGIAYNRDEFQAICERGFEASPTHELLIEQSVLGWKEYEMEVVRDKADNCIIVCSIENFDPMGVHTGDSITVAPAQTLTDKEYQIMRNASLAVLREIGVDTGGSNVQFAINPENGEMIVIEMNPRVSRSSALASKATGFPIAKVAAKLAVGYTLNELRNDITGGLIPASFEPSIDYVVTKVPRFAFEKFPKADDRLTTQMKSVGEVMAMGRTFQESIQKALRGLETGICGFNLKTEDMEKLRHEISNPGPERLLYVADAFGIGWSIEDVHHYSKIDPWFLIQIQDLVLEELALEKKTLADLNKDEIYRLKRKGFSDKRIAQLVKSDETSVRSLRNAFNIHPVYKRVDTCAGEFKSDTAYLYSTYEEECEAAPSDRKKVMILGGGPNRIGQGIEFDYCCVHAALALRESGFETIMVNCNPETVSTDFDTSDRLYFEPLTLEDVLEIIHVEKPWGVIVHYGGQTPLKLANALHANGVNIIGTSADSIDAAEDRERFQKILHDLNLKQPANRTARNTQEAVGLANEVGYPLVVRPSYVLGGRAMQIVYNDEELNRYMREAVSVSNDSPILLDHFLNNAIEVDVDCICDGEQVIIGGIMQHIEQAGIHSGDSACSLPPYSLSMEIQDEIRRQTAAMARALNVVGLMNVQFAVQNDVIYVLEVNPRASRTVPFVSKATGQPLAKIAARVMAGISLKEQGIQGEVVPQDFYAVKEAVFPFIKFPGVDTILGPEMRSTGEVMGVGATFAEAFLKAQIGAGERIPRTGKVFVSVDNNDKPRLLPIVKRLQEQGYGLCATFGTAKFLRENGIAVQTVNKVREGRPHIVDAIKNDEIALIINTAGGMAESVADSASIRASALKQRVPLYTTIAGADAISLSVANLDIHDVYSVQGLHAGLTK

SEQ ID NO: 20112 - protein, 665 aa, Coccidioides immitis RS
MSSSMPALGILSNSLATPTQLATSSSSLDGIPADLETSIRYAGVRLTQAAGVLLRLPQDIISQAIVFFTRFWIGPEGGSLAIHGAKDISAASIYIAGKLSLTPVSPRSVINVYTFLLSPKSSPLRFVNPAGPPPRADPENYYVSEGTYQSERVALMKMESAILRTLGFDTHVAIPHPIAFTYLQTLGSSTPAAVKRTIEHLNTALLSPQLLYVTHQPNAIAVAAIYLAARETGVKLLDYLTIRIGSVDGGKSVALGQLANNLPLPTKIPEPIPAASFRTSSQTPGTDSTLPHIMNYIRTWRDKLAPISHTSTFRSTGQITPEEFVLAGDYLVYKFPTWSWADAPPAKRVPYLPEGKQFLVTRGVPCHRRLDENFAGDAGKEDVMIKDGLGSGDGKEGEDEDYGWLNTGGGGGGGGGSEPVTMGSEARIKDVRTVDEAGNVGEKEEEEEEEEIPDMEDEEDDEEAIIREPLGKSTKAPLRTYSLYITYTPWYRTPRLYLSGYLSPSEPLTPQLMMEDIVGDYKDKTVTLEDFPFYDGGVKMASVHPCKHASVMKILLDRADAALKIRRQKLKRANAAGEPAKVESGLKGLVDDTAQLNISGGGNRAGNPPSGQNAGDEWEVLQPEGSEEDEDDQQVAIRVDQYLVVFLKFIASVTPGIEHDFTMGV

SEQ ID NO: 20113 - protein, 329 aa, Spiroplasma citri
MPVVNNIQALTHALDLAMEKHQNIVIYGEDVGFEGGVFRVTIGLQAKYGEERCFDAPIAEATLVGTAVGMAINGMKPIVEMQFEGFSYPAFQQLFTHVARLRNRSRGRFTCPLIVRMPMGGGIRALEHHSEAVEAMFAHNPGLKVVIPSTPYDTKGLLLAAVQSPDPVIFLEPTKIYRAFKQEIPDEYYTLPIGEGYKIQEGEDLTIVTYGAQVSECEKALAQLKEEGLPINVDLIDLRTIQPWDREIVIESVKKTGRILVVHEAVRSFSVASEVITTVNEKCFEYLKAPAGRVTGYDIIIPFDRGEHYHQPSVQKIVVKIKELVNYQF

SEQ ID NO: 20114 - protein, 427 aa, Spiroplasma citri
MVKFKFADIGEGLTEGKVAKIMIEVGDKIKDGVEMFAVETDKVNTEIYAPCDGIVSKINMAVGDTIYVGDVVVEIDDGTAGDSPAPATSEQPTTVPVEEEKAAGVVGAVSISNTVLAPRHLPNNGSANVDSNKNVLSTPIVRKMAADLKIDLTKIQGSGQNGKIMKADLVQGAKSTTTGPTLSTMPINIPQINATGAVRREAMSPIRKAIAKQMTLSKTVIAEATLMKNIDVTKLIEIRAQLKGQAEQQGVKLTYMPFFMKACAIALKDFPILNAAYDQEQQEIIFKDYYNIGMATDTPTGLMVPVVKGVDQLNIMQIAKMINDLATKTRERKLKPDEMKDGTFTITNFGSAGIEFATPVINFPEVAILGVGIIKKAPVINKNNEIEISSILPLSLTIDHRLIDGADGGRFLARVTELLESPALLLL

SEQ ID NO: 20115 - protein, 460 aa, Spiroplasma citri
MENKYDVIIVGAGPGGYVTAIKAAQEGLKTLIIEKEYYGGVCLNVGCIPTKALLKSSKVYDMMKHADNYGIDVAKAAVAPNWVKMQERKAKVVTQLTKGVEFLLKKNKVDLIKGEAKAIDKNTVEVAGKRYLCANLIIATGSVSRRLPLPAFEQAEKAGYVISSTEALSLPTIPKKLIIIGGGVIGIEFACLYHRLGTEVTILQGLDTILELLDKDIREELTKLLIKNKVKIETSVKIKAIKGKSVIYDNSEGKEVKLTSDYCLVSVGRTPVTTGFENIGLKIGERKNIEVDEQCKTNLPGVYAIGDVVGRAMLAHVAWAQGILVIDNIKGKNVKMNYNRIPSCIYSFPEVATVGITEEQAIKDKIAYKAFKFPLAANGKAIADGETDGFVKILCDPKYGEILGAHIVAATATDMISEITACMETEGTIHELAKTVHPHPTLSEIIMEVSHGLEGRAIHI

SEQ ID NO: 20116 - protein, 374 aa, Glycine max
QTIKCKAAIAWEAGKPLVIEEVEVAPPQAGEVRLKILYTSLCHTDVYFWDAKQTPLFPRIFGHEASVGGIVESVGEGVTHLKPGDHALPVFTGECGDCAHCKSEESNMCELLRINTDRGVMIHDGQSRFSKNGQPIHHFLGTSTFSEYTVVHAGCVAKINPAAPLDKVCVLSCGICTGFGATVNVAKPKPGSSVAIFGLGAVAVAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEINKAFDLMLKGSIRCIIRMQE

SEQ ID NO: 20117 - protein, 166 aa, uncultured archaeon GZfos12E1
MQTKTNVKVKELMTTDVIAFKPGEKIPHVVKAFRTNRISGAPVIDDQRKVIGIISEADIMKLTATVPFPDIDPLNPFPVFSLSSYMKKVKKIPDEIETLFEGYVKDVMTKKTVTISPDNSISDAARLMHKNDFKRIPVVDDEGKLVGVIARGDVIGVFAKYSHSKK

SEQ ID NO: 20118 - protein, 430 aa, Bacillus subtilis subsp. subtilis str. 168
MPYIVDVYAREVLDSRGNPTVEVEVYTETGAFGRALVPSGASTGEYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 20119 - protein, 381 aa, Candida maltosa
MSESTVGKPITCKAAVAWEAAKPLSIEDVTVAPPKRHEVRIKLYDTGVCHTDAYTLSGVDPEGAFPVILGHEGAGIVESIGEGVTNVKVGDHVIALYTPECGECKFCKSGKTNLCGKIRATQGKGVMPDGTSRFTCKGKEILHFMGCSTFSQYTVVADISVVAINPKAEFDKACLLGCGITTGYGAATITANVQKGDNVAVFGGGIVGLSVIQGCAERGAAQIILVDISDKKEEWGQKLGATAFVNPTKLPEGTTIVDKLIEMTDGGCDFTFDCTGNVGVMRNALEACHKGWGTSVIIGVAAAGKEISTRPFQLVTGRTWKGAAFGGVKGRSQLPGIVNNYLDGKLKVEEFITHREPLAAINKAFEEMHAGDCIRAVVDLS

SEQ ID NO: 20120 - protein, 224 aa, Arabidopsis thaliana
MSQPSVILATASYDHTIRFWEAETGRCYRTIQYPDSHVNRLEITPDKHYLAAACNPHIRLFDVNSNSPQPVMTYDSHTNNVMAVGFQCDAKWMYSGSEDGTVKIWDLRAPGCQKEYESVAAVNTVVLHPNQTELISGDQNGNIRVWDLRANSCSCELVPEVDTAVRSLTVMWDGTMVVAANNRGTCYVWRLLRGKQTMTEFEPLHKLQAHNGHILKCLLSPANK

SEQ ID NO: 20121 - protein, 187 aa, uncultured archaeon GZfos12E1
MRNGLIVALVYRMLDTHDAGDKKNAGHQERDVEMKKKVEEIMTKEVITAKENDSLLDVATVLKENKIAGVPVLNEREEVVGVISEADVLKLLENFHWYTSIFTAHDLMNIFGEDLHDVQQDIEKASKMKVKDVMSKKPETVPPDTLIDDAAQIMHSTGFNRLPVVDENDKLVGIVARADIIASLYEK

SEQ ID NO: 20122 - protein, 511 aa, Bacillus subtilis subsp. subtilis str. 168
MSKKPAALIILDGFGLRNETVGNAVALAKKPNFDRYWNQYPHQTLTASGEAVGLPEGQMGNSEVGHLNIGAGRIVYQSLTRVNVAIREGEFERNQTFLDAISNAKENNKALHLFGLLSDGGVHSHINHLFALLKLAKKEGLTKVYIHGFLDGRDVGPQTAKTYINQLNDQIKEIGVGEIASISGRYYSMDRDKRWDRVEKAYRAMAYGEGPSYRSALDVVDDSYANGIYDEFVIPSVITKENGEPVAKIQDGDSVIFYNFRPDRAIQISNTFTNKDFRDFDRGENYPKNLYFVCLTHFSETVDGYVAFKPINLDNTVGEVLSQHGLKQLRIAETEKYPHVTFFMSGGREAEFPGEERILINSPKVATYDLKPEMSAYEVKDALVKEIEADKHDAIILNFANPDMVGHSGMVEPTIKAIEAVDECLGEVVDAILAKGGHAIITADHGNADILITESGEPHTAHTTNPVPVIVTKEGITLREGGILGDLAPTLLDLLGVEKPKEMTGTSLIQK

SEQ ID NO: 20123 - protein, 253 aa, Bacillus subtilis subsp. subtilis str. 168
MRKPIIAGNWKMNKTLGEAVSFVEEVKSSIPAADKAEAVVCAPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 20124 - protein, 255 aa, Zea mays
MAVRVWLSAILLAFLLAASPFAQVARAQSEEDAAMQEVVDGADLGYVGDDTPVSSEEPLSPAPGVETVCVFPKNAGKIVPAGEETELLVGLQNEGESTLNVVAVHSTLHLPYDHKMYGQNLTVQSFYNASVPVSVQATFPYTFAVSKFLQPGAYDLVGYIVYEIDQHPYQNVFYNGTIEVVEVGGLLSVESVFLITLGIALLGLLGLWAYGQVQQLSKKTKKGPKVELGTGTTDANMDEWLEGTAFAKDKAKKNK

SEQ ID NO: 20125 - protein, 186 aa, Oryza sativa
MEDERNTESHQCGEAAEQVEVKDRGLFDNLLGRKKDDQPEEKKHEEELVTGMEKVSVEEPKKEEHHAEGEKKESLLSKLHRSSSSSSSSSSSDEEEEVIDDNGEVVKRKKKKGLKEKIKEKLPGHKDHAGEHAPPPAATGFPAPAPPASVVTAAPTPAPAPVVTHGDHHHDTAVPVEKIEGDHART

SEQ ID NO: 20126 - protein, 502 aa, Rhodococcus sp. RHA1
MTESVSQGASSRAKTNRSLQGASGDDVGYRKSLKPRHIQMIAVGGAIGTGLFMGAGGRLSASGPSLVLVYALCGFVAFLVLRALGELVLYRPSSGSFISYAREFYGEKMAFVVGWLYFLMWAMASIVDVTAIALYLKFWAPAVPLIDAAPQWTLALVALFVVTLLNLVSVKLFGEMEFWFAIIKVTALVAFLVFGTLFLVLNGETDLGATGFSIVLDHGGVFPTGAITPILAAGGVIFAYASVELVGIAAGETENPSRIIPKAINTVIIRILLFYVGSVLLLSLLLPFGAYTAQTSPFVTFFSHIGSPETAAVASSVMNFVVLTAALSSLNAGLYATGRVLRSMALNGSAPSFTSKLSGNGVPFGGILLTVGCALLGVGLNAIVPTKAFEIVLEISALGIIAAWGTIMLCQLKLRKWANEGRVERPSFRLFGAPFTSYFVLAFLAFVLVTMGFSETGQWVLGSLVVIVPLLIVGWRRSRARLSTTTDHRDFVPVEIPPRTSH

SEQ ID NO: 20127 - protein, 394 aa, Bacillus subtilis subsp. subtilis str. 168
MNKKTLKDIDVKGKVVFCRVDFNVPMKDGEVTDDTRIRAALPTIKHLADQGAKVLLASHLGRPKGEVVEELRLTPVAARLGELLGKEVKKADEAYGDAVKAQISEMKDGDVLVLENVRFYPGEEKNDPELAKAFAELADVYVNDAFGAAHRAHASTAGIAEHLPAVAGFLMEKELDVLGKAVSNPDRPFTAIIGGAKVKDKIGVIESLLDKVDNLIIGGGLAYTFVKALGYEVGKSLLEEDKIELAKSFMDRAKEKGVNFYMPEDVLVADDFSNDANVKIVPISEIPSDLEAIDIGTKTRETYADVIKNSKLVVWNGPMGVFEIDLFAQGTKAVAEALAEAKDTYSVIGGGDSAAAVEKFGLADKMSHISTGGGASLEFMEGKELPGVAALNDK

SEQ ID NO: 20128 - protein, 335 aa, Bacillus subtilis subsp. subtilis str. 168; identical to SEQ ID NO: 1177

SEQ ID NO: 20129 - protein, 464 aa, Bacillus subtilis subsp. subtilis str. 168
MKNTPTQLEPNVPVTRSHSMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEALKILTRINGETVAKEELKNIENSLKIEQMGSLSQLFKPGLRKALVIGILLALFNQVIGMNAITYYGPEIFKMMGFGQNAGFVTTCIVGVVEVIFTVIAVLLIDKVGRKKLMSIGSAFMAIFMILIGTSFYFELTSGIMMIVLILGFVAAFCVSVGPITWIMISEIFPNHLRARAAGIATIFLWGANWAIGQFVPMMIDSFGLAYTFWIFAVINILCFLFVVTICPETKNKSLEEIEKLWIK

SEQ ID NO: 20130 - protein, 352 aa, Arabidopsis thaliana
MEKKSVPNSDKLSLIRVLRAVVLRLFSIRYSRKCVSFFFGSWLALWPFLFEKINKTKVIFSGDKVPCEDRVLLIANHRTEVDWMYFWDLALRKGQIGNIKYVLKSSLMKLPLFGWAFHLFEFIPVERRWEVDEANLRQIVSSFKDPRDALWLALFPEGTDYTEAKCQRSKKFAAENGLPILNNVLLPRTKGFVSCLQELSCSLDAVYDVTIGYKTRCPSFLDNVYGIEPSEVHIHIRRINLTQIPNQEKDINAWLMNTFQLKDQLLNDFYSNGHFPNEGTEKEFNTKKYLINCLAVIAFTTICTHLTFFSSMIWFRIYVSLACVYLTSATHFNLRSVPLVETAKNSLKLVNK

SEQ ID NO: 20131 - protein, 71 aa, Glycine max
MLAQRENKSKNGKLRLLYECAPMSFIVEQAGGKGSDGHQRILDIQPTEIHQRVPLYIGSVEEVEKVEKYLA

SEQ ID NO: 20132 - protein, 510 aa, Burkholderia pseudomallei K96243
MCGIGAIFSTQRASVDGIERSLSALMSKIAHRGDASRFNENLIRERFGLATNRLAIVERDHARQPVSDHERDLHVVLNGQIYNYKELRDELAARGHRFSHAGDAEVLLRAYLEYGPSFATKLDGMFSFVLFDNLNGKFLIGRDHVGIKPLYYAQRDGVWYVASELKALTHVNARIETLAPGTLFDGKETIRYVSYDASRPVSRDSFDEAKARVRTLLEESVRRRVDTDLPICVMFSGGIDSAIVLQLAHRYHPDVTAISFGLPGSNDIEIAHRYCAEHGIRHVIYTFTKQDLLENIDDAVYYGEFFEKIDAIDSAIAHFGYYIANKLGLKVALCGEGSDEIFGGYDLFKTHAQPGALSLYRLNNLHRTDLQRVDRASMRNTVEARVPFMDAELIDYVLSLDFSYKLHGGVEKHILREAFRDVLPGYIIDRPKIRMPDGSGVKNVIIDHIDSLGDAPPDDAARRLGEIGLSDRSALFFARKYLECNFPFPTQRFKQAGKDFSESGYFDFIS

SEQ ID NO: 20133 - protein, 191 aa, Ostreococcus tauri
  misc_feature (1)..(1): Xaa can be any naturally occurring amino acid
  unsure (1)..(191): unsure at all Xaa locations
XLLTPRGKFRGVRFNPALWPSGWGMDDDVGMAMFRACAEATPPAVVGFMCFHGLKPQIPAIRALCEAEPTVPVLIDHFGFTKGIEDEGFEDLLALGRDFEQIHVKCSAHFRVRVATEDGSDSTERQLRRLIETFGRERIVWGSDYPFVTMEDGGYAGAVGLLESQLAADPELIDMIRGENFMRLFPGAVEA

SEQ ID NO: 20134 - protein, 128 aa, Saccharophagus degradans 2-40
MTDSTFLDEITWTSDGLVPAIARDAKTGTVLMMAWMNRESLSLTAQENIAVYWSRSRGKLWRKGETSGFTQHVKSIRLDCDADVIVLDVEQMGGIACHTGRESCFYRELQNGKWVATDPVLKDPKEIY

SEQ ID NO: 20135 - protein, 769 aa, Bacillus cereus ATCC 14579
MFGEKEGDYTMNTNTQTPSLSETMKEWHYALAYEIKHWKTIGGSKISIMNGRFLYTDYENTVYVFQLISEVSLPEGSPIRIEFDGEEATGEVLSVHGLEIELKLNDYIQGEIREAVLYSEPWQLLEQLQERLKEARKDKLKRNRIKRLVDGTSSPKHIEKMKNPKNELAYRAFYNPTTYVWGPPGTGKSYNLSRIISAHYQKGKSVLVLAHSNAAVDVLMSEVTKQIEKKKKWTPGEIVRYGYSQHEHIRNHETLLASKLVETTNGSWGEERLYLEETRQDLREKILSYKATSADKKRIQEIESDLRKQKAKIKEVEKEYIENAKVIGATLSKCAIDALIYERTFDLVVVDEVSMAFVPQIALAASLGKRIVVCGDFLQLPPIAMANHELVRKWLGEDMFYHAGIVESVNKSEAHPNLFMLQEQRRMHADISKFTNSFIYKNRVYDHPSVSERKELAQLQPFANEASVLFDTSQMGAFSLKDAASGSRFNIMSGLVAMQMMLIGLLDGIQSIGVVTPYRAQSRFLSTCIREMLQRTKYQHIPVLAATVHKFQGSERDMMIFDTVDSYPQERPGVLFFDHKNHRLVNVAVTRARGKFIQLSDCHYMRKNLSRKQALSQLTAHIERHGDVCDRTTSRQLWERKISKRLRWFMEMNLEEPKGLLKDILAAKRKIIISLPSTKQVDKRVWQAFMRTNAQIIVYSDGPVPLKNVKLQRQNKAFPFIVIDDEIFWAGAPLTSQMIFEGSTEFPYVCARLQAPETIGVLKGFLDIR

SEQ ID NO: 20136 - protein, 242 aa, Oryza sativa (japonica cultivar-group)
MRKAYKDSFKVLEADIQHANTLASEFPREYDGACLQMRLSYSPAAHIFLFLVQWTDCSLAGALGLLRILVYKVYVDGTTTMSTHERKASIKEFYAVIFPSLLQLQRGITDTEDKKQKAVCMERYRRRDEDERNILSEIDAEREEECGICMEMNSKVVLPNCTHNMCLRCYQDWNSRSQSCPFCRDNLKKTDPGDLWIYVEDQDVVDLETVSRENLRRLFMYINKLPLIVPDVIFSIYDSHIK

SEQ ID NO: 20137 - protein, 221 aa, Triticum aestivum
GDIPRAAFVQKSSLVPVRNSRDIVDPRVRVNDAMSRCAAPAAPATASVSQKLARHRDILHEFTQEFRRTRGNLSSMREHADLLSSVRGDITESKATGGMSPRVHLLRERASIHGSVTQIDEVIGQAQSTRAALSNQRALFGDVQGKVKQLGEKFPGVRGLLGAIKRKKSKDTFISSAEIAACTIFLIIYWLSKDRSVVGKAREREFLSHPQITDQCTQMAQ

SEQ ID NO: 20138 - protein, 391 aa, Oryza sativa (japonica cultivar-group)
MATAAAASLQYALHGAASASAKPRSAAPGRSVRVVAARRSVRARGGAVVARAAVTASADATAESKSGGHEVLLFEALREALIEEMKEDPTVCVFGEDVGHYGGSYKVTKGLAEMFGDLRVLDTPIAENSFAGMGVGAAMKGLRPIVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYICCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 20139 - protein, 495 aa, Staphylococcus aureus subsp. aureus Mu50
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 20140 - protein, 112 aa, Populus deltoides x Populus maximowiczii
TFVGKKWFVTYHAYAMGRMESIWGKNCRDFVPERWLENGIYRQESPFKFPVFHAGPRMCLGKDMAYIQMKSIAASVIERFEIDVQNKEKCPDHLLSLTLRMKGGLQVKVKER

SEQ ID NO: 20141 - protein, 491 aa, Oryza sativa (japonica cultivar-group)
MSSSLASRRSSSSSAAKRPAAGEGGGKAAAGAAAAKKRVALGNITNVAAAANNAKFNSATWAAPVKKGSLASGRNVGTNRVSAVKSASTKPASAISRHESAPQKESVLPPKVLRIVPTAAPAPVTVPCSSFVSPMHSGDSVSVDETMSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEVLEMEASVLNYLKFEMTAPTAKCFLRRFVRVAQVSDEDPALHLEFLANYVAELSLLEYNLLSYPPSLVAASAIFLAKFILQPAKHPWNSTLAHYTQYKSSELSDCVKALHRLFCVGPGSNLPAIREKYTQHKYKFVAKKPCPPSIPTEFFRDSTC

SEQ ID NO: 20142 - protein, 345 aa, Oryza sativa (japonica cultivar-group)
MSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEVLEMEASVLNYLKFEMTAPTAKCFLRRFVRVAQVSDEDPALHLEFLANYVAELSLLEYNLLSYPPSLVAASAIFLAKFILQPAKHPWNSTLAHYTQYKSSELSDCVKALHRLFCVGPGSNLPAIREKYTQHKYKFVAKKPCPPSIPTEFFRDSTC

SEQ ID NO: 20143 - protein, 169 aa, Glycine max
FGSRGIELQLQGWYNRFQRDEVVAQWKKVKGRMSLHVHCHISGGHFLLDILARLRYFIFCKELPVVLKAVVHGDENLFNSYPELQDALVWVYFHSNIPEFNKVECWGPLKEASAPTGGVQEEGLAIPQPCQEECQCCFPPLTLSPIQWSKQVPSRHYEPCDGIGTQQNL

SEQ ID NO: 20144 - protein, 177 aa, Plantago major
MASSMLSTSSTAVAGRAQATMVAPYAGLKSTSVFPATRKTGNAKLARNAGKVRCMQVWPPLGKKKYETLSYLPDLTVEQLAKEIDYLLRSKWIPCLEFELEHGFVYRENNRSPGYYDGRYWTMWKLPMFGCTDASQVIAELEECKKEYPNAWVRIIGFDNVRQVQCISFIAAKPPGL

SEQ ID NO: 20145 - protein, 447 aa, Bacillus subtilis subsp. subtilis str. 168
MKNDNQTLKRTMTSRHIMMMALGGAIGAGLFKGSSSAIDVAGPSVIIAYLLGGIILLFIMQGLAEMAVRNRNARTFRDLVQQVLGNYAAYFLDWIYWKMWVLNIAAEAVVAAIFIQYWLPGCPIWVLALGISLIVTIVNLLSVKIFAETEYWLAMIKITVIIIFIILGLLLLFVSFGDHTASGFSNLTDHGGFFPHGGTGLITAMLVVIYSYGGTEIIGVTLAETKNPEKVVPKAVRSTLTRIVAFYLLPFFIIVSLIPWNQVNSVPESPFVMVFKMVGIPGADHIMNAVILLAIISSMNSGLYGSSRILYTQASDGRLPKVFSKLSSKNVPMFAILMCTSSLYIGVLISLFAGSQTFNYLMGSLGYTVLFIWLIIGFAHLKSRKQQTETPAYYVKWFPYTTWFAIVALLAILIGVIMTTSIVITGITAAIYLLITVAYLVKGRKHQ

SEQ ID NO: 20146 - protein, 336 aa, Bacteroides thetaiotaomicron VPI-5482
MIKVGINGFGRIGRFVFRAAMKRNDIQIVGINDLCPVDYLAYMLKYDTMHGQFDGTIEADVENSKLIVNGQAIRITAERNPADLKWDAVGAEYVVESTGLFLSKDKAQAHIEAGAKYVVMSAPSKDDTPMFVCGVNEKTYVKGTQFVSNASCTTNCLAPIAKVLNDKFGILDGLMTTVHSTTATQKTVDGPSMKDWRGGRAASGNIIPSSTGAAKAVGKVIPALNGKLTGMSMRVPTLDVSVVDLTVNLAKPATYAEICAAMKEASEGELKGILGYTEDAVVSSDFLGDTRTSIFDAKAGIALTDTFVKVVSWYDNEIGYSNKVLDLIAHMASVNA

SEQ ID NO: 20147 - protein, 382 aa, Ostreococcus tauri
MGRPTGAGGGDDADEITEQMAKMLAKIEEQKKYLIAGADRNANAKEIAYGGAYASMEGEGAFSVDAFRETFALTITDASEERVVFEMEGCSAAFANAFRRIIISEVPTMAIEKVYMINNTSVVPDEVFAHRLGLVPIKADPARFEYRGPNDLANETNTIVLSLHARCHRERLDDGSLGEVVNRSVYSNALQWCPDGSQLPEEERAKYSDFKRSQRESFGEEELGCVHDDILLVKLAPGQEIELECHCVKGIGQEHSKWSPVGTCWYRMVPEITILEPITGADADVFMERCANFNDTHACYACEGKGDKKTVKVVETRGCDLCVERVRELTGEPGWDEKIAVRKHKNHFIFTIESVGQMKPGTIFKEAVKILASKCQNVLSTL

SEQ ID NO: 20148 - protein, 507 aa, Bacteroides thetaiotaomicron VPI-5482
MQEKIIILDFGSQTTQLIGRRVRELDTYCEIVPYNKFPKEDPTIKGVILSGSPFSVYDKDAFKVDLSEIRGKYPILGICYGAQFMAYTNNGKVEPAGTREYGRAHLTSFCKDNVLFKGVRENTQVWMSHGDTITAIPDNFKKIASTDKVDIAAYQVEGEKVWGVQFHPEVFHSEDGTQILRNFVVDVCGCKQDWSPASFIESTVAELKAQLGDDKVVLGLSGGVDSSVAAVLLNRAIGKNLTCIFVDHGMLRKNEFKNVMNDYECLGLNVIGVDASEKFFAELAGVTEPERKRKIIGKGFIDVFDVEAHKIKDVKWLAQGTIYPDCIESLSITGTVIKSHHNVGGLPEKMHLKLCEPLRLLFKDEVRRVGRELGMPEHLITRHPFPGPGLAVRILGDITREKVRILQDADDIYIQGLRDWGLYDQVWQAGVILLPVQSVGVMGDERTYERAVALRAVTSTDAMTADWAHLPYEFLGKISNDIINKVKGVNRVTYDISSKPPATIEWE

SEQ ID NO: 20149 - protein, 351 aa, Arabidopsis thaliana
MGGCCFSTPLDNNQQPPQQPQIPPGERKNDGFVNWPVTEFFLSDITTATNNFSSDEIISENAEESSNVVYKGCLLENLGFVAVKRFKNTPWDDPDYFTEDAKTAGELKHKRLVKLLGYCCEEDEGLLVAEFMPNDTLAKRLFQEKNMEWSMRLRVAYHIVEALDYCNSVRFDEYDNLSAYTVLFDKDGDACLSSFGLVKEIIRYNRREGGNQFALVSSDYSYQNVMFYILIVGNVRTGNVTYRFGTILVNLLTGLQISPSHAPEMINGKDVTELMDPNLKGKFSTEEATIVLKLASECLQWKGYIENGITKKLVATLKALQAKKEISSSEMHEVTKQHDVASSSSQQQLPP

SEQ ID NO: 20150 - protein, 405 aa, Robiginitalea biformata HTCC2501
MMRMHRNLVFAVWDGLDQIFNENAYADKVVEKLLRRDKRWGSRDRGFIAETVYDMVRYRRLYAEIAGVSAPYSRQDLGRMFAVWAILRGHTLPDWKEFAGTPERRIKGRFDALQESRAVRESVPDWLDALGAESLGEAVWDRELRALNQQAEVVLRVNRLKASPEQVRESLSEAGFETAPISGYPDALRLLERANVFGSEAFRSGWFEIQDASSQRVAPLLAPEPGMRVIDTCAGAGGKSLHLAALMENKGQILALDIYANKLRELKKRAKRAGAFNIETRPIESSKTLKRLAGSADRVLIDAPCSGLGVLRRNPDAKWKLRPEFVEELTRTQAELLNSYSQLLKPGGKLVYATCSILPGENEQQVARFLDSGAGQAFRLEEEHRILACESGFDGFYLALLNHTG

SEQ ID NO: 20151 - protein, 485 aa, Burkholderia pseudomallei K96243
MSFASLGLAEPLVRAVNELGYTQPTPIQAQAIPAVLGGGDLLAGAQTGTGKTAGFTLPILQRLHAFYAENRSARRAVRALILTPTRELAAQVEESVRAYSKYVKLRSTVMFGGVSINPQIDALKRGVDIVVATPGRLLDHMQQKTIDVSSLDILVLDEADRMLDMGFIHDIKRVLAKLPAKRQNLLFSATFSDEIKSLADSLLDSPALIEVARRNTTAETIAQKIHPVDRDRKRELLTHLIREHNWFQVLVFTRTKHGANRLAEQLTKDGISAMAIHGNKSQSARTRALSEFKSSTLQVLVATDIAARGIDIDQLPHVVNFDLPNVPEDYVHRIGRTGRAGANGEAVSLVCVDEKQLLRDIERLIKREIPQQVIPGFEPDPNAKPEPIQRRGQRGAVAGNGGSGNGNSGGAGNGGRGNRAPRAASQPQAQQGQAAARRDGGTQAKAAKPQQARGGNSRPAGNGNSNGGGAHANRSRSSRSGQRGR

SEQ ID NO: 20152 - protein, 461 aa, Arabidopsis thaliana
MICVNCDIYIFFFINTKKIIIKYEAINFFFFFKPHRTKFILPFFYFLFLSTEILSYFHRSSPSDHQNTPVKMKNWIPNDLIYEILSRLPAISVARSKARPRLLIGVQQDGEWRFYSTPQSQNPCENKLSPADFHMKFSKGISNYSCSYASGLIYFDGMCIRKEDEDAKHVLCDPLTGKYVILPELRVGDSYSYLGFDPVDKEFKVLFMTTRNNIAWKDLDHYILTLGTGELKWRRIRCAFTHEPVWERICINGVLYYSAMNSDGNYVIYASHDGGSTVKLSMWVLEDVEKPEWSKHVYSLWTESQVVKVNHNLSVSGMTATGDIVLSTKYASQPFYVFYFNPERKTLQVPSVEVEGLGANRACMSYYAFADYVEDLSVNDAVRQLKSSPLQQQGQNIVTKRPKPRQGQDTSHDLSKSAPSVKNNKWFKSINKDDVVTFTTEDFPWNTLRSKSVYRFSDSFI

SEQ ID NO: 20153 - protein, 708 aa, Arabidopsis thaliana
MKNSIPIDLIYEILSRLPAKSVARCRCVSKRWRSILRHQVFTELFLTRSNARPRLLIGVQQDGEWSFLSTPQPQNRHESSSLVVAAADFHTKFSSGKSRHQCTYASGGSYSYLGFDPIDKEFKVLFMDTCDFIASKDEDHYILTLGTGELKWRKIQCPFTHEPFWERICINGVLYYSAYYSDSNGRSHLIACFDVRSEKFNFIATKHRYDQLINYKGKLCGINLEYARHVGGFPVKLSMWVLEDVEKPEWSKHVYSLWTESEVVKVNRNLSVSGMTATGDIVLSMEDATNPFYVFNFNPDRNTLQVQSVEIQGLGANRDHIACHAFVDYVEDFSVSDAVLQLKSSPLQQQGQDTSHDLSKSVKNKQLDNYEFLANKLNHSVSLAILFSKSVARCHCVSKQWRAIFRRKYFIELFLTRSKARPRILFVVQDGEWSEWSFLSLPQPQNSSLVVESADIHMKKFSAGISGSIYFTYASGLIYFKCMRIPKEDEDEKPVLCDPLTGKYVILPEPRVFGMYSYLGFDPVDKEFKVLFMASGYTASKDVDHYILTLRTGELKWRTIQCPFTHEPLWTRICINGVLYYSAMNSDGNYVIVCFDVRYEKFKLVDTKCRSEFNGLINYKGKLCGVKLKYAYRVGFPVKLRMRVLEDVEKDEWSTYVKVKVKQNLSVAGMTATGDIVLFMKFASNPLHHSIGLTILYSCLIYFVFLAL

SEQ ID NO: 20154 - protein, 1201 aa, Arabidopsis thaliana
MNSFPNDDLVYEILLRLPAKSVARCSCVSKLRRSILSRQDFTELFLTKSSARPRLLFGVKRANGEGLFFSSTQPRNSYEKSSLVVAADFHTKFSEVISREICSYASGLIYLSDMRISVNDEDVVRAICNPITGNYLGFDPIDKQFKVLFMAYPSGPDDHKILTLGTRRMRWRKIHCPLTHDPFCEGICINGVLYYLAIQIDEPLGKLGGIDWKHGNANGSRTFELSMWVLEDVEKHEWSKYDCTFLEYEVMFYNISLAVGMTATCEIVLSEKFASKSFYVFYFNPERETLQRVEIQGLENHCRVYTITDHVEDLNVNDAKQLNVRQIKPKEEEAETHILKMVTWRKTPNEGKVGVINLTHAYERVFPLQLRMTVLEDFEKQEWSTYVYTLMAENIVVKYVSVVGMTATGDIVLVKTNACKPFYVFYFNPGRNTLLSVEIQGVGEDHKCLNFHTVCAFVDHAAKKILVALDQKRKATSAPKVFLAVKSEKNPEEEVEIHCATETVANILVNEFDEPILGVELLLLSLASESLGKSSLVVAADFHMKFSKDISPNSCSYASSLIYFPIIQISKEWDDEVRAICNPSTRQYAILPPDLRTTYQNFGPLLGFDPIGKQFKVLVFNCRVGNELVYHILTLGTENVRWREIICPFTYEPRWKRSICINGILYYLAVNSNVSSSVINYKLINYKGKLGLVDLEKDYDAGYLLGADENKVFNNNLSVVGATASGTLSEVLKSKVLEKRKNGLTIIQFINYFVDHVEDLRFDGMKTTYVAPSLSPPEQSTSSSSEDPCSLGTRSFRSRTIMNSEENTDSIPIDLILDILSRLPSKSIARCRCVSKLWESMIRQSYFTELFLTRSSSRPHLLIAVEQEGEWKFFSLPQPKNYLGKSSLVVAANLHLKFFEDKRPQHGCSYASSLIYFPNMTIRKKGDDHLGVICNPSTGQYGYVILPPLLDFKSVPYGKFLGFDPIDKQFKVLIPIFDFDKHQTDHHILTLGAETVGWRKIQSPLRYLPHSNGTICINGILYYLAKINYAMDKNVLVCFDVRSENFVFLRLNTYCSSTKLVNYKGKLGMINQEYVDDGGFPLKLSVWVLEDVGKEEWSTYVYTLRDDNKVDQVKYNLSVVGVTASGEIVLVKKTQTLKPFYVLYFNPDKNTLLTVEVKGLHRGLYAVHRIYAFVDHVEDLEFNIMKTTYAAKSKFSQEDRF

SEQ ID NO: 20155 - protein, 602 aa, Oryza sativa (japonica cultivar-group)
MAAAAAVAKSVEAGGEPGGGGGGAWSTVSRSGRSSYSAGGGVGGGKVGELAEGLAGVEIGGERRLDKYDIPVEVSGEDVPPPADGFEAAGLVEAVLRNVARCGYESPTPVQRYSMPIALAGRDLMACAQTGSGKTAAFCLPVVSGLVAAGGSGIGHRERSSFNRAAAKPRALVLAPTRELAAQINEEAKKFSFQTGLRVVVAYGGTPMYNQLRDLERGADILVATPGRLVDMVERSKVSLEAIKYLVMDEADRMLDMGFEPQIRKIVERMNMPRKSVRQTMLFSATFPPEIQRLASDFLSNYIFITVGRVGSSTDLIMQKVELLSDGEKRGYLLDLLQRQSVGVANSKLQQPLTLVFVETKREADSLRYWLYSKGFPATAIHGDRTQQERESALRSFKTGLTPIMVATDVASRGLDVPNVAHVINYDLPKSIEDYVHRIGRTGRAGKAGSATAFFTESDHSLAKGLLELMTEAKQDVPDWLVQYAERPYYGGSSYGGRNRRSGGGGNRFAGRDFRQGSGGGYSGGGGGGGYSGGGGGGGYSGGGGGYSGGGRGGGYSRGGRGGYSGGGGGGGGDPYRASAPPPRYYPSYPMGTADINASGWD

SEQ ID NO: 20156 - protein, 476 aa, Zea mays
MAHPHLVLPSPKSLLPAAATPSRRAVAIRAALSTALSPAKAAAGAEAVRSIRARQIVDSRGNPTVEVDLVAGDGRLHRSAVPSGASTGIYEALELRDGDKAVYGGKGVLQAVRNINEVIAPKLIGVDVRNQSDVDAVMLDIDGTQNKSKLGANAILGVSLSVCRAGAGAKGVPLYKHIQELAGIKELVMPVPAFNVINGGSHAGNNLAMQEFMILPVGATTFAEALRMGSEVYHVLKSIIKSKYGQDACNVGDEGGFAPNVQDNREGLILLMDAIEKAGYTGKIKIGMDVAASEFLTKDGNYDLNFKNQPNDGAHILSAQHLGDLYRDFVKDFPIVSIEDPFDQDDWSSWASLQSSVDIQIVGDDLLVTNPKRIADAIDKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 20157 - protein, 1333 aa, Saccharomyces cerevisiae
MECVSVEGLDSSFLEGQTFGDILCLPWTIIKGIRERKNRNKMKIILKNVSLLAKSGEMVLVLGRPGAGCTSFLKSAAGETSQFAGGVTTGHISYDGIPQKEMMQHYKPDVIYNGEQDVHFPHLTVKQTLDFAISCKMPAKRVNNVTKEEYITANREFYAKIFGLTHTFDTKVGNDFISGVSGGERKRVSIAEALAAKGSIYCWDNATRGLDSSTALEFARAIRTMTNLLGTTALVTVYQASENIYETFDKVTVLYAGRQIFCGKTTEAKDYFENMGYLCPPRQSTAEYLTAITDPNGLHEIKPGFEYQVPHTADEFEKYWLDSPEYARLKGEIQKYKHEVNTEWTKKTYNESMAQEKSKGTRKKSYYTVSYWEQIRLCTIRGFLRIYGDKSYTVINTCAAIAQAFITGSLFYQAPSSTLGAFSRSGVLFFSLLYYSLMGLANISFEHRPILQKHKVYSLYHPSAEALASTISSFPFRMIGLTFFIIILYFLAGLHRSAGAFFTMYLLLTMCSEAITSLFQMVSSLCDTLSQANSIAGVVMLSIAMYSTYMIQLPSMHPWFKWISYILPIRYAFESMLNAEFHGRHMDCGGTLVPSGPGFENILPENQVCAFVGSRPGQSWVLGDDYLRAQYQYEYKNTWRNFGIMWCFLIGYIVLRAVFTEYKSPVKSGGDALVVKKGTKNAIQRSWSSKNDEENLNASIATQDMKEIASSNDDSTSADFEGLESTGVFIWKNVSFTIPHSSGQRKLLDSVSGYCVPGTLTALIGESGAGKTTLLNTLAQRNVGTITGDMLVDGLPMDASFKRRTGYVQQQDLHVAELTVKESLQFSARMRRPQSIPDAEKMEYVEKIISILEMQEFSEALVGEIGYGLNVEQRKKLSIGVELVGKPDLLLFLDEPTSGLDSQSAWAVVKMLKRLALAGQSILCTIHQPSATLFEQFDRLLLLGKGGQTIYFGEIGKNSSSVIKYFEKNGARKCQQNENPAEYILEAIGAGATASVQQNWPDIWQKSHEYANINEKINDMIKDLSSTTLHKTATRASKYATSYSYQFHHVLKRSSLTFWRNLNYIMAKMMLLMISGLFIGFTFFHVGVNAIGLQNSLFACFMAIVISAPATNQIQERATVAKELYEVRESKSNMFHWSLLLITHYLNELPYHLLFSTIFFVSSYFPLGVFTEASRSSVFYLNYAILFQLYYIGLALMILYMSPNLQSANVIVGFILSFLLSFCGAVQPASLMPGFWTFMWKLSPYTYFLQNLVGLLMHDKPVRCSKKELSLFNPPVGQTCGEFTKPFFEFGTGYIANPDATADCAYCQYKVGDEYLARINASFSYLWRNFGFI

SEQ ID NO: 20158 - protein, 450 aa, Crocosphaera watsonii WH 8501
MSYDFDLFVIGGGSGGIATARRAAEYGAKVGLAEYNRLGGTCVNVGCVPKKLMVYTSHFSAQFQESQGYGWSPVKSTLDWSKMITAVNEETQRLNGIYLRMLDNSKVKLYRDYAKLLDPHTIEVGNSKITADKILIAVGGHPVRPDIPGIENTIISDQMFTLAEQPKRMVIWGGGYIGVEFACIMRGLGSDVIQVIRRDKILRGFDEDIRSTIQESMENHGIKILKNCTITAIEKTSQGLKIAVQGDQNNEMVLVDTIGLAATGRKPSLDNLGIENTAVEVNNGAIAVDQYGCTAQDNIYAVGDCTDRINLTPVAINEGRAFADTHFGGKSRVMSYENVPSAVFSTPEAATVGLTEEEAKQQYGEDAIKVYRSKFRPMYYVLPGKEEKTLMKLIVHQESEKVLGAHMVGDYAAEIIQGVAIAVKMGAKKSDFDATVGIHPTSAEEFVTMR

SEQ ID NO: 20159 - protein, 525 aa, Spiroplasma citri
MKAKQPILLAILDGWGIAPDSKGNAVTQGHMVNVEKLKTKYPWVSAHAAGEWVGLPEGQMGNSEVGHIHLGAGRIKYESLTLINKTIKDGTFNQNPELLAAINFAKKSNGAFHIMGLFSVGGVHSHLNHIFAAYKLAAQEGIKEIYLHIFGDGRDTKPECIKIYLEQFQQLQNQLKVGEIATIGGRYYAMDRDKKYDRVQIAYDVLVSRKGSEFSDPIEYINREYQAGRNDEFLMPAYNINTPKGYIKSGDGVFFANFRPDRAIAIASALTNPNFPGNEAQTYFMPKLHDIYFVSMMEYAETVASKHVAFKPIKVVNGLGEWLSKKGYRQLRIAETEKIAHVTFFFDGGKDYFKNGLATQAEITLTGASADLIPSPKVATYDLKPEMSAYEITDKLITELNQNEFDVIILNFANCDMVGHTGILPAAIEAVKTIDNCLGKIYTAIQKVNGIMIITADHGNVEIMIDETGGPNKKHTSQLVPIIITKEGLQLRQDNPAIADIAPTILDLLGEGIPPEMTQPSLIIK

SEQ ID NO: 20160 - protein, 174 aa, Plantago major
MASAMMSSAATVTAQTSMVGQFSGLKFGSTFPIAKKTGRVSSPSSGLKVRCMQVWPPTGKKKYETLSYLPDLTVEQLAKEIDYLLRSKWIPCLEFELEHGFVYRENARSPGYYDGRYWTMWKLPMFGCTDASQVIAELEECKKEYPNAWVRIIGFDNVRQVQCISFIASKPPGL

SEQ ID NO: 20161 - protein, 278 aa, Bacillus halodurans C-125
MKKLFGLLGHPVGHSLSPLMHNQMFQLLDFDGYYHAFDVEPSQLEKAVEGARALQMQGFNVTIPHKVTIMDYLDMVDEEAQEIGAVNTVVMKDGQLFGSNTDGQGYLESLMDVVTTPFPTQDVLIIGAGGAARAIGTVLKREKVRSITIANRTLAKAEEFSGVLESSETSCSALSLKEAEQQLERFSVIINTTSVGMSPRVDDMPLSLERLSRETVVSDLIYNPLETKFLREAKQKGAKTVDGLGMFVNQGALAFELWTGLRPDREKMRRCVLEQLGG

SEQ ID NO: 20162 - protein, 493 aa, Oryza sativa (japonica cultivar-group)
MTSRKPPGIRLFGGITVLRTYQTLVLVLTFVAYTCFHMTRKIPSIVKSVLDPQTKLGSSPWGRLHTKNTLNIGWLPFNTIDGSALLGEIDVAFLAVYSVGMFFAGHLGDRMDLRIFLTIGMFGTAVFTALFGAGYWLNIHNFYYFLVIQMIAGLFQAIGWPSVVAIVGNWFGKSKRGLIMGIWNAHTSVGNISGSLLAAFLLKFGWGWSFAIPSLIMVAVGLLVFVFLPVSPEVMEIDIDDGEISSVKDTTKEPLLEPGQEVKHNAVGFLEAWKIPGVAPFALCLFFSKLVAYTFLYWLPFYISHTPIGGEYLSDALAGSLSTIFDVGGVLGGVLAGHISDRLNARAVTAASFMYCAIPALFLYRTYGSMSIMWNICLMFITGMFVNGPYALITTAVSADLGTHSSLNGNSRALATVTAIIDGTGSVGAAIGPLLTGYISSSSWSAVFTMLMAAALLAGLLLTQLVCSELKGKATSNASKDVADAQGTYSDEV

SEQ ID NO: 20163 - protein, 550 aa, Carboxydothermus hydrogenoformans Z-2901
MVEKAYPWVKHYPPHVPLSLTYPETPLYELLRKTAQKVNKTALIFFNKKLSYSELTEYIENLAVNLSPLGLEPGDRVGIMLPNSPQYVIAYFALMAARMIAVPLNPLLSARELTYIIEDAGVKAIFALNLFAEKLKNLDNVKIIYTAIADFLAFPLNFLLKLKEKAPPVKIDNEKVFALMPLLKNTGSKNFSPKQRDLKKEPAVIIYTSGTTGKPKGVMLSEYALIVNAYHVKVWGDLVPEDVMLTVLPIFHGFGMSVCMNAPLLTGSSVVLLPRFSVEEFFKAVAKHRPTLFAGVPTMFVAMLNHKDLTKYDLSSFRGCFVGAAAMPPEVKEQFEKMTGAQVLEGYGLTEAVTAKCCNPYRGVNKTGSIGIPFPDTVMEIVDAFTGEPLPPGEIGEIRLKSPDLMLGYYKQEAATREVIKDGWLYTGDIGRMDEDGYFYIVDRKKDLIITGGFNVYPREVEDVLYSHPDVKEACVVGIPDNYYGEVVKAYVVLKEGAKTSPEELKAFCRENLTHYKVPKIIEIKDDLPKSAIGKILRRALKEMESEARQ

SEQ ID NO: 20164 - protein, 137 aa, Brassica napus
MVSRQEGTLYTRKRDFTIYGEEFHNSFKKSKQEDPSQGKLQSTMFNERPKSESMRSITFDFELHLHTPLPSNCQKSIEAKGYSRASEDHSSYPKDPVIVGRPKMSLDLELNLSPSTITTKIDESTNHNKTVSSSEGK

SEQ ID NO: 20165 - protein, 513 aa, Oryza sativa (indica cultivar-group)
MVDRLLKDDATEEKGERARMASFVGGMAISDLVKTTLGPKGMDKILQSTGRGRSVTVTNDGATILKSLHIDNPAAKVLVDISKVQDDEVGDGTTSVVVLAGELLREAEKLVNMKIHPMTIIADKFRSDLMNIAMTTLSSKILSQDKEYFAGLAVDAVLRLKGSTNLEAIQILKKTGGSLKDSFLDEGFILDKKIGLGQPKRIENAKILVANTAMDTDKVKIYGARVRVDSMAKVAEIEAAEKQKMREKVQKIIGHGINCFVNRQLIYNFPEELFADAGILAIEHADFEGIERLALVTGGDIASTFDNPESVKLGHCKVIEEIMIGEDRLIHFSGVEMGQACTIVLRGASEHVLDEAERSLHDALCVLSQTVNDTRVLYGGGWPEMVMAKEVDGLARKTPGKKSHAIEAFSRALQSIPTIIADNAGLDSADLISQLRAEHHKEQSTAGIDVISGGGLELILRLLPQVGDMEKLGISESFKAKQAVLMSATEAAEMILRVDEIVTCAPRRREDRM

SEQ ID NO: 20166 - protein, 275 aa, Crocosphaera watsonii WH 8501
MVAATQSLQELCINSIRFLAVDAVEKAKSGHPGLPMGAAPMAYVLWDKFMRFNPKNPKWFNRDRFILSAGHGCMLQYALLYLTGYDSVTIEDIKQFRQWGSKTPGHPENFETEGVEVTTGPLGQGIANGVGLALAEAHLAATFNKPDATIVDHYTYVILGDGCNMEGVAGEACSIAGHWGLGKLIALYDDNHISIDGSTDVAFTEDVSKRFEAYGWHTIHVPNGNTDLDAIAKAIEEAKKVTDKPTMIKVTTTIGYGFSQQTRHRRCSRCCFGCR

SEQ ID NO: 20167 - protein, 368 aa, Thermotoga maritima MSB8
MGETKLFFGPNHPGMHGNFSVHMYVEGDIVKKARPVPGFLHRGFEKLMERRYWYSNISLIPRICVPEPDINEICYAMAIEKIAKVEVPERAQWIRMIVLELARIANHIWTVGGIGGPLGLYTASHWGVADRDRILDIFEALSGARVYHMYIIPGGVRKNMTPKIEEMIWKTLDYIESRLPDYENLIFKNRIVHSRLRGRLILTREQAVEMGVTGVGLRATGVEYDIRKVDPYLFYDRVEFEVPTATDGDAFSRVYLKFKEIPQSIKIIRQALEKMPQADRVNVPIGRGNGLRRIVPKGMAYAHVESTRGEYGFFVVSDGKNKPYRVAVRGASYPQGLYGIEKYLPGTRIEDVPIWLATMDVCAPEIDR

SEQ ID NO: 20168 - protein, 105 aa, Triticum aestivum
  misc_feature (5)..(5): Xaa can be any naturally occurring amino acid
  misc_feature (8)..(8): Xaa can be any naturally occurring amino acid
  misc_feature (16)..(17): Xaa can be any naturally occurring amino acid
  misc_feature (23)..(23): Xaa can be any naturally occurring amino acid
  misc_feature (25)..(25): Xaa can be any naturally occurring amino acid
  misc_feature (29)..(29): Xaa can be any naturally occurring amino acid
  misc_feature (32)..(33): Xaa can be any naturally occurring amino acid
  misc_feature (37)..(37): Xaa can be any naturally occurring amino acid
  misc_feature (41)..(41): Xaa can be any naturally occurring amino acid
  misc_feature (44)..(44): Xaa can be any naturally occurring amino acid
  misc_feature (47)..(48): Xaa can be any naturally occurring amino acid
  misc_feature (52)..(52): Xaa can be any naturally occurring amino acid
  misc_feature (54)..(55): Xaa can be any naturally occurring amino acid
  misc_feature (60)..(60): Xaa can be any naturally occurring amino acid
  misc_feature (62)..(62): Xaa can be any naturally occurring amino acid
  misc_feature (68)..(68): Xaa can be any naturally occurring amino acid
  misc_feature (71)..(73): Xaa can be any naturally occurring amino acid
  misc_feature (76)..(78): Xaa can be any naturally occurring amino acid
  misc_feature (80)..(81): Xaa can be any naturally occurring amino acid
  misc_feature (83)..(83): Xaa can be any naturally occurring amino acid
  misc_feature (86)..(86): Xaa can be any naturally occurring amino acid
  misc_feature (89)..(89): Xaa can be any naturally occurring amino acid
  misc_feature (93)..(93): Xaa can be any naturally occurring amino acid
  misc_feature (97)..(98): Xaa can be any naturally occurring amino acid
  misc_feature (102)..(102): Xaa can be any naturally occurring amino acid
  unsure (1)..(105): unsure at all Xaa locations
VNQEXLIXIKSVMEEXXSNITTXQXKEYXWKXXKSGXVVPXYGXGVXXNTDXRXXCQREXAXKYFPEXPLXXXVSXXXEXXPXILXELXKVKXPWPXXDAHXGVL

SEQ ID NO: 20169 - protein, 353 aa, Oryza sativa (japonica cultivar-group)
MHPRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNGF

SEQ ID NO: 20170 - protein, 557 aa, Galdieria sulphuraria
MEAITEFQQAAEPKNDLYDSTELQKEAGVTDLDDEYLTEEERLHPWRQTRTFYWSVIVASVAVLFYGIDITAISGAQVGYIPHFGLENRTYHQGVMVSCIYFGCFVGVFIALFTNTYFGRRFTISLASFISTGACIWEAVSPSWQVFIPGRIILGFSYGMIGETAPVYLAEMSPASIRGAIVSLYQQVVTIGIFLAYLCNLIFVWVNYQNVGWRIMIGFPMVPSVIEMFLIWTVPESPRWLIKRRRYEDAKRNLFKLRRTAETAERDFVRIKKGVEEDEILQKGKNLLVEVIPVPYIRRALLIGIMEMLFQQMSGMNVFMNYIDEVFEENINMGARTSVAVSLFPGFVNMVATVIVYFTIDRYGRRTLQLVTFPVMFLMLLMVLFSFYGDKKVNLAFFIIGVVFFIVAYSPGAGPVPWTFCAEVFPTYVRAAGTTITTFFVNAFNFALSFSWPSMKAAWGPQGGFGFYAGFNFLGIVMQFLFLPETKGFTLEQMRVVFEEGLFTIAAYHCRAGWRSLRKLLGLSVPDTPLVSPYDKAFAIDRAKREEEMMHAGEVSK

SEQ ID NO: 20171 - protein, 482 aa, Salmonella enterica subsp. enterica serovar Typhi str. CT18
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQTDKRLLVIKQPIGVTAAITPWNFPSAMITRKAGPALAAGCTMVLKPASQTPFSALALAELAQRAGILAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 20172 - protein, 424 aa, Bordetella pertussis Tohama I
MTVDSPILTDTLVVGGGQAGIAMSEHLTGQGVPHIVLERDRIAQRWRTGRWDSLVANGPAWHDRFPGLEFEGLDPDGFASKDAVADYLEAYARKFNAPIRTGVEVVRAERNGGRYGFTVETSAGTYEAQRIVVATGPFQRPVIPAIAPRDPALTQIHSADYRNPGQLPEGAVLVIGAGSSGVQIADELQRAGREVYLSVGPHDRPPRRYRGRDFCWWLGVLGLWDQETVQPGREHVTIAVSGTDGGRTIEFRALAHQGITLVGVTKSFRDGVVAFENDLAENVARGDANHFALLDAADAYIARNGLSLPDEPQARRVPPDPACMTEPILQLDLAAANVTSIIWATGYAAEYGWLNVDAFDANGKPRHQRGVSSEPGVYFLGLPWLSRRGSAFLWGVWHDAKHIAGHIAMQRNYLSYPDFGQSQQ

SEQ ID NO: 20173 - protein, 427 aa, Salmonella enterica subsp. enterica serovar Typhi str. CT18
MNTNNTLMQRCHNAVPRGVGQIHPIFAERAENCRVWDVEGREYLDFAGGIAVLNTGHLHPGIVSAVEAQLKKLSHTCFQVLAYEPYLALCERMNQKVPGDFAKKTLLVTTGSEAVENAVKIARAATKRSGAIAFSGAYHGRTHYTLSLTGKVHPYSAGMGLMPGHVYRALYPCPLHNISDDDAIASIERIFKNDAAPEDIAAIIIEPVQGEGGFYAASPAFMQRLRALCDQHGIMLIADEVQSGAGRTGTLFAMEQMGVAADITTFAKSIAGGFPLAGVTGRADVMDAIAPGGLGGTYAGNPIACVAALAVLDIFEQENLLQKANTLGKTLRDGLMEIAETHREIGDVRGLGAMIAIELFENGDPGKPNATLTADIVARAREKGLILLSCGPYYNILRILVPLTIEASQIRQGLEIIAQCFDEAKQA

SEQ ID NO: 20174 - protein, 466 aa, Salmonella enterica subsp. enterica serovar Typhi str. CT18
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALSKVIAILAFIALGAAAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 20175 - protein, 412 aa, Galdieria sulphuraria
MEALVNIWGLLLTARVILGVSFGIFSSTVPIYLSECAPARVRGMLTGTYQLSVTLGLFLGSVSDAIFVNVSNGWRFMLGTVIIPPCLCLIGLLFTPESPRWLIYKRKYPQALDSLRKVKTTEAEALADLNSIKESITRTWRERSGHGAIYKIITTPYIRHALVIGMFLQLSRQLSGVNAMLYYFDVVLRSAGMSISHAVYVNVAYGAATFLFTLPMFWIVDRFGRRVLLVYTMPIIACMCLLVGLSFLGSRRVRMALSIVGFLLFRLFYSPGLGPISWVITAEIFPLEVRSECLSICTFFSYAFNFVVSFSFPDMMDQMKTEGAFAFFAGCTLIDWIIFFLFVPETKGLDMEVVDQLFRQSWTSQAKQNLKQLKDLFPCIASNNIETCENRNTNSTDITDPSCAEKESQEMK

SEQ ID NO: 20176 - protein, 1043 aa, Oryza sativa (japonica cultivar-group)
MTTSPPPPPPAEQQQQQEEEEVLVPRQELPNGTQPMEVVPSEPAATVENQQIEDPPISRFTWTIENLSRVSTKKLYSEIFVVGGYKWRILIFPRGNNVEYLSMYLDVADSAVLPYGWTRYAQFSLSVVNQMHNKFTIRKETQHQFSARESDWGFTSFMPLGDLYNPSRGYLVNDTCIVEAEVAVCKVVDYWSYDSKKETGYVGLKNQGATCYMNSLLQTLYHIPYFRKAVYHMPTTENDMPSGSIPLALQSLFYKLQYNDSSVSTKELTKSFGWDMHDSFMQHDVQELNRVLSEKLEDKMKDAKKGVLFIDFPPVLQLQLKRFEYDFMRDTMVKINDRYEFPIQLDLDRDDGKYLSPDADRNVRNLYTLHSVLVHSGGVHGGHYYAFIRPTLSDQWFKFDDERVTKEDAKRALEEQYGGEEELPQTNPGLNNTPFKFTKYSNAYMLVYIRESDKDKIICNVDEKDIAEHLRIRLEKDREEKERRKKEKAEAHLYTIIKVARDDDLTTQIGKDIYFDLVDHDKVPSFRIQKQMPFTQFKEEVAKEFGIPTQFQRFWLWAKRQNHTYRPNRPLTPQEETHTVGQLKEAANKAHNAELKLFLEVELGLDLKPLPLPDKTREDILLFFKLYDPEKEQLRYVGRLFVKASGKPQDILPKLRKMAGFSQDEEIELYEEIKFEPNVMCEYIDNRLLFRACQLEDGDIVCFQKSPKPDTADQYRYPDVPSFLVYIRNRQVVHFRSLEKPKEDDFCLEMSKAFTYDEVVEKVAQKLGVDDPTKIRLTSHNCYSQQPKPQPIKYRGVERLLDMLIHYNQTSDILYYEVLDIPLPELQALKTLKVTYHHGTKDEVSVHSIRLPKNSTVGDVLNDIKSKVELSHPNAELRLLEVFYHKIYKIFAPNEKIENINDQYWTLRAEEVPEEEKNLGPFDRLIHVYHFTKDTQNQTQVQNFGEPFFMVIREDETLSSIKERIQKKLKVPDEDFSKWKFAYISLGRPDYFEDSDTVASRFQRNMYGAWEQYLGLEHPDTAPRKTHNANQNRHSFERPFAIS

SEQ ID NO: 20177 - protein, 236 aa, Haemophilus influenzae R2846
MTEKNKPICVVLTGAGISAESGIPTFRAEDGLWAGHKVEEVCTPEALQKNRAKVLDFYNQRRKNAAAAKPNAAHLALVELEKAYDVRIITQNVDDLHERAGSSKVLHLHGELNKARSSFDESYIVDCFGDQKLEDKDPNGHPMRPYIVFFGEMVPMLERAVDIVEQADVVLVIGTSLQVYPANGLVNEAPRKAPIYLIDPNPNTGFVRKQVIAIKEKAGEGVPKVVAELLENTKNS

SEQ ID NO: 20178 - protein, 359 aa, Arabidopsis thaliana
MFCSSMIDIANEFGVPCYMIYTSNATFLGITLHVQEMYDDKKYDVSDLDESVNELEFPCLTRPYPVKCLPHILSSKDWLPFFAAQGRSFRKMKGILVNTVAELEPHALKMFNNVDLPQAYPVGPVLHLDNGDDDDEKRLEVLRWLDDQPPKSVLFLCFGSMGGFTEEQTREVAVALNRSGHRFLWSLRRASPNIMMERPGDYKNLEEVLPDGFLERTLDRGKVIGWAPQVAVLEKPAIGGFVTHCGWNSMLESLWFGVPMVTWPLYAEQKVNAFEMVEELGLAVEIRKCISGDLLLIGEMEIVTAEDIERAIRCVMEQDSDVRSRVKEMAEKCHVALMDGGSSKTALQKFIQDVIENVA

SEQ ID NO: 20179 - protein, 748 aa, Oryza sativa (japonica cultivar-group)
MRLGCVLEHVAPRLAVASAALLGAGEVIAAAAAAGKSGGAGHAAVASTLAQLTVTAVAIASGACLSTKVDFLWPRIEQLPDTLIFEGVEVTGYPIFEDPKVQKAIVFASTAHIGQFRKTGDPYVTHCIHTGKILAALVPSTGERAINTVVAGILHDVIDDTAENLKSIEEQFGDDVASLVSGVSKLSYINQLLRRHRQKNTGGSTLTSEEYFSYALPIRKAEAVAQETLAVWCSLASRLGVWALKAELEDLCFAVLQDLLQAVLPFDLLLDRKRRSYFLNNLHGSSETSVPKPKIVDDAAVALASLAACEEELEQELLISTSYIPGMEVTLSSRLKSLYSMYCKMKRKHVGIKQIYDARALRVIIGDKNGALHGPAVKNCYSVLDIVNRLWTPIDGEFDDYIINPKGSGYQSLHTAVQASDNSPLEVQIRTQRMHEYAEYGLAAHWLYKESKVDYRSGTSNKIGQSTSYPSSSSEDENYIQDVMPSKYSSMKMGHPVLRIEGSQLLAAVIVSIDKGGKELLVAVSFGLEASEAVAERRSCFQLKRWETYARVYKKVSEKWWCAPGHGDWSTNLEKYTLCQDGIFHKQDQFGRLLPTFIQLIDLTEEEEEEYWMVVSAIFEGKEASSLTPDSSNTERSTSEPPSSTPLSDPINNKVHLLRTMLQWEEQVRRGASLVEKSLSVGTCTEPILREVAIICWPYGKIMRMSLGSTAADAARRMGVEGKLLWVNGQLVLPQTELKDGDIVEVRM

SEQ ID NO: 20180 - protein, 385 aa, Arabidopsis thaliana
MKKMYNLPRDLPEEVLCRIPLTSLRPVRSTCKKWSTLSKCGSFAKKHLAQAKVLADAKEFMVVLMMNFRVYLMRVNLQNNVVESSSSSSSSSSSCIKREAKLISLGDEEADISQVFHCDGLLLCISITESKTRLVVWNPYWGHTRLFEPTHQFNKFDSYSYALGYDKSRKSHKILRGITCLDPFKIYDFNSDLWRDLDVTPEWHLWQMLHGVSLKGNAYWFARENYTETMDTDHFFLLCFDFTSETFGPPLPLPFEFAVSEDTMSVSSVREEQLVVLYQPWDYLQLDIWVTSKIEPNAVSWNSKVFLSVSLKQLVSPQFQLTFGSFFIDEEKKVAVVFDKDYDNKRNIAYIFGVDGSFKAVDLGDSDRKCFPLVCSYVPSLVQLN

SEQ ID NO: 20181 - protein, 126 aa, Vibrio sp. Ex25
MKKLISSEHAPAAIGPYSHGTSYGDLIFTSGQLPVDKATGKVVEGGISAQSHQSLTNLKHVLEAGGGSIDTVLKTTCYLSNINDFAEFNKVYAEFFQQDCPARSCFAVKDLPLGVLIEVEAIAHKK

SEQ ID NO: 20182 - protein, 414 aa, Crocosphaera watsonii WH 8501
MGSPNKQDTAGVHGAALGADEVALTRKNLGWDYEPFDIPQDVLKAMNKAEQGASYEAEWNQAFAAYKAKYPTEAAEFERYLSGQLPDGWDKDLPTFTPDDDGQPTRKHSAAILNILAPVVPELIGGSADLTHSNLTELKVSGDFQKGAYANRNVHFGVREHGMGAICNGMSLHNSGLIPYGATFLIFTDYMRASIRLSALSQVGAIWVMTHDSIGQGEDGPTHQPVEVLASLRAIPDLTVFRPADGNECSGAYKVAVEKAKAHAPSLLAFTRQKVPNLPGTSMEGVAKGAYTIVDCDGTPDIILMGTGSEVSLCVAAAEKLTGEGKKVRVVSMPSWELFEAQDEAYKESVFPKAVTKRLSVEAGVSFGWSKYVGPEGYSVSIDTFGASAPGGTCMEKFGFSVDNVLAKAKAVLG

SEQ ID NO: 20183 - protein, 326 aa, Carboxydothermus hydrogenoformans Z-2901
MHSLEDQEKKLFELVKEDLRKIEQELIKEVSERNEFLHDPAMHLLKAGGKRLRPAFALLAAKLGDYDFEKVKPLAVALELIHMATLVHDDVVDNSMLRRGLPTVKANWGNKMSIHIGDRIFAKSLLLIDSCKNNYVAKVLAEVSVKMTTGEIQQLNGAKNISTSIKDYLIKIKRKTALLLSASCELGGVMANVSPRVVNALKQYGLYVGMAFQIIDDILDFTADEKVLGKPVGSDLRQGLITLPVLLALKRDKKHELWRELQNLPQNNANIEQIIKEIKYLGGISEAYAWAKNYIEKAISAFELVPKSPVKDTFLEIAQFIVQRNY

SEQ ID NO: 20184 - protein, 667 aa, Emericella nidulans
GPMTVAMLLENVVASAKAYFEKQKERHITPLPLKLATPVPSDIAISRSQYPKPITQVASEIGIASHELEPYGHTKAKVSLEVLNRLSHRRNGRYILVCGITPTPLGEGKSTTTLGLSQALGAHLNRVAFANVRQPSQGPTFGIKGGAAGGGYSQVIPMDEFNLHLTGDIHAITAANNLLAAAIETRMFHEATQKDAALYKRLVPEKKGKREFKPIMFKRLKKLGINKTDPNELTEEEINRFARLDIDPSTITWRRVLDVNDRHLRGITVGQAPTEKGLTRETGFDISVASECMAILALSSDLADMRERLGRMVVATSKRGEPVTCDDIGAGGALAALMKDAIKPNLMQSLEGTPVLVHAGPFANISIGASSVLADRVALKLAGTEPEEDHEAKTGFVVTEAGFDFTMGGERFFNIKCRSSGLSPDTVVIVATVRALKVHGGGPEISPGAPLHEVYRTENTEILRKGCVNLKKHIENARQYGVPVVVAINRFETDTEAEIAIIREEAISAGAEDAVSANHWAEGGAGAVDLAKAVIIASSKPKDFKLLYDLNGSIQERIERIGKAMYGAEKVEFSELAQKKVDTYTAQGFSNLPICIAKTQYSLSHDPALKGAPTGFTVPIRDVRLAVGGGYLYALAADIQTIPGLPTAPGYLNVDIDPETGEIDGLF

SEQ ID NO: 20185 - protein, 258 aa, Plantago major
VIFHTFCEDIASQLPAVVVSVEYRLAPENRLPIAYDDALNAILWAKDQALGKGGRDPWMEYADFTKVFILGSSAGANIAYHVALRALDFDISPLQIKGVMMNQGYFGGVARTASEIRLKDDAYVPLYVNDVLWTLALPTNLNRDHEFCNPISGGTYLGRIYRLPKIYIKGDYGDPLVDRSVQLAQYLINNGRTVFYRFNAGGFHGIELQNTTAAQELYDDFKYFVNNPFIMNENGISKEPLSYDMKEIMSGGVSRASA

SEQ ID NO: 20186 - protein, 443 aa, Wigglesworthia glossinidia endosymbiont of Glossina brevipalpis [sequence omitted]

SEQ ID NO: 20187 - protein, 423 aa, Oryza sativa (indica cultivar-group)
MEYGAATRGALLAAAPLSGARRSWLPLSSPPSPPSIQIQNRLYSISSLPLKARGVRRCEASLASDYTKASEVADLDWENLGFGIVQTDYMYITKCGQDGNFSEGEMIPFGPIALNPSSGVLNYGQGLFEGLKAYRTTDDSILLFRPEENALRMRIGAERMCMPAPSVEQFVDAVKQTVLANKRWVPPTGKGSLYIRPLLMGSGAVLGLAPAPEYTFIIFVSPVGNYFKEGLAPINLIVEDKFHRATPGGTGSVKTIGNYASVLMAQKIAKEKGYSDVLYLDAVHKKYLEEVSSCNIFVVKGNVISTPAVKGTILPGITRKSIIDVALSKGFQFFGKSSINVFGFLKVEERLVSVDELLEADEVFCTGTAVVVSPVGSITYQGKRVEYAGNKGVGVVSQQLYTSLTSLQMGQAEDWLGWTVQLS

SEQ ID NO: 20188 - protein, 567 aa, Burkholderia vietnamiensis G4
MRGERLLRVLLQLGRRPGEAAQLPARAAGKAHRRADRRIGRRGRRARADARRFASAARRRRSQHRGAAGRPRADRPRARRVSGHAASARARPREDRLHHRPDRHGRQRDARARLHPRDGRARHRHRAGRDRRKRFFVPRRLSRGGAAVRDGAAERDFRRQRPDGRRRAARGGRARHPRAGRMLDHRLRRHRVFPLHLSGAVDGRAVGAGARRNGRADADRADRRRLDGRAEPPPRRVAAARAARIDVGLSGAGHARCARMTAPNAGAGRVTVVGSLNMDLVVRAPRLPLPGETLAGRAYAQAAGGKGGNQAVAAARLGAQVAMIGCVGADAHGAALRAGLEAEGIDCSRVATSASASTGVALIVVDDASQNTIVIVAGGNGEVTPATVAQHEAAIAAADVLICQLETPPDAVFAALSAGRRLGRTVVLNPAPAVAPLPDGWLPLVDYLIPNEVEAAALTGLPVRDPADAEAAARALQAAGARNVLITLGARGVQALSADGAARHYPAPVVQALDTTAAGDTFIGGFAARLAAGDGVDAAIRFAQRAAAVSVTRAGAQPSIPTLAELA

SEQ ID NO: 20189 - protein, 149 aa, Methanococcoides burtonii DSM 6242
MERTYVMVKPDGVQRCLVGEIVSRIEKKGLKIAALRMNVMTEAAAKEHYKEHSERPFFGSLVSFVTSGPSVSMVIEGNNAIKIMRAINGATNPVDALPGTIRGDLAVDMGRNVVHASDAPESAEREIGLHFEESEISGYPRADDEWLYE

SEQ ID NO: 20190 - protein, 238 aa, Brassica napus
MRTMVDLGKQRDHLHHRMQIINTPTTVDCAREIRLRRTLRSFIECMLPYCCTYQQQPAHSYQNDTVSVSSSSSSSDHSSSSSSIVSGTFFGHSRGRVSFCLQDATVGSPPLLLLELALPTAALAKEMEQEGVLRIALVCDRRRSSSSNSRSSSIFDVPVWSMYSNGRKMGFAVRRKVTENDAVLLRMMQSVSVGAGVVPLDEEEQTLYLGARFERVTGSSDSESFHMMNPRGSYGQEL

SEQ ID NO: 20191 - protein, 503 aa, Ostreococcus tauri
MEQTLEVQAEGEGVEDEMREIAVDARAPRVRRDRAKTASRELKRRFQSRDARCVILAGGADETNPLTRRRARSAVHLAGTYRVIDFPMTNLINSGMRQLYVLTQFNSHSLVTHVNKAFPSELFGGEVNGFVEVLPTSQTREHGETWSLGSADCVARHLSSGSLTKYTYEMRMEDECLRQLGSLDECLMSELDGTTIILSAEALYSMNFAELLEQHFLKGADVTIATCNQISSDQANAFGILDVDEMTAQVNCFIEKPTKAQLEEFMQCTTEELESCKLDANMGVYVFNNSALLELLTASKSGVAPGDRHEFGKDVIPYAIDMGYDVKAFRHSDYWKPLRSLRDLYEANISIAVGGDAASLLTHGRQVYTKPNFLPPTTFHGSVYTEKTIFSDGCLVQDGSRIVNSVIGACTSIDKNVDLEGVVVVGRDEIMKRSGGVNSVPDIGANTIIRKCIIDSDATIGANVRIVNAAGIEELDRTDEGYVITEGIVTILGGAIIPDGFVI

SEQ ID NO: 20192 - protein, 273 aa, Zea mays
MWNCSSLLLQYGDDYAARCESSSSPAGAVGLDRILAAEYGRFDSLDLSPPPPLHGLQAQTLFAIHGSSENCLGIGANPIYSTEARPAFSQLSFTQPAADTAAHYSMKWTAAGETATGGGGSRLRGSKRLKTKTPATAQGPQHHGQRCSPKPTTSQSIKAPPCKRSQKLGDKITTLQQLVSPYGKTDTASVLHEAATCIKHLHEQIQILTPSYPELSSPASQQDTGDEEGGATGLRRRGLCVASLSPAVVQLVSAEAALGNRDTEDHWRWLGTL

SEQ ID NO: 20193 - protein, 141 aa, Legionella pneumophila str. Lens
MAKELTLSIIKPDAVAKSVIGEIYTRFEKAGLDIVAAKMTQLSREQAESFYDIHRARPFFKDLVDFMISGPVMIQVLKGENAVAKNREIMGATNPKEAAPGTIRADFADSIDANAVHGSDSLENAAREIAFFFEPHELCNR

SEQ ID NO: 20194 - protein, 175 aa, Oryza sativa (japonica cultivar-group)
MMLETVAAVPGMVGGMLLHLRSLRRFEHSGGWIRALLEEAENERMHLMTFMEVAKPRWYERALVLAVQGVFFNAYFLGYLLSPKLAHRVVGYLEEEAIHSYTEYLKDIEAGKIENVPAPPIAIDYWRLPAGATLKDVVVVVRADEAHHRDVNHFASDVHFQGMDLKDIPAPLDYH

SEQ ID NO: 20195 - protein, 245 aa, Ostreococcus tauri
  misc_feature (1)..(2): Xaa can be any naturally occurring amino acid
  unsure (1)..(245): unsure at all Xaa locations
XXPASGAGMVMGPELEATVANIMTMGFEREQVLKALRAAFNNPDRAVEYLLTGIPEQAEAPRPAAQAQPAAAAAPQAPQADVSAALGGGALNLFPEGIPDMSGDGAGDDGMLDFLRENPQFQAIRAMVQGNPQILQPMLAELQRQNPQLYHLINANQEEFLALLNEPLPENIQDLMSDFGEGVPELEGQGEGMQIELTQEERETVDRLAGLGFPVEICIEAFLACDKNEQLAANYLLNLASGGME

SEQ ID NO: 20196 - protein, 461 aa, Xanthomonas oryzae pv. oryzae KACC10331
MSIRTRSRKATPKQPESALRRWLKERSITEVECLVPDITGNARGKIIPADKFSHDYGTRLPEGIFATTVTGDFPDDYYALTSPSDSDMHLRPDASTVRMVPWATDPTAQVIHDCYTKEGDPHELAPRNVLRRVLDAYAQVKLQPVVAPELEFFLVQKNTDPDFPLLPPAGRSGRPETARQSYSIDAVNEFDPILDLMYDYCDAMELDVDTLIHESGAAQLEVNFTHADPLSRADQVFLFKRTMREAALRHGVYATFLAKPMETEPGSAMHIHQSLLHADTGKNVFSGKREGGFSDTFAHYLGGLQKYIPMAMGLLAPNVNSYRRLMFGEVSPSNVLWGFDNRTCGLRVPIDAPQNMRVESRFAGSDANPYLAMAATLACGLLGIRENLEPTAPISSNGKEQGYDLPRSLGEALDELEGCDALQEMLGQRFVRAYISVKRKEYETFFRVISSWEREFLLLNV

SEQ ID NO: 20197 - protein, 325 aa, Oryza sativa (japonica cultivar-group)
MGSRAAGSVLLRHLCPRVSSSTSAAAHAHAQRPPLAGAGGGGVALWARLLSTSAAAAKEETAASKENTGSTAAAKAEATKAAKEGPGQCDCESRGEQLLGHRGVEARDQGRRPVEVPWETYSPDTTIDLKKHHEPKVLLDKVAYWTVKALRVPTDIFFPEEVRVPRDDAGDGGRGCRGCGGWIRALLEEAENERMHLMTFMEVAKPRWYERALVLAVQGVFFNAYFLGYLLSPKLAHRVVGYLEEEAIHSYTEYLKDIEAGKIENVPAPPIAIDYWRLPAGATLKDVVVVVRADEAHHRDVNHFASDVHFQGMDLKDIPAPLDYH

SEQ ID NO: 20198 - protein, 433 aa, Borrelia burgdorferi B31 [sequence omitted]

SEQ ID NO: 20199 - protein, 423 aa, Spiroplasma citri
MQAREVAWNILWKIFAKNKFSNHLLSNIVEQNDNFIDQDKTLIYRIVYGTLKNKLYLEYIANQFIESKKTNQKLQILLWMSIYQFRFLDRIPNYAIVNEAVNISKSVSPKYAGFINTTLKKIFDSKDEIFEINIADETKKLSIKYSFPSSLYLILRNEYSEDIARQVMIDSLTIPKLSFRVNTLKISRDELLSKYSNYNLTKSLVSSVGVIADKPVVNSEMFKKGLIFIQDEMSMRIAEILDPQETDRVLDMCSAPGGKATHLSQIINNKGIIDAYDISEKKINLIKMNASRLGITNIYPHLLDARKINSEIQYDKILCDAPCSGLGVIKRKPEIKYHTLTNQELANLVEIQEQLLEKAYQLLKPGGILVYSTCTFGGYENIVQIRNFLAKHSDLKIITTEQIFGYENNTDGFYYCKIRKKDK

SEQ ID NO: 20200 - protein, 685 aa, Mastigocladus laminosus
  misc_feature (300)..(318): Xaa can be any naturally occurring amino acid
  unsure (1)..(685): unsure at all Xaa locations
GQGNPIWRVRGDKAHPSSQGMVCVKGATIAESLDKNRLHYPMVRDSLDQKFRRVSWDEAFDLITKRIQAVRFTQGPEAICMYGSGQFQTEDYYIAQKLLKGCLGSNNFDANSRLCMSSAVAGYIQSFGADGPPCCYEDLELTDCAFLIGTNTAECHPIVFNRLEKYHKRNRKVKMIVVDPRRTPTAEAADLHLAIRPGTDIDLLNGIAHLLMRWNYIDVGFIDDCTSNFPAYAEVICHYSPEIVADRCGIDIKDLETAARYWGESQHVLSLWSMGVNQSSEGTAKVRTIINLHLMTGQIXXXXXXXXXXXXXXXXXXXREAGGLAHLLPGYRLVKNPQHRAEVEEFWGLKRGQISPNPGLTAWDMITGLEDGTVGLLWIAATNPAVSMPDLERTKAALMRSPFTIYQDAYYPTETATYAHVLLPAAQWSEKTGVMTNSERTVTLCPAFRRPPGEAKADWEIFAEVGRRLGFVGEFAFANSAEVYAEFVKLTRDRPCDMTGLSHEQLRSQGPTQWPHPAEEMGRTGDGEINFTPPPHHKSPSTPSSKRLYTNLRFHTPDGRARFGAYHSRGLAEPPDPDYPFVLTTGRLYGHWHTLTRTGRIEKTRQMHPEPFIEIHPRDAARLEITDNQLVEVRSRRSKTFFPAKITKAIAPGTVFVPMHWGALWADNAEANALTHPESCPDSLQ

SEQ ID NO: 20201 - protein, 456 aa, Glycine max
  misc_feature (135)..(135): Xaa can be any naturally occurring amino acid
  unsure (1)..(456): unsure at all Xaa locations
MERYKLIKEVGDGTFGSVWRAINKQSGEVVALQKMKKKYYSWEECVNLREVKSLRTMNHANIATLAPPPPECDTLCLVFEYMEYNLYQLMKNREKLFSENEVRNWCFQVFQGLAYMHQRGYFLRVLRPESGSATXAPPKIADFGLAREISSLPPYTEYVSTRWYRAPEVLLQSHLYSSKVDMWAMGAIMAELFTLRPLFPGSSEADEIYKICSVLGSPTTESWADGLKLARDINYQFPQLAGVHLSTLIPSRSDDAISLVTSLCSWDPCKRPTAAEVLQHPFFQSCFYIPPSLRTRAVTRTPPSAGTRGSLDRLGLKRYSGALPNTKITNNFTSPKVQASIASGVQRKLDMANEDGIKSKKSLKTTQQSKYRLPGKGSPTSINKGRTARGVSETAEKLVNMSIGTRRLSLGQTRPPPMKAGVNWISESGNLLRSGQQIPTERTLTRKVAGVLIRSF

SEQ ID NO: 20202 - protein, 591 aa, Oryza sativa (indica cultivar-group)
MPTVSVGRDRFFVALGRTYTQEEFEVLCFEFGIELDDVTTEKAIIRKEKHLEDDDGEVDGDDDEVIYKIEVAANSFWEGHFDISKHYMLMFIANACRYDLLCLEGLARALRIFTGTEATPMYKISCIPRDSMLQMHVKPQILTLSTFMMEKRKRTLVAIGTHDLDTLKGPFSYEALPPQEINFVPLKQEESFRADKLMEFYKSDMKLKKFLHIIENSPVYPVIYDSNRTVLSLPPIINGAHSAITLKTRNVFIECTATDLTKAKIVLNTMVTMFSEYCENKFEVEPVEVVSHDGSKTIYPDLSCYKMEVSLSEVVGPIGISLDETKVISLLNKMQLQAESCPSKGEPRISVSVPPTRSDILHARDLVEDVAIAYGYNNVPKSKPKCMTIGGRQPLNRFSDKLRAEVARAGYMEVLTFTLCSREENFDMLNRTQDVNKAVIIANPRTSEFEVVRTSLMSCLLKTLKHNIDHPRPIKIFEVGDVVTLDGSRDVGASNNRQLAALYCNKQSGFEEIMGLVDRIVNVVRAPHIKFGQNYYVPTNEPEFFPKRQCKIVMSDGKQIGYLGIVHAEVLRKFGIPDPCTFVEIDVEALL

SEQ ID NO: 20203 - protein, 315 aa, Sulfitobacter sp. EE-36
MKDTTFGPKGWTPDRLGSLKGKTYLITGTTAGAGFQATRILLSKGAKVVMLNRNADKSIAAVKTLKDTFGPNAEVSFVRMDLSDLASVRAAAEEVQSTVPRIDALICNAAIAQVPTQQLTVDGFESQLGTNHYGHFLLCGMLFDRIQESAGRIVVVSSLGYNMGIKTIQFDDMNWDKNYSANAVYSQSKLAQMMFAYELQDRLKATDSRVEVYVCHPGASATSLISTSGGLFTRVTWWMMSKTPMVQSAEKGAYPEVMCATEDGLAQRALYGPTGWLQTGGPVGKGTLNPHAYDKPVMEKLWTVSEKATGFHWEI

SEQ ID NO: 20204 - protein, 195 aa, Plantago major
VTTIFYLLCGCMGYAAFGDQAPGNLLTGFGFFDPYWLLDIANIAIVVHLVGAYQVYCQPLFAFIEKWSVRKWSRSDFVTAEYDIPIPLCGVYQLNLFRLVWRTIYVVFTTLIAMLLPFFNDVVGILGALGFWPLTVYFPVEMYIAQNKVRKWTSQWIGLQLLSIACLLVSVAAAVGSIAGVILDLRTFKPFKTVY

SEQ ID NO: 20205 - protein, 441 aa, Clostridium difficile 630
MPMSEITSQMISTEEKKYVAKTQKIPYYPVAFKSGDGAMLYDYEGNEYVDFLASAGSANVGHGNKEISQAVKEQMDDITQYTLAYFHSDPPVKLAEKLVEIAPGDNDKKVLYSATGSACIDAAIKLARGYTGRTKIISMCESYHGSTYGAISISALSTNMRRKMGPLLPEVYHFHYPDKNRTAKECLDEIEYAFAHYLPAEEVAAIFIEPIAGDAGIIVPPVEWVQGLSKICKENGILLVSDEIQQGMGRTGKWFGIENFGVEADLIVLGKSVGGGLPLGAVVGRTEIMQSLDAPAHLFTLAGNTTVCVAALKSIEIIEKENLLQKSIEMGDYIKAGFEKLKEKYDIIGEIRGIGLSIGVDIVKGKGSNEKHPDATAKICYRCIQTGLIMIFLGQSTLRVQPPLVITKEQVDKAMNIIDSAIDDYLNGRIGDEVYEVTQGW

SEQ ID NO: 20206 - protein, 363 aa, Oryza sativa (japonica cultivar-group)
MVLKFSGSGRHQYKSGGSPSLRTSRFHRSSRLAAYPGIIDESGFTSDGAGEAYTYMRTTTASAGARAAPSTWDLPPKVNHRSFQPRVIRSPSASGVPSIGEEDYDDDDDDDDEETVLLEEDRVPREWTAQVEPGVQITFVSIPGGAGNDLKRIRFSREMFNKWEAQRWWGENYDRVVELYNVQTFSRQQGFSTPTSSVDEAMQRDSFYSRVGSTRESPAMMMPPPPPLPSSGAGREHPISRTASSKAQLSSSSSVAAARPPFYPSTAVPDPSDHVWAHHFNLLNSAAAGPAAPYDPSRGTTSSRDEASVSISNASDLEATEWVEQDEPGVSITIREFGDGTRELRRVRFRQATPQSTHTSRKR

SEQ ID NO: 20207 - protein, 108 aa, Bordetella pertussis Tohama I
MSDVQEFIRETVTQHPVVLFMKGTTQFPQCGFSGRAIQILKGCGVKKLVTVNVLEDDEVRQAIKTFSNWPTIPQLYVGGEFIGGSDIMSEMNESGELKQLLDDSGATA

SEQ ID NO: 20208 - protein, 450 aa, Debaryomyces hansenii CBS767
MTYTSPAVVIDNGSHTTKAGFALDDLPSLVFNSNYVVDSNSKVQVGDKQVDESPESDIMTFMENGLIYNFDSIVHNWQYVYDNIDNNNAINAKEFPLMLTEQPWNTSKNKLATTQIAFETLEVPIFSLVKTPLSQLYHMGRSTGLVVDIGSSVASVTPILDGIIQSKSSFHSKYAGDFANLHALRFLESNVSIDNLIPMKFQSTRMSQSFKDYQISYNILQDFKSSMLNVCEIPAGQSTNALNPKNYQLPNKSHIGISREQINLLENLFQPGFSPLLNLAIPEVNFNKPATNGLSSLVLLALKNLESSFIPNNEPMNTTNVNSRYTKFNEILRELLSNILITGGSSLTTGLSQRVINDIYKSAHQFFPNYIFTQPGRLVLGTLGNYQQNDINEVWDKKFGSWLGACNLASMLNDNDNQESNGINIALDNWFVTKSDYEELGEDLILEKFK

SEQ ID NO: 20209 - protein, 481 aa, Xanthomonas oryzae pv. oryzae KACC10331
MFPGEPMSSASIDGAPDAGENTRFIILISCVATIGGFLFGFDSGVINGTVDGLKQTFQSTAAETGFEVASMLLGCAIGAFFAGRLADRSGRRAVLIISAALFLLSAIGAGASHSSGFFIFARVMGGFAVGAASVISPAYIAEVASARYRGRLATMQQIAIISGLFCAFLSNYLLANAAGASTEPLWAGQAAWRWMFWMQAVPSLLFLLLLLVIPESPRYLVVKGRREQALVVLKRLYGNAAAQTKLGEISASMSADRHKPKFSDLINQATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDLNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKCVYETKGKELEQMEG

SEQ ID NO: 20210 - protein, 685 aa, Mastigocladus laminosus
  misc_feature (300)..(318): Xaa can be any naturally occurring amino acid
  unsure (1)..(685): unsure at all Xaa locations
SQGNPIWRVRGDKAHPSSQGMVCVKGATIAESLDKNRLHYPMVRDSLDQKFRRVSWDEAFDLITKRIQAVRFTQGPEAICMYGSGQFQTEDYYIAQKLLKGCLGSNNFDANSRLCMSSAVAGYIQSFGADGPPCCYEDLELTDCAFLIGTNTAECHPIVFNRLEKYHKRNRKVKMIVVDPRRTPTAEAADLHLAIRPGTDIDLLNGIAHLLMRWNYIDVGFIDDCTSNFPAYAEVICHYSPEIVADRCGIDIKDLETAARYWGESQRVLSLWSMGVNQSSEGTAKVRTIINLHLMTGQIXXXXXXXXXXXXXXXXXXXREAGGLAHLLPGYRLVKNPQHRAEVEEFWGLKRGQISPNPGLTAWDMITGLEDGTVGLLWIAATNPAVSMPDLERTKAALMRSPFTIYQDAYYPTETATYAHVLLPAAQWSEKTGVMTNSERTVTLCPAFRRPPGEAKADWEIFAEVGRRLGFVGEFAFANSAEVYAEFVKLTRDRPCDMTGLSHEQLRSQGPTQWPHPAEEMGRTGDGEINFTPPPHHKSPNTQSSKRLYTNLRFHTPDGRARFGAYHSRGLAEPPDPDYPFVLTTGRLYGHWHTLTRTGRIEKTRQMHPEPFIEIHPRDAARLEITDNQLVEVRSRRSKTFFPAKITKAIAPGTVFVPMHWGALWADNAEANALTHPESCPDSLQ

SEQ ID NO: 20211 - protein, 193 aa, Plantago major
VFYMLCGCMGYAAFGDLAPGNLLTGFGFYNPFWLLDIANAAIVIHLVGAYQVYCQPLFAFIEKYANAKWPDREFITNDIEIPIPGLQEPYRLNFFRLVWRTAFVILTTVISMLLPFFNDVVGILGAFGFWPLTVYFPVEMYIAQKKIPKWSTKWICLQMLSMACLVISIAAAAGSVAGVILDLKVYKPFKTSY

SEQ ID NO: 20212 - protein, 170 aa, Oryza sativa (japonica cultivar-group)
MTEFSPPDVLAAVVEEEGEDLEAMMMVGQPGGGGGDGAQDWLASFGREGGGGGGGGGAPGQDWLAAYRARAAPARAGLRRNSADYCSVETASFLRSCGLCRRRLGPGRDTFMYKGEAAFCSLECRQQHMTQEEWQDKCGVTSMKKEAPAPPNGRRRSSKTTTSGGTVAAA

SEQ ID NO: 20213 - protein, 262 aa, Sulfitobacter sp. EE-36
MTGELSPIDKAKFVAAKRAAQFVEDGMRVGLGTGSTAAWLVRCLGEMVRDDGLRIKGVPTSTRTAQLAREVGIEVISLDEAKWLDLTIDGADEFDGELNLIKGGGGALLQEKIVATASDQMVVIADIGKEVETLGAFPLPVEVIPFGWQTTQALVEETLVSMDVLGRNSTLRMNGDIPFVTDEGNYILDLHLKRIGNTRQMALVMNQMPGVVENGLFIDICDAVVIGYGDGRVEVRDINEGTVDRDKMEFVETDNLFSDLSD

SEQ ID NO: 20214 - protein, 234 aa, Plantago major
SIKSYVAEFIATLLFVFAGVGSAIAYNKLTSDASLDPAGLVAIAIAHAFALFVGVSMAANISGGHLNPAVTLGLAVGGNITIITGLFYWIAQCLGSIVACFLLSFVTNGLAVPTHGVSAGQTALQGVVMEIIITFALVYTVYATAADPKKGSLGTIAPMAIGFIVGANILAAGPFSGGSMNPARSFGPAVAAGDFSQNWIYWVGPLIGGGLAGLVYGDVYIASYAALPASEDYA

SEQ ID NO: 20215 - protein, 488 aa, Sulfitobacter sp. EE-36
MSDFDYDLFVIGGGSGGVRAARVAAGEYGAKVALAEEDRYGGTCVIRGCVPKKLMVFASGYAELVDEAQCFGWDIKPGTFDWHAFKTRLNTELDRLEGVYRKLLANSDVDTFDQRATIKDAHTVQLANGETRTAKHILLATGGRPVRPDVPNAQLGIVSDDIFHLESLPKSILIVGGGYIGCEFACILNGLGVEVTMYNRAAQILRGFDDEARGLIAESMTNAGVDIHCGTSIVEMALESEHEAGTMPSNSDAAMGATAEQSNELNNCDARAGTQGPIWVKASNGAEKVFDMVLFATGRAPNTDGMGLEEVGVSLGRRHEVEVDEYSQSGVPSIYAIGDVTDRVNLTPVAIREGMAFVQTVFGGNPTPVDHDLIPSAVFTQPEFGTVGLTEEQAAEQEPVEIYSASFRPMQTAFAEKNKRVMMKLIVSKETRVVLGCHIVAPNAGELIQLVGIAVKAGLTKEQFDATCAVHPTMSEELVTMRSPTRTA

SEQ ID NO: 20216 - protein, 505 aa, Oryza sativa (indica cultivar-group)
MEYLSSAAGPEFFVPASQGELFLKSEQQPSKRRHLTTLATESSGVGREYPTDGFIESFVLVVLILQAVVIGCSSLDELPVQLSNRRLLHDRNHAALLYKDHFPTVGNMTFPTSHQLQNDPNYKPLDSSSHPAEASAKKGSSKGFKKWLYMVVIPVAGLIMLAGMAWMFLPCRKKSVATIGPWRTGLSGQLQKAFVSGVPQLQRPELERACEDFSNIVASHPYYTVYKGTLSSGVEIAVVSTTIKSSKDWSKHCEDCFRKKIESLSRINHKNFINLLGFCEEEEPFTRVMVFEYAPNGTLYENLHDEAFDHIDWRSRMRIIMGIAYCIQHMHELNPANVHPDLHSSAVFLSEDCAAKIADLSVWQEVVSDGKKSTANNNHHEPISARLAGNVYSFGILLLEIISGKPPYSENEGSLANLALGCIIKGRSIASLLDPVLESHKENELDVICQIIMECIQSDPTKRPGMREITTRLRETIAISPDAATPRLSPLWWAEVEVLSPVEPR

SEQ ID NO: 20217 - protein, 158 aa, Zea mays
  misc_feature (91)..(91): Xaa can be any naturally occurring amino acid
  unsure (1)..(158): unsure at all Xaa locations
MASPLRRSFPSLGRALLTPAPARMLSAEASDALVEIKPGEIGMVSGIPEEHLRRKVVIYSPARTASQQGSGKVGRWKINFLSTQKWENPLXWGWTSTGDPYANVGEAGLTFNSAESAKAFAEKHGWNYVVRKRHTPLLKPKAYAENFKWKGPPKAEQA

SEQ ID NO: 20218 - protein, 426 aa, Lactuca sativa
MPTDIEDEIKDEKNPRPLDEDDIALLKTYGLGPYSNSIKKAEKDVKEMSKRINDLCGIKESDTGLAAPSQWDLVSDKQMMQEEQPLQVARCTKIINPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGAGGDNEVQRTMLEIVNQLDGFDARGNIKVLMATNRPDTLDPALLRPGRLDRKVEFGLPDMESRTQIFKIHTRTMNCERDVRFELLARLCPNSTGADIRSVCTEAGMYAIRARRKTVTEKDFLDAVNKVIKGYQKFSATPKYMVYN

SEQ ID NO: 20219 - protein, 429 aa, Legionella pneumophila str. Lens
MSRSSDLFHKAQTIIPGGVNSPVRAFKGVGGEPVFFKSGKGAYLTDVDDKQYIDYVGSWGPLILGHCHPKVIEAVDNVLHSGMSFGAPTELEIQLAEKIASLMPSIEKIRMVNSGTEATMTAIRLARGFTNKNKFIKFNGCYHGHSDSLLVKAGSGLLTLGIPSTPGIPQCITEHTLTADFNNLEQVAQLFEKYPNDIATVILEPVPGNMGFILPKIEFLKGLRELCDQYNALLIFDEVMTGFRVGLHGAQGLFGIKPDITTLGKIIGGGMPVGALGGKREIMSFLAPEGPVYQAGTLSGNPLAMAAGLATLKEIEKINFFEDLSSTTNKLTEALSDAAENANIPLFAASLGGMFGFCFTDKNSVENYLDVASSDEVLFKKFFHAMLAQGVYFAPSMYEAGFVSSMHGDLEIQKTYDAAELVLNQLKSA

SEQ ID NO: 20220 - protein, 873 aa, Cryptococcus neoformans var. neoformans JEC21
MPRQQSEDELRIRGQAPRSPRSSQGDPLERNSKLEDEEELDLIRRYEDFSTVDWIQDSLHERTFQNKAPRSRIIAQLDRSDGAVGHLWRLIRRALEEGEAYVVISLVGVIIGVSAALISIITTWLSDIKMGHCTTGWWLTRKFCCLEVSDEMEACAEWKNWGGVEPFQWIAYVLFAAAFSFAAAYLVKNFAPYAAGSGISEIKCILGGFIINGFLSVETFFIKGLTLPLAIASGLAVGKEGPSVHVACSVGNVVAKWFSRYERSHLKMREIVTASSAAGVAVAFGSPIGGVLFSIEEMNQTYSNRTMWRSFVCALVATFTLASMDPFRTGKLVIFNVSYDRDWHYFEIPAYILIGIFGGLYGAFVIKFNVQMASFRRKHLSGHGIFEAVALASITAIIGYLNGFLRIDMTEMLSVLFRECEGGGDYNGLCHAVFTHRTYRASSQWRMVNSLLLATIIRTVFIIVSYGCKVPAGIFVPSMAVGATFGRMIGILVKAMYNSYPSAPWFAACAPDAPCITPGTYAFLGAAAAMGGITRLTVTVVVIMFELTGALTYILPAMIVLLVTKAVSDQFGGGGISDHMIKFNGYPFLEKEDKEDPTDHAFIEPIANVMKKDLIILEATGVPLNHVVDIVQHTNYQGFPVVKSHEDQTIVGFVRKNELRIALEKTRRVRNLSFNTTCTFQCIRAIPEDAHELLERPDILIPSQGGIMTVNTGAENREDNGSEISHVDFGQYVDDIPLTVAPKMPLELVMQLFRRMGPRVILVSDQGRLTGLVTVKDVLRHELSEAHHRSRSTHTPLTPSHPAYAQSNGWDTEWTVDDERGHGLEIALEEGLEWTRSKATWAYGAALERWRGIRGQDRRTATFDYELDEGIQG

SEQ ID NO: 20221 - protein, 478 aa, Xanthomonas campestris pv. campestris str. ATCC 33913
MRGRMGRHRSGPRMSEPSSTDAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCVLIFSLNMVSARWFAEGEFWFSLINVVTIVVFIVLGGAAVVGWLPLADGSPAPGVRHLRADGWFAHGTVPILMTMVAVNFAFSGTELIGIAAGETAQPARAIPLAIRTTLIRLVVLFVGTVLVLAALLPAHAAAVETSPFVRAFELLGIPYAAGLLNAVILTAILSAANSGLYAAARMLWSLANEGTLPARFARLTRRGIPLPALVLSMLGGLLALLTGVYAADTVFVAISAVSGFAVVVVWLSICASHYCFRRQLLRDGIALDSLAYRAPWYPWTPLIGGALCVLACAGLAFDPQQRIALWCGIPFVALCYGAHAVTQRLAARRVRP

SEQ ID NO: 20222 - protein, 389 aa, Acinetobacter sp. ADP1
MNSSLSLLHPYPFEKLNVLFKDVTPADLPLIPLSIGEPKHPAPEFVKQAIIDNFNHLSTYPNSKGLPELRESIARWLTQRFQLNHISSEDHILPVTGTREGIFSFVQALINRDEAPYVVMPNPFYQIYEGATLLAGAKPYFINCTAENDYLGDFDAVPSEVWEKTALLFVCTPGNPTGAVLSKEKLKKLIQLSDQYNFVIASDECYSELWFDQAPVGLLEVCAEIGRDNYKNCIVFHSLSKRSNLPGMRSGFVAGDAELLKPYLKFRTYHGAAMPVQHQLASIAAWNDEAHVEENRQQYRAKFNLFQSELGQLIPLKKPDAGFYYWLHVDNDEAFAKMLMEKAHIKVLPGRYLSRETEQGNPGENHVRMALVADLAQCEQVVQRLKKVL

SEQ ID NO: 20223 - protein, 329 aa, Bordetella pertussis Tohama I
MSAHPDPTPEAILASARRTLQTEAQAIADLAARLDDSFVQVVGMLLACRGRVVVSGIGKTGHIARKLAATLASTGTPAFFVHAAEAIHGDLGMVTRDDVLIAISYSGTGQELLTILPVVRRMGAGLIAITGNAESELARLADVHLDASVSQEACPLNLAPTASTTAALALGDALAVACLEARGFGREDFARSHPGGALGRRLLTHVRDVMRHGPALPIVAEDAPLPRALEEISAKGMGMTAVVDAQRKPVGIFTDGDLRRLIERVGDIRSLTVADGMTRAPRTIGPDALAAEAAQQMDDRRLNQMLVVDTAGVLIGALHTHDLMAAKVV

SEQ ID NO: 20224 - protein, 685 aa, Mastigocladus laminosus
  misc_feature (300)..(318): Xaa can be any naturally occurring amino acid
  unsure (1)..(685): unsure at all Xaa locations
SQGNPIWRVRGDKAHPSSQGMVCVKGATIAESLDKNRLHYPMVRDSLDQKFRRVSWDEAFDLITKRIQAVRFTQGPEAICMYGSGQFQTEDYYIAQKLLKGCLGSNNFDANSRLCMSSAVAGYIQSFGADGPPCCYEDLELTDCAFLIGTNTAECHPIVFNRLEKYHKRNRKVKMIVVDPRRTPTAEAADLHLAIRPGTDIDLLNGIAHLLMRWNYIDVGFIDDCTSNFPAYAEVICHYSPEIVADRCGIDIKDLETAARYWGESQRVLSLWSMGVNQSSEGTAKVRTIINLHLMTGQIXXXXXXXXXXXXXXXXXXXREAGGLAHLLPGYRLVKNPQHRAEVEEFWGLKRGQISPNPGLTAWDMITGLEDGTVGLLWIAATNPAVSMPDLERTKAALMRSPFTIYQDAYYPTETATYAHVLLPAAQWSEKTGVMTNSERTVTLCRAFRRPPGEAKADWEIFAEVGRRLGFVGEFAFANSAEVYAEFVKLTRDRPCDMTGLSHEQLRSQGPTQWPHPAEEMGRTGDGEINFTPPPHHKSPSTPSSKRLYTNLRFHTPDGRARFGAYHSRGLAEPPDPDYPFVLTTGRLYGHWHTLTRTGRIEKTRQMHPEPFIEIHPRDAARLEITDNQLVEVRSRRSKTFFPAKITKAIAPGTVFVPMHWGALWADNAEANALTHPESCPDSLQ

SEQ ID NO: 20225 - protein, 523 aa, Oryza sativa (japonica cultivar-group)
MAMNFEMWGAVWSALASLVFLWPMLQNHVPAGLRHWLTAMADKLASHLSPYLHITISEYGDHRFRRSDFFLAVEAYLSHACARRARRLKADLGRDARSVQVSVDDHQEVTDSFRGATLWWYPSSMSNKSSVISFYPGEDERRLYRLVFHRRHRDLVLDGYLPHVLAEGRAVTVRNRQRRLFTNNASTSWNPYRRGKGVWSHVPFEHPASFDTLAMDPGDKDAIVVDLVAFRDGKDYYAKVGKPWKRGYLLYGPPGTGKSTMIAAMANFLDYDVYDLELTAVKNNTELRKLYIETTGKSIIVIEDIDCSIDLTGKRKKSSGDNKASDGGGEGSDDKPKLPTEADKDDGGSKVTLSGLLNFIDGLWSACGGERIIIFTTNHKEKLDPALIRRGRMDVHIEMSYCGFEAFKVLASNYLGVEQHELLGDIRRLLEEADMSPADVAENLMPMSKRKKRDPDACLAGLVEALNMAKEEAQANKAAKEDEEAKAAKGIEEMKTKEQATTNGEDEGKDKRTSEENKANGDI

SEQ ID NO: 20226 - protein, 339 aa, Oryza sativa
  misc_feature (54)..(54): Xaa can be any naturally occurring amino acid
  unsure (1)..(339): unsure at all Xaa locations
MALVQSARRAAGPAASRLFSTASVAAAGRSPVAGLPKALPRPAISSLWMVGAAXPPRRFAGTAAVGGVDVTAPTATPPPAKKEESEKEAASYWGVAPTRLVKEDGTVWKWSCFRPWDTYEADVAIDLTKHHNPATLGDKVARWTVKSLRWPVDLFFQRRYGCRAMMLETVAAVPGMVAGAVLHLRSLRRFEHSGGWIRALLEEAENERMHLMTFMEVSQPRWYERALVVAVQGAFFNAYLASYLLSPRFAHRIVGTPEEEAVHSYTEFLRDLDAGKIDDVPAPAIAIDYWRLPADATLRDVVMVVRADEAHHRDVNHYASDIHYQGHALREVAAPLGYH

SEQ ID NO: 20227 - protein, 719 aa, Mycobacterium smegmatis str. MC2 155
MAGPRKEALDDHFTTVVSQLSAPAVRQAWPDTALSTDMALTLFDAQLASRHLDLAARWLRAQGKGFYTIGSSGHEGNAAVAAALRLTDPALLHYRSGGFYAARAAQACGTDPIRDVLLGVLAATSEPISGGRHKVFGRHDLNVIPQTSTIASHLPRAVGVAFAIARARKLGVPCAWPDDAVTVCSFGDASANHSTAVGAINAALHAAYQGLPMPLLFVCEDNGIGISTRTPRGWIANAYGNRPGLQYFAADGSDLSSAYDTAQAAADWVRRHRKPAFLHLSTVRLMGHAGSDYEPSYRRPEEIVADFDRDPVLNTAKMLVAHGILSPDQALQRYEDKRAEVIDCARELSAAPQLGSAEAVLEPLREALDEAKEVSVAPAAGDTPLTLALAVNRALHDVLAEYPEALVFGEDVARKGGVYGVTRGLQAAAGPARVFDTLLDEQTILGLALGAGVSGLLPIPEIQYLAYLHNAADQIRGEGATLQFFSNRQYRNPMVVRIAGYGYQKGFGGHFHNDNSIAAIRDIPGVVIASPARPDDAAAMLHTCVAAAKTAGALCVYLEPIALYHTKDLHEDGDQGWLAPYPGQPVPIGRARTYGDGNDLTILTFGNGLWMSLRVARRLEQRDIAVRVVDLRWLAPLPVDDMAREAAATGRVLIVDETRQTGGVGEGVLAELLARGYTGRVERVASADSFIPLGDAALQVLLSEDTIEAAAVKLLTEGS

SEQ ID NO: 20228 - protein, 84 aa, Arabidopsis thaliana
MASSMLSSGAVVTSPAQANMVAPFTGLKSSASFPVTRKANKDITSITSKGGRVYVLANGKRGVAGAPIKTGKNKFETLSYPPCP

SEQ ID NO: 20229 - protein, 130 aa, Arabidopsis thaliana; identical to SEQ ID NO: 1412

SEQ ID NO: 20230 - protein, 404 aa, Nanoarchaeum equitans Kin4-M
MNPKEEALKVLKEADEVANIDVYEYLKEPERVVETYFPARTKNGIEYFKGYRVQYNTALGPAKGGIRFSPTVTKEEVEALALWMVIKNALLGLPFGGGKGGVVVNPKEYEEWELENIARGFVRSIAEFIGEDKDIPAPDVYTNERIMAYMMDEYEKIVRHKAFGVITGKPIILGGNPVRNIATSLGGYYVLNEAVKLKKVENTVAIQGFGNAGQGIAKLLDGQYKIVAVSDSKGGIYCKDGIDIEKLIEVKKKTGSVINYEGCEKITNEQLLELDVGILIPAAIEGVITKQNADKIKAKIILELANGPTTREADKILYEKGVLVLPDVLANAGGVTVSYIEWVGNKRGMPFNEKETKELLKEKMVHAFLDVLEVSNKYNIDMRLASYIIALERVKQAMRYRGLI

SEQ ID NO: 20231 - protein, 139 aa, Zea mays
MASVSAIGVLKVPPASTSNSTGKATEAVPTRTLSFSSSVTSSDDKISLKSTVSRLCKSVVRRNPIIVSPKAVSDSQNSQTCLDPDASSSVLGIILGGGAGTRLYPLTKKRAKPAVPLGANYRLIDIPVSNCLNSNISQI

SEQ ID NO: 20232 - protein, 568 aa, Oryza sativa (japonica cultivar-group)
SLASETCEELFTANAPRIDLALNGVEVFVNASGSHHQLRKLSLRIDSMRNATLACGGVYMYANQQGCDGGRLYYDGCCCIAVNGDVVAQGSQFSLKDVEVLDALVDLDAVSSYRASVSSFREQASHRTKVPFVKVPYKLCKPFQSGMVPTGPVEVMYHRPEEEIAFGPSCWLWDYLRRSRASGFLLPLSGGADSSSVAAIVGCMCQLVVKDIENGDEQVKADAMRIGQYKDGEFPKDSRELAKRLFYTVYMGTENSSEGTRSRAKMLAEEIGSFHLDVPIDSIVSALLSLFERLTGKRPRYKVDGGSNTENLGLQNIQARIRMVLAFMMASLMPWVHNKSGFYLVLGSSNVDEGLRGYLTKYDCSSADINPIGSVSKQDLRAFLRWAAVHLHYSSLAEVEAAPPTAELEPIRADYNQLDEVDMGMTYEELSIYGRLRKIFRCGPVSMFQNLCHRWCGTLSPSEVADKVKHFFKYYAINRHKMTVLTPSYHAESYSPEDNRFDLRQFLYNARWPYQFRKIDELVQDMDKDGKWVNSTEGELRRRKGVRSAEGGGMGVVAVGSANPSAGS

SEQ ID NO: 20233 - protein, 589 aa, Ustilago maydis 521
MASALPPCEQPLLTPEYHDVIIVGAGISGIAMACQLKRKLNIHDFKILERSPDPSGTWTNNSYPGCACDVPAPVYSFSFATKGDWSTFYPQQKELKRYFGTVAAEHDLQKNFHFQTTVQEARYDRDTGLWHIWSQDWTRAQREGQQHHFVCKFFVSAVGGLSQPKACDIDGHESFAGPIFHTAAWDHSVDLKGKDVILVGNGCSATQCVPYLAEHSNKLTQFVRSKHWIAPHPHQPFDSIPGFKWLLKHFVFVRKFQRLLIWLVLESHFIMILQNPLGRLFRWSWRRKCEAHMKKNAPKEYWDMLLPNKDELMVGCKRRIIDDDYLPTLRLPHVSVVNVKLARIEPNHVVLADGRKIKADVIVMANGFEPHAAGAPMKVVGVNRTLHEHWEKYGEGGMIAYRSSLNAGFPNMGSINAANTGTGNQSLIFASECTVNFLLEVAKPILAAPRPPTFAIEHMPTTTFSNDTRLHNYKIPTFEVKLKAELDEQHWIAKCMSKLVFTSGCKSWYIDAKSGRVTSMQPDWQINYMLKATFPKWDDFKYTGLKNAGAKVPQCVPWWKVCGDWLGLGHVKYVDPKETPQINRASMDA

SEQ ID NO: 20234 - protein, 424 aa, Oryza sativa (japonica cultivar-group)
MDDDAGDASPPPAAAGVGATAAQSRDMAASPTSSRSVTETVNGSHRFVIQGYSLAKGMGVGKHIASETFSVGGYQWAVYFYPDGKNPEDNSAYVSVFIALASEGTDVRALFELTLLDQSGKGKHKVHSHFDRSLESGPYTLKYRGSMWGYKRFFRRTALETSDFLKDDCLKINCTVGVVVSTIDYSRPHSILVPDSDIGYHFGTLLDNHEGVDVVLSVGGERFHAHKLVLAARSTVFRSKFFDDEDGEKNEPGENDDVQEIVIDDMEPKVFKAMLHFIYRDTLVDDNELGGSSSEGSIFDTLAAKLLAAADKYDLARLRLLCESYLCKAISVATVASTLALADRHHAMELKAVCLKFAAENLSAVIRTEGFDYLKDNCPSLQSEILRTLAGCEEECSSGGKSQSVWGQLSDGGDTSGRRVRPRT

SEQ ID NO: 20235 - protein, 255 aa, Debaryomyces hansenii CBS767
MPTLREDSVYLAKLAEQAERYEEMVENMKTVASSGQELSVEERNLLSVAYKNVIGARRASWRIVSSIEQKEEAKGNESQVSLIRDYRSKIEAELSKICEDILSVLTDHLISSAQTGESKVFYYKMKGDYHRYLAEFAISEKRKDAADLSLEAYKSASDVAVTELPPTHPIRLGLALNFSVFYYEILNSPDRACHLAKQAFDDAVADLETLSEDSYKDSTLIMQLLRDNLTLWTDLSEAPAPTEEQQPSEPKADEE

SEQ ID NO: 20236 - protein, 520 aa, Ustilago maydis
MTASVSSNQTSLSRRSSHNRHSRISSGSSSASSGSSRPRSSRGRSTSPINPTKQEAAVQMAAKRASVSSVGSTISSSYSTLTADSKVADTTAATSTVSASASSNKVPAGLRAMLFEEEYQEEAIEHMHHMELQTVAAVELMDVQPELKWFMRPYLVDFLIEIHQTFRLPSRNTFLTMNIVDRYVSKRIVYKRHYQLVRCAALLIAAKFEDAKDRVLSVKELSQMCCNAYDESAFAQMEGHVLSTIGWTLGHPTAEAWLRIESVRGGEDLKTVNLARFFLEVSLFHRDFISLKSSALTTGALILARFICGLPQSTQLSLNAEAAKAAHMLDAYVWENLQDLSLILIKKYSYAYFSSASTVACEWYRARVAAAKSSPPSGLLPAQALTRNAGAVAQEVDDDDSMCSQPTTPASSVQSTPSRSMDEDEDEDEEDDMPVTPLSLYSLHDPLVAAANAAGLPVPMPSSRASAQDKERRLSSSSASTEKPMPSSKSASTHLTVQQPMLGARKPLGNVVWNVNVQQF

SEQ ID NO: 20237 - protein, 612 aa, Carboxydothermus hydrogenoformans Z-2901
MCGIAGMISFSKDLSPFVPLLEKMTQSLTHRGPDALGIWHSENIILGHRRLAVIDPERGRQPMIRTFGDWQYVIVYNGELYNTKELRDELEARGHHFYTTCDTEVLLVSYIEWGKECLSKLNGIFAFAIFDEKENQLFLARDRLGVKPLFYALVNDTLIFASEIKTLLLHPDIPSRLSTDGLKEVLFLGPARTPGMGVFAHISELLPGDYAVFNPEGLFIKPYWRLTSNPHPDDFPTTVKKTRELLEDAVIRQLVSDVPICTLLSGGLDSTVITAFAASHLHSRGETLNTFSVDYAENELYFTESAFQPNCDAMFIPLVAKEFNTLHRNIVLTQEELFEALFPALIARDLPGMVDIDSSLWLFSREIKKEATVGLSGECADEIFGGYPWFFRKEALEAKTFPWALSLDRRKTLFRQDLIAELKPDEYVQKRYHEALEEIPEISGLSPEEKRLREITYLTLTRWMPILLDRKDRMTMAWGLEVRVPYCDHRLVEYLWNVPWHFKTAGGQEKGLLRQAVADLIPDYILKRKKSPYPKTHHPLYTKLVREALTQILAENSSPINFLIDENEVRKLITNPSPPNARPWFGQLMGDTQIMAYLIQLNYWFKKYHISF

SEQ ID NO: 20238 - protein, 467 aa, Thermosynechococcus elongatus BP-1
MIEVDVAIVGGGLSGLSVAWRLQRSAPHYSGVLLEASDRLGGNITTQAAEGFVWELGPNSFAPTPALLQLIAEVGLHSELIRGDRHLPRYIYWRGELYPLEPTRPLALATSNLLSPWGKVRAALGALGFVPPYLGSGDESVDSFFRRHLGQEVAERLVAPFVSGVYAGDPQQLSAAAAFRRIAQLEKLGGSLIAGALRLRRQQPPQPKPPAQVQMRPGELGSFREGLAALPRAIAQQLKAPLHLQTPVEAITPEPKGGYLLRSGEQTWHARSVVLATPAYQTAELVAPFQPAIARALATIPYPTVACVVLAYPAGLGRSVRPGFGVLVPRGQGIRTLGTIWSSCLFPQRTPAGWQVFTSFIGGATDPDLASLREEAIVEQVQQDLTRLLDLPAAKARLLGMKVWRRAIPQYIVGYPQQWQQVTHALTQTPGLFLCSNYAEGVALGDRVEHGNRTAAAVAAYLAGGQS

SEQ ID NO: 20239 - protein, 229 aa, Plantago major
MADQYTTTHQETTKFEEPCETPAPAVEASDRGLFGFGKKDEEKKCEEEVIATEFDEKVKVCEEEKVEEPKHESLLQKLHRSDSSSSSSSEEEYIDDNGEKKKKKKLKDKIKEKISGDKKEEEKAEVKCEDTVVPIEKCDDVPEAEKKGLLEKIKDKLPGGNKKTEEVVAPPPPVTETQPLAECYGEPAAAPVEPEKEKKGFLEKIKEKIPGYHPKTEEEKEKEKEKEAC

SEQ ID NO: 20240 - protein, 686 aa, Methanocaldococcus jannaschii
MHKNKNLKELGETMEFKIVNTICPYCGVGCGLGLVVKDGRVIGIHPNKRHPINEGKLCAKGNYCYQFIHSKDRLTKPLIKKESGFVETTWNKALEVIAENLKTYKDEIGFFSSARCTNEDNYILQKFARVALKTNNIDHCARLCHSATVTGMSACFGSGAMTNSIEDIELADCILIIGSNTFEQHPLIARRIMRAKDKGAKIIVIDPRRTITAKNSDIYLQIIPGTNVALINAMINVIIKENLIDKEFIKNRTEGFEKLKEIIKKYTPEYASKICGVDKELIIESAKIYGNAERASIIYCMGVTQFTHGVDAVKALCNLAMITGNIGKEGTGVNPLRGQNNVQGACDMGALPNVFPGYQKVEDGYKLFEEYWKTDLNPNSGLTIPEMIDESGKNIKFLYIMGENPIVSDPDVKHVEKALKSLDFLVVQDIFLTETAKLADVVLPAACWAEKDGTFTNTERRVQLIRKAVNPPGEALEDWIIIKKLAEKLGYGDKFNYNKVEDIFNEIRKVTPQYRGITYKRLKIDGIHWPCLDENHSGTKILHKDKFLTDNGRGKIFPVEYREVAELPDKDYPFILTTGRIIFHYHTGTMTRRCKNLVEEINEPFIEINPDDAKSLKIENGDLVKVISRRGEITAKARITEDIKKGVVFMPFHFVEANPNVLTNTALDELCKIPELKVCAVKIERI

SEQ ID NO: 20241 - protein, 191 aa, Triticum aestivum
  misc_feature (117)..(117): Xaa can be any naturally occurring amino acid
  misc_feature (135)..(135): Xaa can be any naturally occurring amino acid
  misc_feature (174)..(176): Xaa can be any naturally occurring amino acid
  unsure (1)..(191): unsure at all Xaa locations
CTQAAVFHYGSISLIAEPCRTAHLHAMKVAKEAGALLSYDPNLREALWPSLEEARTKILSIWDQADIVKVSEVELEFLTGINSVEDDVAMKLWRPTFKLMLVTLGDQGCKYYTKDFXGTVPSYKVQQVDTTGAGXDHLLGSLLRKIVQDPSALQDKTKLEGAIKFANACGASRXXXGHFHPSGSDFIVFKH

SEQ ID NO: 20242 - protein, 330 aa, Gossypium hirsutum
MMSRGYNRLASSMFTMVSPRFFSTAATRGVLSNDMVKAPAVGLGVRCRSSMAAIAGGDKEQEKKQAVGGGGGSSKDDKEIVSYWGLDPTKVSKEDGSPWKWTCFRPWDTYQADLSIDLKKHHAPVTVLDKMAYWTVKSLRWPTDLFFQRRYGCRAMMLETVAAVPGMVGGMLLHCKSLRRFEHSGGWIKALLEEAENERMHLMTFMEVSDPRWYERALVFAVQGVFFNAYFLGYIISPKFAHRVVGYLEEEAIHSYTEFLKELDNGNIENVPAPPIAIDYWRLPPNSTLRDVVLAVRADEAHHRDVNHFASDIHYQGRQLKEAPAPLGYH

SEQ ID NO: 20243 - protein, 327 aa, Sulfitobacter sp. EE-36
MTAPTLRRYLTQNSFDPDLVFLLEDIASASRLIAGLVRRGAFEGNLGAAGEINVQGEAQKTLDIMANDVFERECANSPRVAALVSEEVEEVTWLKEPQKGDYLLYFDPLDGSSNLDVNLSVGSIFSVMQVQADGDRNVLHNGRNQICAGYAIYGPSTMFVVTKGDEVAGFSSDPDTGEFSLTHPKMTVPAETSEYAINTSRARYWYAPVSRYVDEAIAGKEGPRGRSFNMRWTASMVADVHRILTRGGVFLYPADSNNQKTGGKLRLMYEANPMAMVIEAAGGAASTGQGAIMDVAPTAPHQRVPVILGSRDEVAVLDSYHKDAADS

SEQ ID NO: 20244 - protein, 108 aa, Oryza sativa
ARREEERSGDGFVEVLAATQTPGSEGKRWFQGTADAVRQFDWLFDDAKAKDIDDVLILSGDHLYRMDYMDFVQSHRQRGADISICCLPIDDNRASDFGLMKIDDTGRV

SEQ ID NO: 20245 - protein, 427 aa, Escherichia coli
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTLHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFFRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 20246 - protein, 446 aa, Chenopodium rubrum
MAARAVLQEQPRGGVQQKNGQGGERRNRTALGDIGNVVTARGGAIGAANGIAKPQAINRPLTRSFCAQLVANAQAAAEKKKKQGVKAVDVNVGGARKAGVGVAVAPAAAAQKKVQEKKKTEVVVAETKTPSGHGKVEQKPASKKKKTPTFTSFLTARSKEACGLSKKPQELIVNIDEGSVEDELAVVEYVEDIYSFYKIAEDESRVRDYMDSQPDINEKMRSILVDWLIEVHYKFELRQETLYLTINIIDRFLSMKIVPRKELQLVGIASMLIACKYEEIWAPEVNDFVQISDKAYVREQVLCMEKTILGNLEWYLTVPTPYMFLTRYVKASVTLDSEMENMSYFFSELGMMNYSTTIKYPPSLLAASSVYTARCTLNNSPSWTETLKHYTGYSENQLLECARLLVSFHMAAPEGRLRAVYKKFSKPDNGAVALRPPAKSLLASTS

SEQ ID NO: 20247 - protein, 568 aa, Xanthomonas oryzae pv. oryzae KACC10331
MSHSVEDIKSESRRLRGSLEQSLADAVTGALREDDQTLIKYHGSYQQDDRDIRDERRQQKLEPAYQFMIRTRTPGGVITPAQWLALDGIATRYANHSLRITTRQAFQFHGVIKRELKATMQAINATLIDTLAACGDVNRNVQVAANPLLSQAHATLYADAACVSEHLLPNTRAYYEIWLDEERVSGSGNEDEPIYGDRYLPRKFKIGFAAPPLNDVDVFANDLGFIAILRDGRLLGYNVSIGGGMGASHGDAQTWPRVANVIGFVTRDQLLDIATAVVTTQRDFGNRAVRKRARFKYTIDDHGLDTIVAEIARRAGFALQPAQPFAFEHNGDRYGWVEGEDGLWHLTLSLPAGRIADTDTATHLSGLRAIAQLNVGEFRMTPNQNLVIAGVPASERARVDALVAQYALDAGNRSASALARGAMACVALPTCGLAMAEAERYLPDFSAALQPLLQQHGLADTPIVLRLSGCPNGCSRPYLAEIALVGKAPGRYNLMLGGDRRGQRLNTLYRENITEPEILAALEPLLARYAAERDHANDEGFGDFLHRAGLIALPSYPTHRRLDLELLA

SEQ ID NO: 20248 - protein, 359 aa, Arabidopsis thaliana
MEGDVGIGLVCQNTMDGKASNGNGLEKTVPSCCLKAMACVPEDDAKCHSTVVSGWFSEPHPRSGKKGGKAVYFNNPMWPGEAHSLKVEKVLFKDKSDFQEVLVFESATYGKVLVLDGIVQLTEKDECAYQEMIAHLPLCSISSPKNVLVVGGGDGGVLREISRHSSVEVIDICEIDKMVIDVSKKFFPELAVGFDDPRVQLHIGDAAEFLRKSPEGKYDAIIVNSSDPVGPALALVEKPFFETLARALKPGGVLCNMAESMWLHTHLIEDMISICRQTFKSVHYAWSSVPTYPSGVIGFVLCSTEGPAVDFKNPINPIEKLDGAMTHKRELKFYNSDMHRAAFALPTFLRREVASLLAS

SEQ ID NO: 20249 - protein, 248 aa, Alkaliphilus metalliredigenes QYMF
MESLLYSFFAGISTSLGVVVLIIFGKPSEKVLATLLGFAGGIMLAISVFELMPESVALGSMTSALIGFLLGAGMMYGLDMVLPHSHMSDSDNLVVENEGNLQSVENPMLRVGYLILFGIALHNLPEGLAIGAGLEASPELGIAIAVAIALHNIPEGLAMAGPLKAGGLSSMKIFLFTLVAGLMTPLGTAIGLLFFRISPVFIGGSLAFAAGAMIYIVNDELIPQANAMSSHLANAGLIAGLLLGFVFL

SEQ ID NO: 20250 - protein, 96 aa, Glycine max
NPTLLFLLFQSRFADAFLRELAGVTIAPERLYGLGTGPKVEVLKKLQKMPEHQGLTLHFVEARLATLKNVIKEPELDNWNLNLVNWGFNTQKEREE

SEQ ID NO: 20251 - protein, 325 aa, Ustilago maydis
MNYVQLEKLGEGTYATVYKGRSRLNNEIVALKEIHLDAEEGTPSTAIREISLMKELRHTNIVRLYDVIHTESKLMLVFEYMEQDLKKYMEIHGHRCALDPVTTRSFMFQLLKGTAFCHENRVLHRDLKPQNLLINKRGELKLADFGLARAFGIPVNTFSNEVVTLWYRAPDVLLGSRTYSTSIDVWSAGCIMAEMISGLPLFRGRDNNDQLNQILRILGTPDDNTMKRLVNDSPEIQMRAFPRVPRVPFQNMFPKAHPLAIDLLDKLLKFDPTQRISADEALRHPYFTTSAAIAGLTHPQSNSQLNVGNGGAPQQGAYQQGVPGQ

SEQ ID NO: 20252 - protein, 372 aa, Chenopodium rubrum
MAPSFDLLCAEDNSSIFDEVDDNYYGVVDDDVLQICNLQQQHGNLRNFDDFTLILLIIIKEHNFEALISGFFVANHECLASLFDNERQHFLGLDYLKRFRNGDLDLGARNLVIDWIHKVQSHYNFGPLCVYLSVNYLDRFLSAYELPGKAWMMQLLGVACLSLAAKVDETDVPLILDLQVSESKFVFEAKTIQRMELLVLSTLKWRMQSVTPFSFIDYFLYKLSGDKMPSKSLIFQAIQLILSTIKGIDLMEFRPSEIAAAVAISVTQQTQIVEFTDKAFSFLTDHVEKERLMKCVEIMHDLRMSSRSNGALASTSVPQSPIGVLDASACLSYKSDDTSTTPSGSCGNSAHSSPASAPPPKRRKLDRTSQIS

SEQ ID NO: 20253 - protein, 655 aa, Zea mays
MGGSHSREDLDLSDSDSEDAESPRASDNSSDYGTPPPASVSSKLASGAGAATPASIDAIDRHLRQLHLKYNEPISPNPSSGPTPSANPAALNAVKLYLHIGGSSPSAKWIVSDRLAAASFVRAGAGAGDGDDEDDDAPAAGGPWCLVVGSKIRARVGPELQLKAFPAQRRVDFVADGVWALKFLHSDGFGDFCAKHHSCMFENSYGVAATDEGRAKVFGKDFAAWARPEDGDESIWEDATDGFSPGPKGSPMPPRTPLLKAVLEDLREFEEPVEEGSGIKSLALGALDNSFLVGDKGIEVVRNFEHGIHGKGMSVKFSGGSTNFSTPKKALLMRAETNMLLMSPATDGKPHAKGVHQLDIETGKVVSEWKFEKDGADINMRDITNDSKGAQLDSSESTFLGLDDNQLCRWDMRDRRGIVQKLASATESPVLQWTQGHQFSRGTNFQCFASTGDGSIVVGSLDGKIRLYSKSSMRMAKTAFPGLGSPITHVDVTYDGKWILGTTDAYLILVCTIFIDKDGKEKTGFSGRMGNRIAAPRLLKLNPLDSHLAGANNRFREGRFSWVTENGKQERHLVATVGKYSVVWNFLQVKNSHHECYQYQEGLKSCYCYKVIPKDESIVASRFMHDKYSVSDSPEAPLVVATPMKVTSFSISSRH

SEQ ID NO: 20254 - protein, 887 aa, Legionella pneumophila str. Lens
MTNETNLDLDPIETREWLDALQAVLFNDGPERTAFLLQQLLNKANAEGVKLTSSINTPYRNTIKPHEEKQMPPDEGIGKRINALIRWNAVAMVLRAGKYAPELGGHIASYASASTLYETGFNYFFKGQKGENGGDLLYIQGHSAPGIYARAFLEGRLTEKQLEKFRQEVEVDGLSSYPHPWLMNDFWQFPTVSMGLGPLQAIYQARFLKYLENRGLIKAEGRKVWAFLGDGEMDEPESVGALSIAAREKLDNLIFVVNCNLQRLDGPVRGNGKIIQELEGLFRGAGWNVIKVIWGGRWDPLFARDNQGWLQKRMEECLDGDYQSYKANDGSYVRQHFFNQYPELKKMVENMSDEEIWRLNRGGHDPQKVYAAYARAVEHKGTPTVILAKTIKGYGMGAAGEGQNITHQQKKMTIDQLKAFRDRFNIPISDDKIADIPFYKPDDDSPEIKYIKKQREALGGYLPHRSTEVEQLKIPDLGEFSSITKGLGDREISTTMAFVRILSVLLKNKDINSRIVPIVPDECRTFGMEGLFRQIGIYSPVGQLYTPVDHEQVMYYREAVDGQILEEGINEAGAFCSWIAAATSYSSNKLTMIPFYIYYSMFGFQRIGDLAWAAGDMQARGFLLGGTAGRTTLAGEGLQHQDGHSHVLASTIPNCISYDPTYAYELAVIIQNGLHRMYEKQENVFYYITIMNENYSHPDMPAGVEEGIIKGMYLLKENKKKSKNHVQLMGCGTILREVIKAAEMLEEDFSITSDIWSVTSFNELRKEGLAVERYNNMHPQNKPQESYVTSQLKGRRGPVIASTDYMRIYADQIRPFVPNRYITLGTDGYGRSDTRTQLRHFFEVDAKFIVLAALNALVAEGSLDKAKIVDAMKRYNINQDKLDPMTH

SEQ ID NO: 20255 - protein, 474 aa, Legionella pneumophila str. Lens
MANKIKTDVVVLGSGPGGYTAAFRAADLDKKVVLVERFDSLGGVCLNVGCIPSKALLHIAKVVDEAHEMSEQGVAFGKPKFDNKKLVAWKNSVVAKLTGGLKALAKQRKVEVITGTGKFSGTHQILVETKEGTVEIEFDNAIIAVGSESIKLPFIPEDKRIFSSTGALELADIKGDLLVLGGGIIGLEMATVYSSLGVNVTVVEFMDQLIPNADADLVNILQKRMTKKGVKFLLKTKVTAVEAKKDGIYVSMEGEHATDKPLCFQQVLVAVGRKPNGGAINAEKAGIKVDERGFIPVDNQLRTNVPHIFAIGDVNGQPMLAHKAIPEGKVAAEVIAGKKHYFEPKCIPSVAYTDPELAWAGLTEKEAKEKGINYEKASFPWAASGRALSMGREEGMTKLLFCPETNRILGAGIVGVNAGDLIAETALAIEMCCDVEDIALTIHPHPTLSETIAQSAEAFEGTITDLYLPKKKKK

SEQ ID NO: 20256 - protein, 319 aa, Arabidopsis thaliana
MAFPPPIHGSDAPPPPQPPSVVNGIETSRRQQQQIAAASSSLVKSHPLHNFPLSDLRWAMNHANTHRLRKASSRSPLREANTGKGNLVIEEVNEASGSSFELRPEKKKGNASGVSDSAADRSATKSTTPDGRSKIFIRIRTKNNEETAVSTDIATSVAASVQVTDDSAGPAIDAEGERISDGGGQEADEFGPKTWNLRPRRPPPTKKRSIGHGGGVLKSCNGALPENKSLGTVRTESIRSRNGVDAKMATTERKEKKPRLSISLSKLEIDEDIYALTGSKPSRRPKKRAKNVQKQLDVLFPGLWMGNVSSEAYKVSEHA

SEQ ID NO: 20257 - protein, 275 aa, Cryptococcus neoformans var. neoformans JEC21
MALVTITGFPCSGKSTRAQQLKQYFEKRLKEPEYDGPALEVVVVDDESSHVPRSTYDSSAQEKPGRASLFSNVNRSLGTDTITIVDSANYIKGFRYQMYCAAREAHTRVATIHVVAPPDMCRKWHEKRGECSYKQATFDNLIMRYEEPSSMVRWDSPLFTVPWDEDPPFEDIWNAIIKGDKKPPTSARSKPPPNTLQTLTATTSLINSSLLSHLTSLPNSTTFPIPSPPAPSSSSLVLHLPAKKITLSLAAAGNWTEGDVATGYVRFLEQTWETG

SEQ ID NO: 20258 - protein, 188 aa, Ustilago maydis 521
MTNPHPLCQEQGSKVSISTCPFTILAVFDSITSGSALKPRLGFALKLSGRVLNRKKASLTFSAFHSVFAATFSYTELQTFLDAEQAKARVQSSIHTFTDRCWDQCIKSSIGSSFGRGEEACLSNCVERFLDTSLFIVNKLQEQRALIETKQDKAFLSDATQRDIGDLNNIVNLSFCHSCFEVGLIGSG

SEQ ID NO: 20259 - protein, 578 aa, Zea mays
  misc_feature (162)..(162): Xaa can be any naturally occurring amino acid
  misc_feature (228)..(228): Xaa can be any naturally occurring amino acid
  misc_feature (241)..(241): Xaa can be any naturally occurring amino acid
  misc_feature (256)..(256): Xaa can be any naturally occurring amino acid
  misc_feature (291)..(291): Xaa can be any naturally occurring amino acid
  unsure (1)..(578): unsure at all Xaa locations
MASSRTSWADVADAEPAPPPPVAAPAAASNGPARSSYVPPHLRNRPPAAAAAAPASAAPPPRSTAGLLTRTGGGSSFGAGGGGGFGGGRARGGARWDREPDPFADSAADAEVPFDEHQNTGINFDAYEDIPVEMSGRDIPPPVSTFADIDLGDALNENIRRXKYVRPTPVQRLAVATGRAGNLADALTSSAWCVISAFALFPFVSVEFWWSVVKLVLRGLLRLDFCPXRVLTPEVEEAVGXGSPLDPVVMYLTVRXLDTINSVGVFRGRRGKLCVMVSSKKIPATVYFESXFRRIVEQMDMPLPGARQTMLFSATFPKEIQKMASDFLDNYIFLAVGRVGSSTDLIAQRVEFVQEADKRSHLMDLLHAQRDTGKQTLTLVFVETKRGADSLESWLCMNGFPATSIHGDRNQQEREYALRSFKSGQTPILVATDVAARGLDIPHVAHVVNFDLPNDIDDYVHRIGRTGRAGKSGLATAFFNDNNSSLARSLADLMQESNQEVPAWLLRYAARPSYGGGGGGRNRRSGGGSRFGGRDFRNDSSSFGKGGSRGGGDYYGGGSSGGYGGGGHGGAGAPSAWD

SEQ ID NO: 20260 - protein, 319 aa, Leptospira interrogans serovar Copenhageni str. Fiocruz L1-130
MKVSVLKDSLIRKFDKKLETIIREDLKILSEIKTYTIQSGGKRIRPILHYCLCQLLGYSGKHWLDVGAIAELIHAASLLHDDVVDEAETRRGLQSVGSKFGNKTAILAGDYLLACGIDHLNGLGYPELMEVFTQVIKDLSVSELIQMEWEKNPKITLDIYNKIIYGKTASLFAVVCVSAGILSDKNEKEKKKLRQFGIDLGSFFQKKDDAIDYFTSASKSGKIPLKDFYNGLYTHPILLLLDRADRNDKKLIHSLFAKSERSQGDGIVILSLLSRYQIRERMDAEFQTIADNLLKFLNGFSESTIRNLLKEQILKLLDE

SEQ ID NO: 20261 - protein, 340 aa, Oryza sativa (japonica cultivar-group)
MEKLLSSSGAAAAVASQGQLPDCFVFPADRRPPASTAAVSLPVIDLSGPRDAVRRAVLDAGKELGFFQVVNHGVPPETMREMAAVCEEFFRLPAEDKAAFYSDAEENPNRLFSSTIYEVGDQRYWRDCLRLACGFPVADDTNTHWPDKPHHLRDVTEKFFVATRGLGIELLRLLCEGMGLRPDYFERDLTAGDVIINVNHYPPCPDPSLTLGLPPHCDRNLITLLLQGDVFGLQVSYNGDWINVDPVPDAFVVNFGHLLEIATNGVLKSIEHRAMTNSAVARTSVATFMMPPMDCLVGPAKELVGDGGQPQYRTVTFREFMRIYKTVGARRDSVEKAFKI

SEQ ID NO: 20262 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNSDGDLMEGVSQEAASMAGHLKLGKLVLLYDSND

SEQ ID NO: 20263 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVWLYDSND

SEQ ID NO: 20264 - protein, 346 aa, Mycobacterium smegmatis str. MC2 155
MNAVAADARGTMRASVLTSVGTVVVEDRPVPTPGPHEVLVEVAAVGVCGSDVHYYRHGRIGDFVVNEPMILGHELSGRIAAVGEGVDPARVGQRVAVEPQHPCRRCKQCKAGRYNLCPEIKFYATPPIDGAFCRYVTIDDDMAHAVPDSISDDAAALLEPLSVAIATMRKAGVVPGSSILIAGAGPIGVICAQTARAFGAARIVVTDLVAERRERVLRFGATEVLDPAVDDVAALDPKVDAFVDASGAAPAVVSGIKAVGPAGNVVLVGMGADDVTLPVGYIQNMEINVTGVFRYTDTWPAAIHLVSSGAVDLDALVTGRYDLDHVAEALDSDSDPASLKSIVVPE

SEQ ID NO: 20265 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEVNHTDGVEATTGPLGQGIVNAVGMAMAEAHLAAKFNKPGFDIVDHYTFALNGDGDLMEGVSQEAASMAGHLKLGKLVLLYDSND

SEQ ID NO: 20266 - protein, 109 aa, Triticum aestivum
MSAAEGAVVFSEEKEALVLKSWAIMKKDSANLGLRFFLKIFEIAPSARQMFPFLRDSDVPLETNPKLKTHAVSVFVMVIHHASPNDVLLYRYASMADQCVCASMCCDWR

SEQ ID NO: 20267 - protein, 434 aa, Glycine max
MSPVPGAHAPLLPGSKSKDVPPATVSGAVFNVATSIIGAGIMSLPATLKVLGVIPALVLILVIAFLAELSVEFLMRFTRAGETTTYAGVMREAFGPLGAVAAQVAVVITNLGCLIMYLIIIADVFSGNQREGEVHLGVLQQWFGIHWWSSREFALLVVLFLILLPLVLYRRVESLKFSSAISTLLAVAFVTICTVLAIVAIVEGRTQSPRLIPCLDQHTSFFDLFTAVPVVVTAYTFHFNVHPIGFELAKPSEMATAVRIALLLCCVIYFSIGLSGYLLFGDSTQSDILVNFDQNAGSALGSLLNVLVRLSYAFHVMLTFPLLNFSLRTNVDEFFFPKKSPLATDSKRFVSLTLVLLALSYIAAILVPDIWYIFQFMGSTSAVCLAFVFPGAIVLRDSYGISTRRDKIIALVMVILAAITSVIAISTNIYKAFQ

SEQ ID NO: 20268 - protein, 484 aa, Brachymonas petroleovorans
MDAQRTLPDCSKLFLGGRWVEPAQGMYYDNENPAKRETICRVAQASAADVDAAVRGAQQALEPGSPWAQMTPAARARLLWRVAERIREQVEELAWLESLDTGKPYGEALHGDIPHAAGAFEYYAGWCSKLAGSVLPVSPRYLDYTRLEPVGVVGAIIPWNFPLQMAAMKVAPALAAGNAVLLKPAEQTPLTAFALARIFEELEFPPGVLSVLPGFGATGAALVAHPGIDKITFTGSTAVGKTIMRGAADTLKRVSLELGGKSPNIVFADADLKRAVRGATTGIYYNQGQMCTAGSRILVQDSLYDKFLEAFTAAIADLRPGDPLDPKTRMGALVSQEQFERVSHYVALGQEDGATLLAGGQGSAERGYFFPPTIFTDVKPEHRIAQEEIFGPVVSVMRFGSEEEALRLANGVSYGLAAGVWTADVGRAHRVAHGLRAGTVWVNTYNALWNEAPFGGYKQSGIGREGGREGIEPYTEVKNICLSL

SEQ ID NO: 20269 - protein, 490 aa, Mycobacterium bovis AF2122/97
MTRITRANGCPDGTLENAVVALDGGANYPREILGNKGHGIDMMRRHHLPVPPAFCITTEVGVRYLAAPESTIAAIWDDVLDRMSWLETETSCTFGRGPNPLLVSVRSGATQSMPGMMDTILDVGMTDAVERVLARPGAADFAHDTRRRFTSMYRRIVGSAGPITDDPYAQLRASIEAVFASWNSPRAVAYRDHHGLDDQGGTAVVVQAMVFGNLTANSGAGVLSSRNPITGANEPFGEWLPGGQGDDVVSGLVAVAPITALRDQQPAVYDQLMAAARSLERMAGDVQEIEFTVEDSQLWLLQTRGAERSAQAAVRLALQLHHEGLIDDTETLRRVTPTHIETLLRPSLQPETRLAAPLLAKGLPACPGVVSGTAYTEVDEALDAADRGEPVILVRDHTRPEDVMGMLAAQGIVTEVGGAASHAAVVSRELGRVAVVGCGPGVAAALAGKEITVDGYEGEVRQGVLALSAWSESDTPELRELADIAQRISS

SEQ ID NO: 20270 - protein, 362 aa, Aspergillus oryzae
MLATPLLTQCRNPSFVLRKVKDVVIEDRPKPVLKDPDDVIVHVKQTGICGSDVHYWQRGRIGDYVLAGPMVLGHESSGKVVEVGVAVSHLKAGDRVAMEPGVPCRCCNQCRSGAYHLCGGMSFAATPPWDGTLAKYYVNTADFCYKVPDHMSMEEAAMVKPAAAIAKTADLRAHQTVLVFGCGPIGVLCQTVAKAHGAKTIIAVDVLEVAKSYGVDHVFMPEKPEPGADPIAHAEKMAQKLKEECGLGEGADVELECSGAEPCVQMGVFAARHGGTIVQARMGKEVINFPITAVCTRGLVVKGSIRYLTGCYPAAIDLIGKGIIDVKRLVTNRFKFEEAEQAFELVKAGRQDVFKVMIAGVV

SEQ ID NO: 20271 - protein, 398 aa, Debaryomyces hansenii CBS767
MISRSITHQLARGAGVMGRRTMASASSDLVSIKLPESSFEGYNLEIPELSFETEKDTLLQMYKDMIIIRRMEMASDALYKAKKIRGFCHLSIGQEAVAVGIEAAINKKDSVITSYRCHGFTYMRGASVKEVLGELMGKRSGVSYGKGGSMHMYAQGFYGGNGIVGAQVPLGAGLAFAHKYRGEGNCTFNLYGDGASNQGQVFESYNMAKLWDLPCVFACENNKYGMGTSASRSSAMTEYYKRGQYIPGLKVNGMDILACYQASKFAKDWCTSGNGPLVLEYETYRYGGHSMSDPGTTYRTREEVQHMRSRNDPIAGLKATLLELDIATEEEIKSYDKAARKYVDEQVAEAEADAPPEAKMDILFEDVYVPGSEIKELRGRISDDTWNFEKGTFSNRVY

SEQ ID NO: 20272 - protein, 507 aa, Mycoplasma genitalium G37
MHKKVLLAILDGYGISNAIYGNAVQNANTPMLDELINSYPCVLLDASGEAVGLPMGQIGNSEVGHLNIGAGRVVYTGLSLINQHIKDRSFFANKAFLKTIEHVEKNHSKIHLIGLFSNGGVHSHNEHLLALIELFSKHAKVVLHLFGDGRDVAPCSLKQDLEKLMIFLKNYPNVVIGTIGGRYYGMDRDQRWDREMIAYKALLGVSKNKFNDPIGYIETQYQNQITDEFIYPAINANLNSDQFALNNNDGVIFFNFRPDRARQMSHLIFNSNYYNYQPELKRKENLFFVTMMNYEGIVPSEFAFPPQTIKNSLGEVIANNNLKQLRIAETEKYAHVTFFFDGGFEVNLSNETKTLIPSLKVATYDLAPEMSCKAITDALLEKLNNFDFTVLNFANPDMVGHTGNYQACIKALEALDVQIKRIVDFCKANQITMFLTADHGNAEVMIDNNNNPVTKHTINPVPFVCTDKNVNFNQTGILANIAPTILEYLNLSKPKEMTAKSLLKNNN

SEQ ID NO: 20273 - protein, 454 aa, Vibrio sp. Ex25
MFGIFKPKAHIDRLSPGSIDSTYSRLRWQLFIGIFVGYAGYYLVRKNFSLAMPYLIEQGFSRGDLGVALAAVSIAYGLSKFLMGSVSDRSNPRYFLSGGLLMSALVMFCFGFMPWATGSVTAMFILLFLNGWFQGMGWPACGRTMVHWWSRKERGEIVSVWNVAHNVGGGLIGPLFILGLWAFNDDWRTAFYVPAFFATLVAVFVWMTVRDTPQSCGLPPIEEYKDDYPDDYDKSHEQEMTAKEIFFKYVFNNKLLWSIAIANAFVYLIRYGVLDWAPVYLKEAKDFSVDKSSWAYFLYEWAGIPGTLLCGWISDKLFKGRRAPAGILFMVLVTVAVMVYWFNPAGNPMVDMMALIAIGFLIYGPVMLIGLYALELAPKKAAGTAAGLTGLFGYLGGAVAANAILGYTVDHFGWDGGFIILVGSCITSIVCLMYAFLGERAHHEQKEREKEALA

SEQ ID NO: 20274 - protein, 564 aa, Xanthomonas campestris pv. campestris str. ATCC 33913
MCSIFGIFGLQPGDDLQALRRQALECSQRQRHRGPDWSGVYVDAGAILVHERLAIVDPAGGSQPLLSEDGSLALAVNGEIYNHRELKAELLQPYAFQTGSDCEVINALYREDAPASYLNRLNGIFAFALWDKAAGRVIIARDPIGVVPLYWGHDREGRLRVASELKSLVDDCADAAQFPPGHWYDSATGALSRYYERSWREYSEVENVQVPLQELREAFERAVHRQLMTDVPYGVLLSGGLDSSLVAAVAARYARHRIEENDTTEAWWPRLHSFAIGLTGSPDLAAAEVAAAALGTVHHGFEYSFEEGLDALPEVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDARFKMIDKTSTGATRIEKGILREAFAGYLPESILWRQKEQFSDGVGYGWIDGLKAHAAAHVSDRELAAADRRFPVNPPQTKEAYFYRSLFEQFFPSQAAAETVPGGKSIACSSPTAIAWDASFAAMADPSGRAIAGVHAQALAS

SEQ ID NO: 20275 - protein, 480 aa, Petunia integrifolia subsp. inflata
MANSSDSSASKLQLRDLPGDYGLPLFGAIKDRYDFHYNQGTDGFFRSRMQNYQSTVYRANVPPGPFNAPKSKAIVLVDAVSFTVLFDNSKVDKKNFFDGTFMPSTDFTGGYRLCPFLDTSEPKHATIKGFFLSTLAKLHNRFIPLFLSSMSELFTNLEHELSNKGEAYFNTISDNMTFDFIFRLLCENKSPSETSLGSDGPTFLNKWVFFQLAPLITLGLKYVPNFIEDLVLHTFPLPFCPLKSDYKKIFDAFYNSMGSILDEAEKIGVKRDEACHNFIFLAGFNSYGGNKVFFPALIKWVGAAGESLHRRLVDEIRTIVKEEGGVTLSALNKMSLTKSVVYETLRIEPPVPFQTAKAREDIVINSHDSSFLIKKDEIIFGYQPLATKDPKIFDNPEEFIGDRFMGDGEKLIEYVYWSNGKESDDPTVNDKQCPGKNLVVLLGRLLLVEFFLRYDTFDIEYGKLLLGSKVSFKSVTKATS

SEQ ID NO: 20276 - protein, 339 aa, Triticum aestivum
  misc_feature (87)..(87): Xaa can be any naturally occurring amino acid
  unsure (1)..(339): unsure at all Xaa locations
AGYLPTYIHAPPPTLLPLLPLLLPSPPHPIARSLPRLGVDRSLLLPELLRRPDGAVDRVLARSEVKGGEDGHAGSAGGQPGGGGGGXRPSRYESQKRRDWHTFGQYLRNHRPPLELSRCSGAHVLEFLRYLDQFGKTKVHAAGCPFFGHPSPPAPCPCPLRQAWGSLDALVGRLRAAFEEHGGRPEANPFGARAVRLYLREVRDSQAKARGIAYEKKRRKRPPPSSSQKAAKAAPSPPPPASTHVAAPPPERAPEVLVARAVPAQGHYFIPHPQHYMHAHFLMPGGHEADAAVPSSSSGNSNGHSNGHSGGTGDKMAMAMAAAAEAHAAGCMLPLSVFN

SEQ ID NO: 20277 - protein, 153 aa, Streptococcus pyogenes
PMAYVLWNHFMNINPKTSRNWSNRDRFILSAGHGSAMLYSLLHLTGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSND

SEQ ID NO: 20278 - protein, 247 aa, Bacteroides fragilis NCTC 9343
MQKYGLIGYPLKHSFSIGFFNEKFKSEGIDAEYVNFEIPEINDFMEVIEENPNLCGLNVTIPYKEQVIPFLDELDKDTAKIGAVNVIKIIRTPKRKIKLVGYNSDIIGFSQSIQPLLQPYHKKALILGTGGSSKAIYHGLKNLGIDSVFVSRTKKEGMLTYEELTPEVMAEHTVIVNCTPVGMYPKVDFCPAIPYELLTPNHLLYDLLYNPNITLFMKKGEEHGAVTKNGLEMLLLQAFAAWEIWNK

SEQ ID NO: 20279 - protein, 357 aa, Dioscorea gracillima
LKQKIDRMYNGEKINCTENRSVLHIALRAARDKVIESDGKNVVPDVWHVLDKIKEFSEIIRSGSWVGATGKALTDVVAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGIPLPFETGEIDFGEPGTNGQHSFYQLIHQGRVIPCDFIGVMRSQQPIYLKGEVVSNHDEL

SEQ ID NO: 20280 - protein, 544 aa, Cryptococcus neoformans var. neoformans JEC21
MATEEIHSLYDTILILDFGSQYSHLITRRCRELNVYCEMLPCTQKISDLSWKPKGVILSGSPYSVYAPDAPHVDPEVFTLGVPILGICYGLQEIARVHGGTVDAHTHREYGYAKIEVVKTGKKEQDALFEGIEMEADGGLQVWMSHGDQLTSLPPNFVTIASTPTSPYTAVAHESKPIYGVQFHPEVSHSPKGKEVIAAFVKNVCSVRDGWSMESFIPKEIARIRQICGEKGQVIGAVSGGVDSTVAAKLMHEAIGDRFHAIMVDNGVLRKDEAKKVHKMLTVDLGVNLTVVDASELFLARLKGVEDPERKRKIIGNTFIEVFEAEAAKLEAAAEKELAEKGGEAKGKIEWLLQGTLYPDVIESISFKGPSATIKTHHNVGGLLEDMKLKLIEPLRELFKDEVRALGRLLNIPEHLVGRHPFPGPGLAIRILGEVTREQIAILQHADDIYIEEVRAAGLYDQISQAFVALLPVKAVGVAGDARTYDQVVAVRAVSTEDFMTADWFVFPPQVLKRISSRITNEVKGVNRVVYDITSKPPGTVEWL

SEQ ID NO: 20281 - protein, 370 aa, Pseudomonas aeruginosa UCBPP-PA14
MIKSRAAVAFAPNKPLEIVEVDVAPPQKGEVLVRIVATGVCHTDAYTLSGQDSEGVFPCILGHEGGGIVEAVGEGVTSLQVGDHVIPLYTAECGKCKFCLSGKTNLCQAVRATQGKGLMPDGTSRFSYKGEPVFHYMGCSTFSEYTVLPEISLAKIPKDAPLDKVCLLGCGVTTGIGAVLNTAKVEEGATVAIFGLGGIGLAAIIGAKMAKAARIIAVDINPGKFDIARELGATDFINPKDYDKPIQDVIVELTDGGVDYSFECVGNVQLMRAALECCHKGWGESVIIGVAGAGQEISTRPFQLVTGRVWRGSAFGGVRGRSELPSYVEKAQKGEIPLDTFITHTMGLEDINEAFELMHEGKSIRTVIHY

SEQ ID NO: 20282 - protein, 455 aa, Bifidobacterium longum NCC2705
MAVTHTAADATAATTMTNAVADIEQETPEIEKERQLAGVGAGAGTVANGKKKPHDHALASILGPAFVAAVAYVDPGNVAANITSGARYGYLLVWVLVLANAMSVLIQYQSAKLGIVTNKSLPELLGERMSDAGRFMFFMQAEVIAIATDLAEVIGGAIALNLLFGLPLFIGGLVIGAISTVMLWFQGGKTQTTFERIIIVMLLIITFGFIAGLFVDPPSPGEVVKGMIPRFQGTDSVLMAASILGATVMPHAIYLHSTLVNDHYAGGEKPSIKTQLKGSKIDVVWALLLAGTVNLAMLVLAANSLHGMSGTDSIDGAQRAITQVLGPVIGTIFSIGLLASSLSSTSVGTYAGSEIMHGLLHVNAPMWACRVVTLVPALIVLWFAKDPTQALVIGQVVLSIGIPFAVIPLMRYTHDKELMGKWADGTVKHVIFMIVVALIVALNVLLIVLTLMGRA

SEQ ID NO: 20283 - protein, 172 aa, Glycine max
KMACLVSRSGRELQRYNNMGGRQVVGCIPYRYKQDIEGKMSNELEVLVVSSQKGQGLMFPKGGWELDESVEEAAYRESLEEAGVMGMIERELGQWNFISKRYGIYYEGHMFPMFVKEQLDIWPEKNLRRRIWMTVAEAREVCQHWWMKEALDILVQRIVSSQQRKEDLYSIG

SEQ ID NO: 20284 - protein, 185 aa, Solanum melongena
MDVRRRSEKAVYPSKVFAADEKPLKPHKEDNDTLLIDASDALPLPLYLTNGLFFTMFFSVMYFLLSRWREKIRNSIPLHVVTLSELGAIVSLIASVIYLLGFFGIGFVQSFVSRGNNDSWDVEDENDEEFLLKEDSRSGPATTLGCAIPPPPARQIAPVAPPQPVMSMAEKPAPLVTPAASDEDE

SEQ ID NO: 20285 - protein, 519 aa, Orobanche ramosa
MTEQLGAAAKFRRSGGSPTKALINKPKKNMYALLISVMASMTSILLGYDTGVMSGATLYIKKDLKITDVQVEILVGLINIYSLIGSAVAGRTSDYLGRRITIVIASVIFFVGAAVMGLANNYAVLMVGRFVAGLGVGYALMIAPVYAAEVAPASSRGFLTSFPEVFINFGVLLGYLSNYAFAKFSLKLGWRLMLGVGALPAIFIGLAVIVMPESPRWLVMQGRLGDAKKVLDRTSDSPQEAQLRLADIMEAAGLPEDCHDDVVPVLKQDRGGGGVWKELIVHPTKPVLHITIAAVGCQFFQQASGIDAVVMYSPRIYEKAGITSDEKKLLATIAVGLCKTVFILVTTFMVDRIGRRVLLLTSCGGLVLSMLTLATGLTVIDHYGADRFPWVVVLCVLTTYSSVAFFSMGMGPIAWVYSSEIFPLKLRAQGCGLGVAINRATNGVILMSFISLYNAITIGGAFYLFSGIGIVTWIFFFTLLPETRGRTLEDMEVLFGTFFKWRTTMRELHKKEAEDALYA

SEQ ID NO: 20286 - protein, 427 aa, Debaryomyces hansenii CBS767
MSTLEELENQQDDSIDQEILQSSTSDIMNRTRLLDNDIKVMRSESQRLTHEKTVMLERIKDNQEKINNNKQLPYLVGNVVELLDLSAEKEASEQGANVDLDATRSGKSAVIKTSTRQTIFLPLIGLVDPANLKPNDLIGVNKDSYLILDTLPSEYDSRVKAMEVDEKPTEDYSDIGGLDKQIEELIEAVVLPMKQADKFKNLGIKPPKGALMYGPPGTGKTLLARACAAQSGATFLKLAAPQLVQMFIGDGAKLVRDAFALAKEKAPTIIFIDELDAIGTKRFDSDKSGDREVQRTMLELLNQLDGFGSDDRVKVLAATNRVDTLDPALLRSGRLDRKIEFPLPSEEARESVLKIHARKLNCDNSSVNWRELARSTDEFNGAQLKAVTVEAGMIALRNGKSIIKHEDFVEAIGEVQARKSKSVNFYA

SEQ ID NO: 20287 - protein, 466 aa, Thermosynechococcus elongatus BP-1
MSLWRPTAILLASDLPLIPPTRLRAMTLPTFVDLNLDPFWMPFTANRQFKQSPRLLVSAAGMYYRSIDGREILDGTAGLWCVNAGHCRPEIISAIAQQAATLDFAPTFQMGHPGPFQVADRLRRITPDPLNHVFFANSGSEAVDTALKIALAYHRLRGEGTRQRLIGRERGYHGVGFGGISVGGIAPNRKFFGSLLAGVDHLPHTHNLEHNAFSKGQPTWGAHLADELERLVALHDASTIAAVIVEPLAGSTGVLIPPQGYLERLRAICDRYGILLIFDEVITGFGRLGAPFASQYFGVTPDLITVAKGLTNAAVPMGAVIVRDEIYETFMQGPAGQIEFFHGYTYSGHPLACAAALATLEIYEKEALFERAASLAPYWQEAIHSLRGLPHVIDIRNLGLVAGIELAPREGQGGPRGYDALCRAFEAGLLIRVTGDIIALSPPLIVERSHIDQMVDILSRVLQELP

SEQ ID NO: 20288 - protein, 883 aa, Yarrowia lipolytica CLIB122
MTDKDQYPTTVSEVANFSTNNDKEQYVTDVTEVDSSVLAWMAEQLQIPPSDDDGSYSPEVHFMAARFEEMNFEDACKLVRENMKYHDNDNNFRDEYRREIRDLMEALDSVGGGDDEKMSLDDPNNKVMMVRYWATIFHWWSPYPEVRAVTDPQDDTECTSETWRVWVLGTIWVGIAAFINQFFSPRMPSIGLGAGVIQLLLFPCGRFLEYVLPDKGLTFRGTRYSLNPGRWSQKEQLLTTIMVSCASGTPYITYNLMTQILPSFYGQEWARSFSFGFVFMLSTQMMGFGLAGLLKRCAVYPVKAVWPSLLPTLAVNKALLAPNRKETINGWTITKYKFFLILVACSFAYFWLPNYLFEALSYTNWMTWIAPENETLARVTGSLQGMGYNPIPTFDWNMATAAYSPVAMPLYTVLNDYIAVFISGLVILGLYYTNNFWTSYIPINTNRLYDNQGKPYQVMKILTNNRFDDEKYQAYSPPFYGAANLVVYSSFFAIYPLSFVYVTLMEWAATKEALVETAKALRHIHRSNYEGRVDPFSRYMRKYKEVPDWWFYIIMVLMFVLSVVMVQVWPVDTPVWTLVFVIGLVLAFIIPFTIFAAYTANSLSLNVISELIIGYALPGSFMALNHIKALSVTIQMQAQNYASDQKLTHYAHLPPRSIFWMQIWATFVNGLVCLGVLSFQVDMPDICEPTNKYKFTCPGDTTFFTASVAWGVIGPKKMFDKYPAMKWMFLLGALLGVLFYLLQVTLPAFLAKKYPSKEKTIDKIRRQLLYINPIIVCGGFMAWAPYNLSYRTGGLYLALLFNMYIKSRYLAWWKKYAYILEAGMGTGIAICAIIIFFAVQYNPVIVDWWGNNVPYVGVDGTGLSIIEPIPDVGYFGPAPGNYD

SEQ ID NO: 20289 - protein, 632 aa, Bacillus cereus G9241
MCGYVGCLYNTAKRYSETEKIQFENMTNLLYHRGPDDQGYFRDEHVQFGFRRLSIIDLDAGHQPLAYENERYILMFNGEIYNYIELREMLIKQGACFSTQSDTEVIVALYAQVKEECVNYLRGMYTFVIWDRQEKKLFGARDHFGIKPLYIAQQNDITFFASEKKSILHVMQDKGVNPTALQHYFTYQYGPEPETLTNDINKIEPGHYFIKEIGKELEVYRYWKPYFNASDKTKEDHIRAIRDVLYDSVKVHMRSDVPVGAFLSGGIDSSIIASIAKEINPNLLTFSVGFEHRGFSEIDVAKETAEKLGVKNYSVLVTPQEFMNEFPKIMWHMDDPLADPAAVPLYFVAKEARKHVTVVLSGEGSDELFGGYNIYREPNSLKMFSYIPTSGKTVLKALSGVLKEGFKGKSFLERGCTPIEERYYGNAKIFREEEKIKLIKSYNESVNYKDVTKPLYNEIKNYDDVSKMQYIDMYTWLRGDILLKADKMSTAHSLELRVPFLDKEVFDVASKIPTELKIANRTTKVILREAVRGIVPDHVLDRKKLGFPVPIRHWLKDEMYDWALNIIKESKTEHLIDKQYVLNLLEAHCADKGDYSRKIWTVIAFMVWHQIYIEHKYDTNLFSEECRVYNLV

SEQ ID NO: 20290 - protein, 357 aa, Dioscorea nipponica
LKQKIDRMYNGEKINSTENRSVLHIALRAARDKVIESDGKNVVPDVWHVLDKIKEFSDRIRSGSWVGATGKALTDVMAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSIPFEKNIPVLLGLLSVWNVSFLGYPARAILPYSQALEKFGPHIQQVSMESNGKGVSIDGIPLPFEAGEIDFGEPGPNGQHSFYQLIHQGRVIPCDFIGVMRSQQPIYLKGEVVSNHDEL

SEQ ID NO: 20291 - protein, 477 aa, Helianthus tuberosus
HEWVLGVGKPKNLPPGPTRLPIIGNLHLLGALPHQSLAKLAKIHGPIMSLQLGQITTLVISSATAAEEVLKKQDLAFSTRNVPDAVRAYNHERHSISFLHVCTEWRTLRRIVSSNIFSNSSLEAKQHLRSKKVEELIAYCRKAALSNENVHIGRAAFRTSLNLLSNTIFSKDLTDPYEDSASGKEFREVITNIMVDSAKTNLVDVFPVLKRIDPQGIKRGMARHFSKVLGIFDQLIEERMRTGRFEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIGRDPTVWDDSLEFKPQRFLESRLDVRGHDFDLIPFGAGRRICPGIPLATRMVPIMLGSLLNNFDWKIDTKVPYDVLDMTEKNGTTISKAKPLCVVPIPLN

SEQ ID NO: 20292 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPDFDIVDHYTFALNGDGDLMEGVSQEAASMAGHLKLGKLVLLYDSND

SEQ ID NO: 20293 - protein, 338 aa, Bradyrhizobium japonicum USDA 110
MLATLMYGPGDVRCEQVDDPRILKPTDAIIKLSATCICGSDLWPYRGLQPIDGRAHMGHEYCGVVVEVGREVTTVRPGQFVVGSFCISDNTCPHCRFGFHSSCVQREFMSGAQAPYARVPLADGTLVATAELPSPDLIPDLLATSDVLGTGWYAADAANVREGSTVVVVGDGAVGLMGVLSAKAMGAERIIAMSRHETRQRLAIEFGATDIVAERGEAGIARIKELTRGVGADSVLECVGMQESMTQAIECTRPGGSIGYVGVPHGVTFDGQAMFFAQRRMLGGPAPVRRFLPDLIDRVLAGKIKPGKVFDLKLPLADVAEGYRAMDERRAIKTMITV

SEQ ID NO: 20294 - protein, 357 aa, Dioscorea quinquelobata
LKQKIDRMYNGEKINCTENRSVLHIALRAARDKVIESDGKNVVPDVWHVLDKIKEFSERIRSGSWVGATGKALTDVVAVDIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLKGAASIDDHFHSTPFEKNIPVLLGLLSVWNVSFLGYPARAILPYSQALEKFAPHIQQVSMESNGKGVSIDGIPLPFETGEIDFGEPGTNGQHSFYQLIHQGRVIPCDFIGVMRSQQPIYLKGEVVSNHDEL

SEQ ID NO: 20295 - protein, 314 aa, Nostoc sp. PCC 7120
NGFGRIGRLVLRAGINNPNIEFVGINDLVPPDNLAYLLKYDSTHGRLRSQVETKDDGIVIDGHFIPCVSVRNPAELPWGKLGADYVVESTGLFTDSEGASKHLQAGARRVIISAPTKDPDRVRTLLVGVNHDLFDPSKDLIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWG

SEQ ID NO: 20296 - protein, 357 aa, Dioscorea septemloba
LKQKIDRMYNGEKINCTENRSVLHIALRAARDKVIESDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLGYPARAILPYSQALEKFAPHIQQVSMESNGKGVSIDGFPLPFETGEIDFGEPGTNGQHSFYQLIHQGRVIPCDFIGVMRSQQPIYLKGEVVSNHDEL

SEQ ID NO: 20297 - protein, 357 aa, Dioscorea tenuipes
LKQKIDRMYNGEKINCTENRSVLHIALRAARDKVIKSDGKNVVPDVWHVLDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISAALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGIMRSQQPIYLKGEVVSNHDEL

SEQ ID NO: 20298 - protein, 980 aa, Thermosynechococcus elongatus BP-1
MTGLYEAETIAIARQLWAASQESRNFFSQLREQMRIEDKLLGWAMEHPGLRVQLFRLIDCLPSLRSQTEVARHLQEYLSDPSVELPPGLKKLLNFAQPDSLPAQAAATTFTTAVQALAHKYIAGETTEQVLKTIGRLRKQGMLVTMDILGEAVITEAEAQQYCDRYLDLMEHLSPLGQREGVNPVQVSVKLTAFYSQFDPLDVSGCRAKVGEPIRRLLHRAQELGVAVHFDMEQYAYKDITLAILKDILLEPEFRDRADIGLTLQAYLRDSYQDAQDLITWVQQRGTPITVRVVKGAYWDQELIKAVQHHWPLPVYQHKQNTDANFERIIELLLSHHTVLRTAIASHNVRSQARAIAIAQRQHIPPTAMECQVLYGMADKLAKALVEAGQTVRVYCPYGDLIPGMAYLIRRLLENTANSSFLRQQLGAVAIEELLAPPEPTADFEAVNVHLTTGKTSTFVNAANSDYARASQREAIQAALIHVHRQLGQTYTPIINGDRVNPREYSESLNPSQPEEIVGRVGLATIEDAEHAIRAAKAAQAQWQQTSVAERATLLRRAADLLEAQRHELVAWMCYEVGKVVAEGDAEVSEAVDFCRYYADEMERLSSGYDRNFPGETNHYHYQGRGLAVVISPWNFPLAIPTGMTAAALVTGNCTILKPADPAAVVAAKLAEILMAAGFPPGVFQFLPGRGSVIGPYLTQHPDVHLIAFTGSQEVGCRIIAEAAVLQRGQSHIKRVIAEMGGKNAIIIDESADLDQAVAGVVQSAFGYSGQKCSACSRVIVLESIYKPFVERLVAATQSLNIGPAHLPSTRVGPVVTAAARDRIQEYIAKGQQEAELLLSVPVPEMGYFVSPTIFTNVPPTATIAQEEIFGPVLAVLRAETFTQALAIANATAYALTGGLYSRTPSHIQQAKAQFAVGNLYINRGITGAIVDRQPFGGFKLSGIGSKAGGRDYLLQFLEPRVITENVQRQGFAPIAGVDD

SEQ ID NO: 20299 - protein, 1316 aa, Wigglesworthia glossinidia endosymbiont of Glossina brevipalpis
MDTRILGIKLDNKLSHRIENISSRLNRTPHWIIKQAIFLHLDDLEKKSKSSEKLIENKNEIQDYQDKINEKIIFKPFFEFAQQILPQSYLRFNTTNAWSTPEKEIVPKLLELSKCEEETEKKIHELSKYLAKGLREKSKKYNREQMVQDLLREFPLSSKEGIALMCLAEALLRIPDVNTRNSLIKDKIKNKDWKSHFGSNKGLFINSAVWGLCITNNLIKRHKEKNLSSYLNKVIQKIGEPIVGKAINVAMKLMGKQFVVGENIQQALKNTNILEKKGFSYSYDMLGEAALTEEDAQKYMTSYENAIHCIGKSSLGKGIYKGPGISIKLSAIHPRYSRNKYEKVMSELYPRLRSLTLLARHYDIGMNIDAEEANRLEISIDLLDKLCCEPSLFGWSGIGFVVQAYQKRCMYVIEELIDIAKRTKRRLMVRLVKGAYWDSEIKNAQIEGIEDYPVFTRKAYTDISYLACAKKLLSESNHIYPQFATHNAHTVSSIYHFAGENYYSGQYEFQCLHGMGEQLYEKVVGNAIDKKLDRPCRIYAPVGTHKTLLAYLVRRILENGANNSFINRISDNNVSIEKLVLSPIKESISISKKENVEIGTSHPNIPLPKNLYGNNRENSHGFNFSNENVLAKLSSDLLKNSDKFWKVTPIIHSKLDKGSISKIINPANKKDIIGECQSSTLKDVESALESSVKGIELWSSKEPLERSKILYDISNKIEKNTNIFINLLVRESGKTFPNAVSEIREAVDFLRYYSNQIKPFNNKTHIPLGCVLCISPWNFPLAIFLGQISAALASGNAVIAKPAEQTPIVAYEAIKLMIDSGIPSESLQFLPGSGKIIGNSLSKDHRIHGVMFTGSTQVARLLQLNLSDRLSKGRPVPLIAETGGLNAMIVDSSALTEQVVSDIIVSAFDSAGQRCSALRLLCIQEDVSEKTLNMIKGAIDSYTVGNPEYFSTDIGPVIDKNAKINIDQHILNMKKSNHSVWQSEMSYDTKQDLGNFVLPTLIELDDIDQIKEEVFGPVLHIVKFKYEEMNNIFEKINSSGYGLTIGIHSRIEENIEKVTTSTKVGNYYVNRNIVGAVVGVQPFGGEGLSGTGPKAGGPLYLYRLLSDRKEKNILSSLEELDKNKKVDLTRCEKIQESCVSLIEWISVNYPDLEKYCNYFISQSQSGSSRVLQGPTGEKNTYLLLPRERILCLSNDENDLLIQLAAVTSIGGKAILSHNPITQKIFSILPQSVLKNVILIPNWKREDSMFDIVLFHGDELQLKEVLEILSKKRGPVINVHSHKNGDKKIFLEKLLIERTISLNTTAAGGNTTLLSMV

SEQ ID NO: 20300 - protein, 536 aa, Psychrobacter arcticus 273-4
MDTLFMTTVTATPAIKEDRILILDFGSQYSQLIARRVRDSGVFCEMFPYDIDTQRITDFGAKGIILSGGPESVHAENSPRINDAVFELGVPVLGICYGMQAMAERFGGKVHASDIHEFGAATINIDGKSTLTNGIEDAAAKLNVWMSHGDKVVDAPQGFDIVASTPSCPIAIMADDSRHYYGLQFHPEVTHTAQGQALLGRFVHEICDCAGSWTPDNIIDMRIEQLKKQIGDKQVLLGLSGGVDSSVVAALLHKAIGDQLTCVFVDTGLLRLHEGDQVMQIFAENMGVKVIRVDAEELFLTALAGESDPEAKRKIIGKTFIDVFANSAREISEQSDGKVIEFLAQGTIYPDVIESAKSHQGKAHVIKSHHNVGGLPDDLAFELVEPLRDLFKDEVRKLGITLGLPAKMINRHPFPGPGLGVRILGEVTKEFADILRSADAIFMEELEKSGWYEKTAQAFAVFQPIKSVGVVGDGRRYAWVIALRAVETVDFMTARFAHLPYDLIETVSNRIMNEIAEVSRVTYDVSSKPPATIEWE

SEQ ID NO: 20301 - protein, 380 aa, Clostridium acetobutylicum ATCC 824
MSKKEIIAMILAGGQGSRLGILTRRTAKPAVPFGGKYRIIDFTLSNCSNSGIDTVGVLTQYKPLALNSHIGIGSPWDLDRTSGGVSVLPPYMKETGGNWYKGTANAIYQNRHFIENYDPEYVVILSGDHIYKMNYLEMLDFHKKKNADATIAVFEVPLNEASRFGIMNTDEDDRINEFEEKPKKPKNNLASMGIYIFNWRFLKRFLEEDARDESSNNDFGKNIIPNMLNKKRKLYAYRFNGYWKDVGTIQSLWEANMDLLDDNNSLNIYDPKWKIYSVNPTMPPQYIACNSDVKRSLVVEGCIVLGKVYNSVLFPGVYIGRDTIITNSVIMPNVIVGNNVIIKKSIIGSNARVDDNVIVGTNDNISVVGAGSKVKESIIQ

SEQ ID NO: 20302 - protein, 372 aa, Clostridium acetobutylicum ATCC 824
MLNNYMSILSLNENDNDIKSLTKARPLASIPIAGRYRIIDFILSNLVNSGVKNIGILTQCKSRSLLDHLGSGKPWDLDRKLNGLFIFNFSGITSTLSDIEMLKSNMEYLYRSTQEKVILSSSAVICNIDFQRAAEFHEKSGKDITLIYKRTNNGKRKFLNCSVLNMDKNNNVISIGKNTGLDDVQNISLGMFIMNKKLLINILNNCIRTGFSLSLKQCIRKHMNNFTVNAYEFNGYAEYIDSVKSYYKVNMDMLNLDINREVFFKNGLIYTKVKDEAPTKYFNDSEVCNSLIANGSLIHGQIENSIIGRRVTISKGARIKNCVIMQNCTIKENVDLTNVIVDKNVIIDENTVLKGGKEFPLVIEKKSIYSEV

SEQ ID NO: 20303 - protein, 388 aa, Glycine max
MSSSSSEDESMSEQSNELGLDFILSLDNVPSKLPPHLELFKTRVLCNNDAPVHTDTVQYSGAYAILGVDNSVRLDSFCENFKVEVKRLTDSDIEFDMIGIDPAIANAFRRILIAEVPTMAIERVYIANNTSVVQDEVLSHRLGLIPIRADPRLFEYPENAGDDKNEKNTIVFKLHVRCQVGQPRITVKSDKLKWLPNGSELPCEDVKPNAGSKPKTFTSFTCSQDSLPEFSNNSIGLTYSDIILAKLGPGQEIELEAHAVKGTGKTHAKWSPVATTWYRMLPEVVLLKDVEDELAEELKNKCPVNVFDIEDIGKGKRRAKVARPRDCTLCRECIRGGKEWEDRVSLRRVKNHFIFTIESTGALPPEVLFTEAVKILEDKCERVITELS

SEQ ID NO: 20304 - protein, 437 aa, Alkaliphilus metalliredigenes QYMF
MNYTTQMDAARKGLVTKEMEAVARKEGMDIEILRERVATGKIAIPANKNHHSLDAEGIGEGLRTKINVNLGISKDCPNIEVELDKVRTALEMKAEAIMDLSSFGKTEEFRKSLIEMSPAMIGTVPIYDAVGFYDKELQDITAQEFIDVVEKHAKEGVDFVTIHAGMNQETAAVFKRNPRLTNIVSRGGSLLYAWMELNKKENPFYQYYDQLLEICEKYDVTISLGDACRPGSIHDATDASQIKELMVLGELTLRAWEKNVQVMIEGPGHMAIDEIAANMVLEKKLCHGAPFYVLGPIVTDIAPGYDHITSAIGGAIAASHGADFLCYVTPAEHLRLPTLEDMKEGIIASKIAAHAGDIAKKVPGARKWDNEMSRARQQLNWEKMFELAIDPEKARRYREESKPEHDDSCTMCGKMCSMRNMNKIMEGKNINILREDD

SEQ ID NO: 20305 - protein, 536 aa, Populus tomentosa
MNPQEEFIFRSKLPDIYIPKNLPLHSYVLENLSKHSSKPCLINGANGDVYTCADVELTARRVASGLNKIGIQQGDVIMLFLPSSPEFVLAFLGASHRGAITTAANPFSTPAELAKHAKASRAKLLITQACYYEKVKDFARESDVKVMCVDSAPDGCLHFSELTQADENEAPQVDISPDDVVALPYSSGTTGLPKGVMLTHKGLITSVAQQVDGDNPNLYFHSEDVILCVLPMFHIYALNSIMLCGLRVGASILIMPKFEIGTLLGLIEKYKVSIAPVVPPVMLAIARSPDLDKHDLSSLRMIKSGGAPLGKELEDTVRAKFPQARLGQGYGMTEAGPVLAMCLAFAKEPFDIKPGACGTVVRNAEMKIVDPETGASLPRNQPGEICIRGDQIMKGYLNDPEATSRTIDKEGWLHTGDIGYIDDDDELFIVDRLKELIKYKGFQVAPAELEALLIAHPEISDAAVVGMKDEDAGEVPVAFAVKSEKSQATEDEIKQYISKQVIFYKRIKRVFFIEAIPKAPSGKILRKNLKEKLPGI

SEQ ID NO: 20306 - protein, 132 aa, Brassica napus
MAYGDSRSGPSILDSFSLSPLPYPVLLILAVASVFLMTSWYWSFEDAAESAGEQMNLALLLIPLLLIVLVRWLSTVENPDAFLGMFSNRRQTYGSPNAGDEGGSSPWGVAAIIVMLLVLLQYQSSFLEMWFG

SEQ ID NO: 20307 - protein, 599 aa, Candida albicans SC5314
MTTKEKDEFNIGSLQNSPESSTNMSPDVITTPISKWQAFKDSFKPPEQKPLASSSSSTSSLSASSPHHNDVANNYDIEKSLRPDQQGELKRELKNRHVQMIALGGSVGTGLLIGSGGALHQGGPAALLIAWGITGTMVFCIIHSLGELCVAFPVNGAFSTYANMFVDSSWAFAVGWNYAIMWLIVLPLELVAAAMCITYWNDEINPASWVAIFYVLIVVINIFGVKYYGDAEMYLTIFKIIAIVGFIILGVVLVCGGGPTHEFIGNKYWKQDGAFANGFKGVATTFVTASYSMAGSEMVGLASAEVANPQKSLPKAIRQVFWRIFLFYFLSLTFIGLLVPSNSPQLLGASGTSASPFVIAIKNGGIYALPSIFNACILLSVLSVGNSAVYGCSRTIQSLGAQGLGPKIFAYVDRKGRPLGGLVISAIFGLLCFLSAYHDEATIFNWLLSVAGLATIFSWFNIGLCHVRFRLALRKQGRSLQELTFTALTGVWGSVYSMIFLCVVLVIQFWTALFPLGSKGKANAENFFQNYLGAVVILIFYVGHKLYTRNWKLCVKLEDIDLDSGRRSFDLDLIRAEIEEEKAANKAKPLYKRLWNYWC

SEQ ID NO: 20308 - protein, 314 aa, Nostoc sp. PCC 7120
NGFGRIGRNFARCWLGRENTNIELVAVNDTSDPRTNAHLLKYDSMLGKLKNVDITADDNSITVNGKTIKCVSDRNPENLPWKEWEIDLIIEATGVFVSKEGATKHINAGAKKVLITAPGKNEDGTFVMGVNHHDYDHNLHNIISNASCTTNCLAPIAKVLNDKFGIIKGSMTTTHSYTGDQRLLDASHRDLRRARAAAINIVPTSTGAAKAVALVIPELKGKLNGVALRVPTPNVSMVDFVVQVENRTITEEVNQALKDASEGPLKGILDYSELQLVSSDYQGTDASSIVDANLTLVMGNDLVKVMAWYDNECG

SEQ ID NO: 20309 - protein, 373 aa, Oryza sativa (indica cultivar-group)
MAGKENAAAAQPRLTRAAAKRAAAVTAVAVAAKRKRVALSELPTLSNNNAVVLKPQPAPRGGKRTASHAAEPKKPAPAPAPAVVVVVDDDEEGEGDPQLCAPYASDINSYLRSMEVQPKRRPAADYIETVQVDVTANMRAILVDWLVEVAEEYKLVSDTLYLTVSYIDRFLSAKAINRQKLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDPDTNPWSKKLQEVTGYRASELKDCITCIHDLQLNRKGSSLMAIRDKYKQHRFKGVSTLLPPVEIPASYFEDLNE

SEQ ID NO: 20310 - protein, 418 aa, Prochlorococcus marinus str. MIT 9313
MVDALDSKSSAFGHVGSSPTAPTAVMGTYKRFPVTLLRGKGCWVWDDHGHQYLDAVAGIATCALGHSDRALRRSLGQQLKQLQHVSNLYRIPEQEALAHWLVENSCADSVFFCNSGAEANEAAIKLARKHGHRRRGIDRPIILTANSSFHGRTLAAISATGQPNFHKGFEPMVEGFEFFPFNNLQAFEQQLNRLEAQGPSVAAVLIEPLQGEGGVNPGEAGFFRRLRELCSQHQILLIFDEVQVGMGRCGNWWGYQQLGIEPDAFTLAKGLGGGHAIGALLVKQHADLFEPGDHASTFGGNPFACKAALTVAKEIERRGLIAKVQQRGAQLREGLTDLVQRFPRQLKGVRGWGLLQGLVLQDESTFTAPNVAQAALEEKLLVIAAGPKVVRMVPPLIIKPSEIRQLLQRLEATLAHFR

SEQ ID NO: 20311 - protein, 459 aa, Nocardioides sp. JS614
MTTFGVEDPASLEIIAQVPDQGPDEARVAVDRAAAAFADWSRTSPRHRSDVLRRAFDLMMRDSEELTGLITSENGKSLVDAAAEVGYAAEFFRWFSEEAVRPSGEYGEAPTGGVRTIVTHRPVGVAALVTPWNFPAAMVTRKIAPALAAGCTVVLKPAAETPLTALAVGRILSEAGVPDGAVEIVTTTDAPGVVTAWLSDDRVRKVSFTGSTGVGRALLHQAADRVLNASMELGGNAPVVVTDDADLGAAVAGTMIAKFRNSGQACTAANRIFVHNDVAFDFVARLGAAVEKLSVGPAIDGAAIGPLITQAALQRVTEAVDFAVREGARISHQAQLPEAPGYFFPPTVLAGLAPDATILREEIFGPVAPVVVWHDEDELLELVNDTEYGLAAYVFAGDIGRAVRLGERIDAGMVGINRGLVSDPSAPFGGVKQSGLGREGAREGLREFQETQYLSVDWS

SEQ ID NO: 20312 - protein, 595 aa, Saccharomyces castellii
MESSKKNETSPEVNSITSSTLKTPNVTEKFEPYPDTTAVKHRTHFNRFVDSFKRAEVNHNGIDLEDGTNSIQSDDNLKKAMKSRHVIMMSLGTGIGTGLLVANAKGLYLAGPASLVIGYFMVSFITYFVIQAAGEMAVTYPTLPGGFNNYASIFVSKPFGFATVWLFCIQWLTVLPLELITASMTIKYWNDKINADVFVVILYVFLLFIHFFGVRAYGEAEFIFNSCKILMIGGFVILSIVVNCGGAGVDGYIGGKYWRDPGAFASDNAASRFKGVAFVLVTAYFSYGGVELFALSVNEQENPRRSTPAAAKQSIYRILIIYLLTMILIGFNVPHNSDQLMGAGGSATHASPYVLAVSIHGVKVVPHIINAVILISVTSVANSALYASPRLLRSLAEQGYAPKYFNYVDREGRPLRALILCSIFGVIAFCACSDQEEVIFTWLAAIAGLSELFTWSSILLSHVRFRLAMKAQGKSLNELGYISITGIWGSLYGCFFNVLVFIAQFWVALSPPGSKGVYSAEAFFESYLAFPVWLFFYLGYMLYSRDFTFLTDLKKIDLDNHRRLYDPELLRQEDEETKERIRNGGWTQKLLNFWC

SEQ ID NO: 20313 - protein, 476 aa, Saccharomyces castellii
MSAVLSTQTTRSILSNSGRRAATIALIHRLYTTASAEPTLKETFSQLIPSKIDEIKQFKKDHGKTVIGNVLLEQAYGGMRGIKGIVWEGSVLDPEEGIKFRGLTIPEIRDQLPKLGDEPLPEGIFWLLLTGEIPSRAQVEQLSADLASRAELPEHVVNLLNGLPKHLHPMAQFSIAVNALESESKFAKAYAQGVNKKEYWKYTFEDSLDLLGKLPTIAATIYRNVFKDGKLGAWDPQADYGKNLATLMGFKNKDFMELMRLYLTIHSDHEGGNVSAHTTHLVGSALSSPYLSLAAGLNGLAGPLHGRANQEVLEWLFKLREEVKGDYSKETIEKYLWDTLNSGRVVPGYGHAVLRKTDPRYTAQREFALKHFPDYELFKLVSSIYEVAPKVLTKQGKTKNPWPNVDSHSGVLLQYYGLTEASFYTVLFGVARAFGVLPQLIIDRAVGAPIERPKSFSTEKYKELVAKIESGETKVV

SEQ ID NO: 20314 - protein, 473 aa, Saccharomyces castellii
MLRFSRQLHNSTRLCSQATGLKESLKAIIPKRKEEFLKLKKECMGTKVDDITIGSILSGMRGNRSMFWEGSMVDAQRGITFHGKTIEQCQRELPGDESGNFYPESMLWLLMTGEVPTKQQTKQLMEELAVRGSEANFPIATSRVIDSLPNDMHPMTQLAIGLASMNKVSRFASNYEKGLLNKNNYWEDTFEDTLNLISFLPILTGKIYSKITNDGKPLGKFSPTEDWSSNICSLMGMSNSTYSVNKNNFNASESKDFLSLMRLYTGIHADHEGGNVSAHTTHLVGSALSDPYLSYSSGIMGLAGPLHGLAAQEVVRFLVEMNGQISSPNQPDEIERYLWDLLNSKRVIPGYGHATLRKPDPRFTAMLKFTKDRKSEFENDKNVVLMQNLSSIAPKVLKAHGKCQNPYPNVDSASGILFHHYGLKESLFFTVIFGCSRSMGPLTQLVWDRIYGLPIERPKSVNMETLKLLSNSQ

SEQ ID NO: 20315 - protein, 189 aa, Arabidopsis thaliana
  misc_feature (59)..(59): Xaa can be any naturally occurring amino acid
  misc_feature (156)..(156): Xaa can be any naturally occurring amino acid
  unsure (1)..(189): unsure at all Xaa locations
MASSMLSSATMVASPAQATMVAPFNGLKSSAAFPATRKANNDITSITSNGGRVNCMQVXPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRXIIGFDNTRQVQCISFIAYKPTKLSPVNFPFAFV

SEQ ID NO: 20316 - protein, 325 aa, Medicago truncatula
MEGESNNKENSSKLASYEAEGTSNHDVSEEHHIQNQYFGRSGIEWNFLPKLPQNNYVEYLSESSCYLPNTATTAEYNMIGNSHYHTLGSSSSSFNDPGKADFGFKLIDSSSHDFGVRKRAGLWRSDEGEEEAHKFETGSSQNLHYAEGHATWTPDSVGDKQYGSQFDHMGVVAAPSLLPNPKSGGSSTKQKSEKTRYSDRQRRQRIADNLKALHELLPTPHVGSQAYILDDIIDYVKYLQIQVKELSGSKLQADSNSIPLVFHEGYGHYIKEQVLNEPLEEIMGNLLEVNSAATCQLLENKGLVLLPIALVDELNQAMQWLNQAS

SEQ ID NO: 20317 - protein, 191 aa, Triticum aestivum
  misc_feature (98)..(98): Xaa can be any naturally occurring amino acid
  misc_feature (121)..(121): Xaa can be any naturally occurring amino acid
  misc_feature (146)..(146): Xaa can be any naturally occurring amino acid
  misc_feature (163)..(163): Xaa can be any naturally occurring amino acid
  unsure (1)..(191): unsure at all Xaa locations
DCGAGAGNGTAANVCDPSLVHTAITLDEEYLRGSVAAVHSVVQHARCPESVFFHFLVSDPSLGDLVRAVFPQLRFKVYYFDPGRVRGLISTSVRQALXEQPLNYARNYLARPPPSPGVRRXVIYLGSDLVLRRTNVAKLWRHRLGXRTSGAPEYWQPNFTKYXTGGLAGHAPAALPGRGVYLTQQGLLNVR

SEQ ID NO: 20318 - protein, 608 aa, Oryza sativa (japonica cultivar-group)
MQVQQRKPKACAESAAAARGADQQQCDGRPLEAGEESLERSVPRKRKPAAAVAAAEKRWSSVAYVVLAAFVMATVFAVLGGRRPAVWIAATKALRRGSDDKSIPLARSAADKLLGGLLPEGFDEKSCRSRYESYLYRRNPGRRPSPHLVARLRMHEELQRRCGPNTESYNRAVQRLRDGGAAEADAHSPDDEQCKYVVSISYRGLGNRILAAASAFLYAVLTGRVLLVDPSNEMDELFCEPFPGTTWLLPRDFPLASSYANFSADTAESYGNMLKNKVLGTDGSTDGDMPAAQMPAFAYLHLDHDYGDGDKMFFCDDDQRLLSNIQWLVMRTDTYIVPSLFLVTTFQDELDALFPERDAVFHHLGRYLFHPANHVWGLVARYYRAYLATARQLVGVQVRVFDHRQAKSPHVVLEQITSCAWKEKLLPEVLDAVEDAAMPTPPTTPHGGSNNSKAVLITSLRPWFYERVKAMYWERATATGEDVSVHQPSHEEYQHFGEKSHDGKAWAEMYLLSLCDVLVTSGWSTFGYVAQGLGGLRPWVMYKPVNITAVPDPPCGRDVSMEPCFHSPPFYDCKTKRGVDTGTILPHVRHCDDVSWGLKLVDPNGSPN

SEQ ID NO: 20319 - protein, 397 aa, Clostridium acetobutylicum ATCC 824
MCGIAGFVNFKKNLIDKKSIIEDMTNTLIKRGPNEKGYYISKNALLGHRRLIVVDPKGGSQPMIKIHNGKKYIIVYNGELYNTEDIRKELLEAGYEFSSYSDTEVLLTSYIHWKEDCVNHINGIFAFAIYSETDKKIFLARDPLGVKPLFYTIKNNNLIFGSEIKTLLANPLVEPILTKEGLTEIFALGPARNLGSGVLKDIHEIPPANFIEFTEHKFKLHEYWRLSCKPHTENASETAEHIKFLLTDAIKRQLYADVPVCTFLSGGLDSSIISAVAASEFKKHGKTLNTYSIDYKDNNLYFKNDNFVITPDSVWAEKMRKFIGSNHHKIINNNLDLASALYDAVKANDIPGMADIDSSLFLFCKGVAEKNVVSLSGERAIQMITNLVKQFINIGEL

SEQ ID NO: 20320 - protein, 278 aa, Triticum aestivum
  misc_feature (242)..(242): Xaa can be any naturally occurring amino acid
  misc_feature (255)..(255): Xaa can be any naturally occurring amino acid
  unsure (1)..(278): unsure at all Xaa locations
MHPTRWELSHMVDLQAAALVISSGRPGRWATFSFAMASGTDEKAKMESLTSPAAFVEGGIQDACDDACSICLEAFCGSDPSALTGCKHEFHLQCILEWCQRSSQCPMCWQPVSMKDPTSQELLEAVQWERNIRTNQTQNTTIFHHPALGDFEVQHLPVVGNDAELEERILQHLAAAAALGRSHQHGRREGQRNRSGSHGRPQFLVFSAHPNTPAGSVSLSSTQGGGADDLRILVPRVGDLPXHANPIEEAGHPKXPGVLTYHAYQDAVVHLEIFPRIR

SEQ ID NO: 20321 - protein, 106 aa, Zea mays
EIEKAAERGELTELVLMVIWNRLDIARRDDERDAIRSLDLLYRRVETEILKSEATPAMRLLNDLLNLHDGGDNEKWLKKCRKRMLEVFPREDPFTVVFPAGFNMEN

SEQ ID NO: 20322 - protein, 363 aa, Clostridium acetobutylicum ATCC 824
MRKLSKKVFLIFAVTTIFILGNSAWDRTIASEEDNSMIDGKPKEYYISEKNYKREIKQVENYLSARRESGHFIGKENIDIYYEKYVIPNSKNSIVISHGFRESMVKYNETIYYFLKNGYSVYGLEHRGHARSGRLGKDSTQTSVDNFDYYVDDFKKYVDTIVEPDNRGKNLFLYAHSMGGAIGGLFLERYPKYFKAAVLSSPMFEVDTGRYPEFLSRAVASVFNFVNLGDTYAPGHHEYSCESDFENSCTTSNIRYDYYLDKTNKSRKIENGGASFKWVKESLKATDEVTDGKNASKVTIPVLLFQAENDDIVRPGGQDKFAKEAKKCKLIVIKNSKHEIYREKDSIMVPYFNKVFTFLNNNK

SEQ ID NO: 20323 - protein, 271 aa, Escherichia coli CFT073
MTICLKVKIYKELSMSVPLILTILAGAATFIGAFLGVLGQKPSNRLLAFSLGFAAGIMLLISLMEMLPAALAAEGMSPVLGYGMFIFGLLGYFGLDRMLPHAHPQDLMQKSVQPLPKSIKRTAILLTLGISLHNFPEGIATFVTASSNLELGFGIALAVALHNIPEGLAVAGPVYAATGSKRTAILWAGISGLAEILGGVLAWLILGSMISPVVMAAIMAAVAGIMVALSVDELMPLAKEIDPNNNPSYGVLCGMSVMGFSLVLLQTAGIG

SEQ ID NO: 20324 - protein, 246 aa, Clostridium acetobutylicum ATCC 824
MIVITSFALSGECADEIFGGYPWFMRKEMIYANTFPWSRFVNERISLLSDDLKSINLQEYVDARYKENLNNVPVSDEDSPYAKRMRELFYLNIKWFMITLLTRKDRMSMANSLEVRVPFADYRLVEYAFNIPPEIKFLNGREKGILRKAFEGVLPQDVIERKKSPYPKTFDPRYTALVQKWLKKVVEDKTSPILDIIDLKTVNELIETGGSSYKTPWFGQLMKGPQLIAYLLQVNFWLKEYKIKMI

SEQ ID NO: 20325 - protein, 311 aa, Aspergillus oryzae
MTLPTPQHYHIFGQGISQSLSPTIHNAAFAHYGLPHRYDIQECNSLQDVKSLIDDPTFGGSSVTMPHKLSAGVFCAHVSDSATRLGAINTLIARSIESGDGTLTREIHGDNTDWSGLYSLIKEYASGERKQVGLVIGAGGAARAGVYAMAQAGIERIYVGNRTLAKAEQIARDFEDLCRVIPVQFPSALPEAPDVIIGTVPGEAMPQEAFKGLFRNEKGLCIEMAYKPRLTNLLAVARENPGWTTADGVEVLLRQGFEQFRLWTGLDAPEAVMRKAIEAATEGKVGGTSSLPSNMGCLSTGYPINHLTCEV

SEQ ID NO: 20326 - protein, 226 aa, Prochlorococcus marinus str. MIT 9313
MLISILTGFAAGALHVVGGADHLVAIAPSALRKPATALRSGLAWGIGHSTGVLVLSTIAIVLKDLVHIERMSSWAEFCVGVALLVVGAMAIRTALGLDIHTHQHTHQQNYGHAHDHQHVHLHLRGRHQHGRHAHAASSLGLLHGLAGASHLIAVIPALALPPLGALIYMAAYLLGSIAAMVAVVGAISLATLRVGRRALPLLVGSTGGLSIITGFFWLQKTSPQLL

SEQ ID NO: 20327 - protein, 302 aa, Aspergillus oryzae
MPSETDPRAYAYLVGVGVTHSIAPPMHNYIAKALGHDWTFIAKECPTVEDAVELFRRSDFAGGVVTMPYKRTIMDHLDGLDEYAIRLGACNNVYRTSDGKLRGTNTDWRGIKGCLLGASAEGRGKPAVLIGAGGAARAAIFTLHDQLECRQIYLVNRDRDEVKVLLEEVKQVYGDGLEIIYVERVEQVAGLPSPYYIVGTVPDAEPSTPDEVEVHQIIGSFLSTPQEKGVLLDMCFKPRKTRILQAGQANGWKTVEGTEIIGHQIHEQYRLWCGEEESSQIPVTDAWAVLRKAAEESPAINF

SEQ ID NO: 20328 - protein, 812 aa, Aspergillus oryzae
MDSISVFETFTGVWVVRSGLCVSHDSHWWSSSPSPRASYISSCETGANRRLTPLATLELRHIDVFQVPSSHVQHHGLPSSSRRYSSDASLVLVGFPGAGKKTLGIMAAVALRRRLVDFVAVFQQRHGMHPQAYIVSHGSERYRKLELEVTEEILTEHRKGCVIVGLGWLASRQQQVLLEEFASCHPVLYIRRDRRDLQQLIATSQDKFERMWDAGNSFFESCSNLEFYNVTEGSTDEARSALPAYLKLKETERTFVRFLHRIWGREHLTRYSADPLSASYTYALQVPMACLEGPLESYEELENGADAINLKVELSEFHGRRPSESMARAVAMLRRHSRALVIVDIIPSSVPDILSYRKLLGMALRTIPDAITCSMAHGDDLAQEVAAAKGYIKAIATYHQEYSLARNETRPELFTFRQKAQSIGFDAIHITGESTAPGDSLHGISFPHTLAKDSLIPTIAYDTGLFGRTSVCLNPILSPVVLESMKPTGVTLREAEMAVSACFLRRRKRFGIFGQQLSHTLSPAMHNAAYAACGLPYTYGIAERERLSDIREILDDESYGGVAVSLPYKTEVLPYLDEISPEALDINAVNTVVLHQECQPNGVRKTIRKGYNTDYLGIKDCIYKHLSPANAIRDGSTALIIGAGGMAHAAIYACYQLGVRRICVYNRTLSNARRLVDYYREWVKSKDKAPLELTILSSADDPWPAHLRQPTVIVSCIPGQKCDIESSSALNIPDHWLQSRTGGVFVEVAYDPLETRLIRSMRQHVSRGWIIVDGLSVLVEQGIAQYELFTTRPAPVHVMRRAIQQSILERTV

SEQ ID NO: 20329 - protein, 1118 aa, Corynebacterium diphtheriae NCTC 13129
MPKRNDIKHVLVIGSGPIVIGQACEFDYSGTQACRVLKEEGLRVTLINSNPATIMTDPEFADHTYVEPIEPEYIEKIFEKEIAEGHPVDAVLATLGGQTALNAAIKLDRRGSLEKYNVELIGADIDAIERGEDRQKFKDIVAKIGGESARSRVCHNMQEVYDTVEELGLPVVVRPSFTMGGLGSGLAFNQEDLERIAGGGLAASPEANVLIEESILGWKEYELELMRDGADNVVVICSIENVDALGVHTGDSVTVAPALTLTDREYQKMRNQGIAIIREVGVDTGGCNIQFAVNPRDGRLITIEMNPRVSRSSALASKATGFPIAKIAAKLAIGYTLDEITNDITGVTPAAFEPTLDYVVVKSPRFAFEKFTGSDDTLTTTMKSVGEAMALGRNYIAALGKVMRSLENKQVGFWTTSDEFFAGDRAKNLDAVLEDLKRPTEGRMYDVELALRLGGSIEEVHQASGLDPWFLAELQSLIDFRESLMKAPVLDEPLLRKAKFFGLSDRQIAALRPEFAGEDGVRRLRWSLGVRPVFKTVDTCAAEFEATTPYHYSAYELDPAAESEVRPQTEKDKIIILGSGPNRIGQGIEFDYSCVHAALELSRVGYETVMVNCNPETVSTDYDTADRLYFEPLTFEDVMEVYHAESESGHVAGVIVQLGGQTPLGLAEKLRDAGVPVIGTTPEAIDLAEDRGEFGEVLRKAQLPAPAFGTATSFEEAKTVANNIGYPVLVRPSYVLGGRGMEIVYDENSLHAYIERATEITSDHPVLVDRFLDNAIEIDVDALCDGENVYLAGVMEHIEEAGIHSGDSACALPPMTLGAEDIENVRRSTEALAHGIGVKGLMNVQYALKDDILYVIEANPRASRTVPFVSKATGVHLAKAAARIMTGATIPELQAEGMIPTGYDGGSLPENSPIAVKEAVLPFNRFRRPDGTMLDTLLSPEMKSTGEVMGLADNFGAAYAKAEQAAFGALPTEGTVFVSVANRDKRTLIFPIQRLASLGFRVLATSGTAGMLRRNGIECEVVLKQTQVQEARQNGTEGQRSVVDMIKAGEVDLILNTPAGSSGARHDGYQIRAAAVNVGVPLVTTVQGVTAAVQGIEALRAGELSVRALQELDHSVTR

SEQ ID NO: 20330 - protein, 227 aa, Xanthomonas campestris pv. campestris str. ATCC 33913
MQCACCAPVAAAAASLPSSLRAAPSKKTDLTAEQALQVLRDGNKAFVENRPKKVISDGKRRLELALGQTPFVILVSCSDSRVPPELLFGRGLGEMFIVRNAGNTVDTTALGSIEYAVSQLGVPLVVVMGHESCGAVAAAVSVVEQNAFFPGAIGAMIEPIVPAVLTAKSKGGEDLLAASVKANVKRTVDRLRGASEPALLEPLRGGSCRVVGAYYTLKDGKVDFFDV

SEQ ID NO: 20331 - protein, 274 aa, Glycine max
  misc_feature (109)..(109): Xaa can be any naturally occurring amino acid
  misc_feature (118)..(118): Xaa can be any naturally occurring amino acid
  misc_feature (124)..(124): Xaa can be any naturally occurring amino acid
  misc_feature (162)..(162): Xaa can be any naturally occurring amino acid
  misc_feature (195)..(195): Xaa can be any naturally occurring amino acid
  misc_feature (208)..(208): Xaa can be any naturally occurring amino acid
  unsure (1)..(274): unsure at all Xaa locations
RRARWVRDSVWLHLFGTGAITETHKSPFSFNVGLAQMLRGGVILDVVYAQLTRIPEEAGACLVMALERVPSDILAQGGVARMTDPKLMLDIKRAVPIPGLGKVRIGPFXEAQIIEAIXIDYLDXSEVLTLRDDGLHLCENYFRVPFLCGCRNLREALRRICXGATLIRTKGEGGGGHFCEAVRHVRAVVSDIGVXPDLDDDEGFGFAXSIACPYDLRSADQTSLGRAPRRHVSRRAEAPPPAGWRASFLHPRNANGRFSFGGPGVFQKRGASPA

SEQ ID NO: 20332 - protein, 533 aa, Prochlorococcus marinus str. MIT 9313
MSWPPSNAEHLLVTAAQMTALEEEMFASGLPVAALMEKVGQAMAAWFRQHPELLADGVKVLVGPGHNGGDGLVVARELHLAGVKVQLWAPLPIRQPLTAQHWTYVKSLGIHQLDHAPDVAGEPVWIEALFGLGQSRPLPEALATLLQARQRCQPGKLVSLDVPAGLCSDSGIPFPGGAAVAMTTLTVGLLKQGLIQDAAIDHVGRLVRVDMGVPEILLKQLPQSQTRRLCSADVATLPCQHLAAGAMKYERGRVLVIAGSDDYPGAAFLAIQGAIASGAGSIQAAVPVAVADQLWQVAPEVVLAAALESSAAGGMAVAPWLASHDLSRFDAVLIGPGLGRGGEPWSVMAEPLQRFAGLLVLDADGLNRLALVTDGWQWLKQRQGHTWLTPHAGEFRRLFPQLKARQPLDAALEASRLCGAAVLLKGAHSVVADPSGAAWQLAETASWVARTGLGDLLAGYAAGLGSMDAAKAQVCHCQGESLAVVALLHAEAARRCRQGSSASSIAQSLAELTISLQANECDQGHVKGYECKR

SEQ ID NO: 20333 - protein, 135 aa, Prochlorococcus marinus str. NATL1A
MKSSSIEAIETKFAPKPVGPYNQAILVENYLYCSGQIALDPSTGVMVGNGNIEEETRQVLKNLMAVVEAAGGRSSAVIRTTIYLTDLNDFAKVNEIYAETFNKTVSPARACVEVSKLPKGGKIEIDCIAWLENKK

SEQ ID NO: 20334 - protein, 519 aa, Oryza sativa
  misc_feature (433)..(433): Xaa can be any naturally occurring amino acid
  unsure (1)..(519): unsure at all Xaa locations
MLPRSRTLPPRIHDGVVVVERDVRRYQQLPQQVEMEMTTTKRQQDHQVETMTTKKIDEEDEEVDDDGRAKRRGTVWTAASHIITAVIGSGVLSLAWAIAQLGWVVGPTVMLLFAAVSYFTSNLLADCYRTGDPATGRRNYTYMEAVKANLGGAKVKVCGCIQYLNLLGVAIGYTIAASISMMAIQRSNCFHARGEQDPCHASSNVYMIMFGIVQVFFSQIPDFDQVWWLSILAAVMSFTYSAVGLALGAAQVAQNRTFAGSAMGVAVGFVTKTGDVVTPAQKVWRNLQALGDIAFAYSYSIILIEIQDTLRSPPAEARTMRKATGISVVVTSVFYLLCGCMGYAAFGDDAPGNLLTGFGFYKPYWLLDVANMAIVVHLVGAYQVYCQPLFAFVERRAERRWPNGLPGGDYDLGWIKVSVFRLAWRTCFVAVTXTVVAMLLPFFNDVVGILGALGFWPLTVYFPVEMYIAHRRIRRWTTTWVGLQALSLACLLVSLAAAVGSIAGVLLDLKSYRPFRSTY

SEQ ID NO: 20335 - protein, 307 aa, Actinobacillus pleuropneumoniae serovar 1 str. 4074
MGKIWVTGDAVVDLIPDGENHYLKCAGGAPANVAVGVSRLGVEAGFIGRVGLDPLGKFMQQTLNAEKVSTEHMILDPKQRTSTVIVGLDDGERSFTFMVNPSADQFLEAGDLPTFQKGDFLHCCSIALINDPSRSTTIEAIRRIKAAGGFFSFDPNLRESLWASLEEMKQVVNSVVAMADVLKFSEEELTLLTDTATLEQATKAITAQYPEKLIIITLGKDGAIYHLNGHSQTVAGKALKPVDTTGAGDAFVSGLLAGLSQVENWKDESVLVDVIRKANASGALATTAKGAMSALPNKAELEAFLAQ

SEQ ID NO: 20336 - protein, 843 aa, Thermosynechococcus elongatus BP-1
MRVVVMAGGSGTRLRPLTCDLPKPMVPVVNRPIAEHILNLLRRHNLDDVVMTLHYLPDVVRDYFGDGNEFGVHLSYVVEEEQPLGTAGSVKNIVNLLTDPFLVVSGDSITDVDLTDALRFHQQHGAPVTLILARVPQPKEFGIVFTDSDGRVRRFLEKPSAAEVFTDTVNTGIYILNPTVMDYLNSGIERDFSRDLFPLLLQADVPMYGYITDAYWCDVGSLQTYQQVQQDALYGRVHLEIQGHEVQPQIWVGHNTPLPPTVQLQAPLVLGNNCRLGAGVTLGPGTVLGDNVMIGNGSRLRSVVAWNGCFIGDDSELEHCILARHVHVDRHVTLQEGVIIGSRCVVREEASLSQGVRIWPGKRIEAGAIVNQSLIWGTTGQRYLFGQRGVAGVANVDITPEFAVRLAAAYASILEPGTSVLVSRDQRNVSRMVSHALMSGLMSVGIHVLNLEAIALPIARFAAQTLSVSGGIHVRAHPDRADQLLIEFFDHKGINLSRAKERQIETAYFREEIRRALLTDVGVMTHPNNCVAAYAQGFEKWLNTQLFYGSPAKIVIDYAYAVSGVVLPQILSKFGCDAVVLNATLHPTPLNILERQRLLRELGQVVTALSASLGVQVSANGERLTLVDNAGQVFSDQELTALMTYLTLLTHPGGTVVVPVTTSSAVEAIARQQGGHIIRSRTNPTDLMEACQHQSGVVLGGSAETGFIFPQLHPGFDAMFTIATLIELLALIGKPLTVIRQELPRVHYYHRPIRCPWLAKGSLMRHLVETHPRNHLSLIDGVKIGEPNTDHWVLILPDASEPLVHLYVNSPDALWSQQMLQRYSRRIEAFARLEPLSDATIKM

SEQ ID NO: 20337 - protein, 451 aa, Bradyrhizobium japonicum USDA 110
MARLCGEDAMLRPVIGIAVMALACMLAGTALGKGGGGHGGGGHGGGHGGGHGGGHGGGHHGGGGHFGGHGFGHAHGGGHHGGPRFATGARHGGPNFGQIRNAAVRPANFRNALNAHSSAFRNGRLIGNPAARAQIAAAAALAGWHGASSGWWQHPGGGYGWVGPLFWPFAYNDLYDYTIWGDGLGFWGYGYPDIYAGIFGPYGYDGLSAYLPQRPPGRRQARGVALDQLCGSDRREIVGLPIDQIAAAVQPSEAQGASLDELGNASILAAGMIRASCPAQVAATAPGRLAAMQQRIEAMTKAVDLVQPALDKFYGSLTDEQKARFNALAEDQRRATASSNTEGSLVQNCGAAAALDWPGADIEARLHPNDTQRAALQVLQDTSAKVSASLKAACQPNEVMTPPARMAAVRKRLDLMLDGVKSVRAALEDFYGTLNDEQKAQFEAIGPRRTS

SEQ ID NO: 20338 - protein, 262 aa, Zea mays
MEMTGFGSPCGACKFLRRRCARGCVFAPYFCDEQGAAHFAAIHKVFGASNASKLLAHLPLADRPEAAATISYEAQARLRDPTYGCVAHIFALQQQVMALQTQLASLTVTAQGQQRVHDVDDDAKGYVGTAAAGQLGCSSNGSVAPATYGNVGHESLTALLRSESDYLQQSPCHAFEHAGADDKDDDGRQGNTFDFEAAADSSSFGAEESGWRSLSGYRDCEDLWWWRRRRQQLSYRRRRPSSPFRFGVGTRPSCSTRQSALT

SEQ ID NO: 20339 - protein, 221 aa, Kluyveromyces lactis NRRL Y-1140
MTYPERKAFVSRITNETKIQIAISLNGGPISIENSILQREESDAAKQVTGSQIIDIQTGVGFLDHMIHALAKHSGWSLIVECIGDLHIDDHHTTEDCGIALGQAFKEALGHVRGVKRFGSGYAPLDEALSRAVVDLSNRPYAVIELGLKREKIGDLSCEMIPHFLESFAEAARITLHVDCLRGFNDHHRSESAFKALAIAIKEAISSNGTNDVPSTKGVLM

SEQ ID NO: 20340 - protein, 401 aa, Alteromonadales bacterium TW-7
MTVNRELFDHVMVPNYAPSSVIPVRGEGSRVWDQQGKEFIDFAGGIAVNCLGHCHPALVGALKEQGEKIWHLSNVMTNEPALRLAKKMVDATFGEKVYFANSGAEANEAALKLARRFALDKFGPEKSQIIAFNKGFHGRTFFTVTVGGQAAYSDGFGPKPGDIVHCDYNDLAAFEALISDQTCAVMMEPLQGEGGIVSPTDEFAQQVRDLCTKHNALLIFDEVQTGVGRTGDLYAYQGLNVVPDILTSAKALGGGFPIGAMLTTTDIAQHLKVGTHGSTYGGNPLACAVAEAAFDTVNTPDVLAGVKEKAALFNELLAAVNEKYNVFSEIRGKGLLIGAVVNEQYKGRAKEFLVAGTEQGLMSLVAGADVVRFTPSLVIPEADIREGMARFEKAVASVVNA

SEQ ID NO: 20341 - protein, 265 aa, Pyrococcus horikoshii
MVLYFIGLGLYDERDITVKGLEIAKKCDYVFAEFYTSLMAGTTLGRIQKLIGKEIRVLSREDVELNFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNPTIRAGMVKDLIREDFGDPPHILIVPGKLHIVEAEYLVEIAGAPREILRVNV

SEQ ID NO: 20342 - protein, 244 aa, Aspergillus nidulans FGSC A4
MPLPARTASLSRNTNETKIQVSLSLDGGVLPPYEPSSHFPVPTDPLEAEAAKKGIVPNKDAAHATQFTPTQQITISTGIGFLDHMLHALAKHSGWSLAIRAKGDLYIDDHHTTEDTFLALGTAFTTALGARQSLARFGRGDAPLDEALSWAVIDLSSRPWAVINIGFKREKIGDLSTEMITHGLQSFAQAAGVTLHIGCTYGDNDHHRAESAFKALAVAIRAACARRVEGEVGAGDVVSTKGVL

SEQ ID NO: 20343 - protein, 269 aa, Alteromonadales bacterium TW-7
MNKKILITGATDGIGFETAKMLLAQGHTVLLHGRNAQKLNKVHTLLNNDYPQASTQTYVADLSEMAQVLNLAKQITADHKHLDVLINNAGVFKLDNPETADGLDARFAVNTLAPYLLTTLLLPLFDTQGRIVNVSSAAQATVNLDALIGQSFLSDNAAYAQSKLAITMWSRHMGLKLKGNGPLVVSVNPKSLLGSKMVKDAYGLNGGDLKLGADIFCRAALSDEFSNSTGLYFDNDAECFSAPHADALNDAKNQQLIDALDLKLLQLAI

SEQ ID NO: 20344 - protein, 340 aa, Aspergillus oryzae
MSEHTLDTEALLRDSYKYGTSFFSPVSQKDTQTLKTYLLGSPLRNSLAPLLHNTLFSLAGAACTYEAIETDNSEKLLELLVKPDSLGTAVTMPLKVRSMDMVDAVTDEARSIGAINTVFIRRGDNGRSRLIGTNTDCIGVKESFLQNVDAKDLAFGSSQPGLIIGGGGACRSAVYALHFVLGVKTIYLVNRLKEEIDDIIESFRRVPDFKAKLQFVDTVESAAELSRPYLVVGTVPDRDPETEAEILAKRIVDTLMGCDAGGMQKSQGVVLEMCYHPRVQTSFYQFAERNGWRVISGTEAMIWQGVAQHILWTEKGEVFEKESTLSTIRAKIRDALMRRN

SEQ ID NO: 20345 - protein, 566 aa, Bifidobacterium longum NCC2705
MAINPPVDATQTPEWAALQKHYDELQVEGVSLKKWFAEDAERVEKLSFDAGDLHFDLSKNLIKPETLQLFANLAKAVKLDERTKAMYTGVHINNTEDRAVLHTALRRPVEDEGKYIVDGQDTVKDVRETLDKIYAFADDVRSGKWTGVTGRKIETVVNIGIGGSDLGPVMVYEALKPYADAGISARYISNIDPNDLAEKTKGLDPETTLFIIVSKTFTTLETLTNAREARTWLLEELTANGAIAEGDEAQKAEAIKKHFVAVSTNLEKVEEFGIDPNNAFGFWNWVGGRYSVDSAVGTSLAVVFGPARFEEFLHGFHEIDEYFANTPFEKNVVVLLGMLNVWYRNFFKVASHAVLPYDQYLHRFPAYLQQLTMESNGKSVRWDGTPVTSETGEIFWGEPGTNGQHAFYQLIHQGTQLIPADFIAFVNTPNPTKDGDQDVHELFLGNYFAQTKALAFGKTADEVRAEGTPEEIVPARVFSGNRPTTSIFGVALTPFALGELIALYEHITFVEGTVWGLDSYDQWGVELGKQLAKQITPAISQDDDALAAQDASTQSLIKFYRANREF

SEQ ID NO: 20346 - protein, 277 aa, Schizosaccharomyces pombe
MSSLEIIVDKILKFLEKQPKPEGRPFILGISGPQGSGKSTLASALDTELTRKNESVVKFSLDDFYLTHAEQVELAKNNPNNPLVQHRGLAGTHDVTFLNNVLNAFVKGSDEEVSIPFYDQSKFGGYGDRGDESQWKKANPKTTTYVIFEGWMVGFEPLDSCMLSVRARSTRWQNIEGSLLWVNRKLADYQPIFQKIDSLVELEAQEINYVYRWRLQQEHALKARIHKGMSDEEVIEFVNHYMPQYVFYLGTLSNKVHLNPHCLEIILDENRYPVVMH

SEQ ID NO: 20347 - protein, 170 aa, Zea mays
PPLNFAMVDDGIFRSGLPDAANFRFLLSLNLRSIVYLCPEPYAEENARFLRTNGIRLHQFAVEGSKSGPTVLDTMSAQEPFVHIPEETIREALKVVLDVRNQPVLIHCKRGKHRTGCVVGCLRKLQKWCLSSVFDEYLHFAAAKARTTDQRFMELFDASSLMHLTAASQY

SEQ ID NO: 20348 - protein, 249 aa, Zea mays
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKPIPTHAVAGISELEGVVFEVVITFALVYTVYATAADPKKGSLGTIAPIAIGFIVGANILAAGPFSGGSMNPARSFGPAVAAGDFAGNWVYWVGPLVGGGLAGLVYGDVFIGGSYQQVADQDYA

SEQ ID NO: 20349 - protein, 363 aa, Prochlorococcus marinus str. MIT 9313
MSQKTSVSSGQTTANPLAAGRHGERISTLISSKRAKVDRQIGLELFRDMTLGRRFEDKCAEMYYRGKMFGFVHLYNGQEAVSTGVIGAMKRQHDWFCSTYRDHVHALSAGVPAREVMSELFGKETGCSKGRGGSMHLFSQEHHLLGGFAFIGEGIPIALGAAFTSRYKRDALGDASSNAVTAAFFGDGTCNNGQFFECLNMAQLWQLPILFVVENNKWAIGMAHERATSEPEIWQKAAAFGMAGEEVDGMDVLAVRAATQRAIKRARAGEGPTLLECLTYRFRGHSLADPDELRAEEEKQFWAKRDPLKALEKDLTSESLVRAEELRAIEKEIDAEINDCVEFALAAAEPNPNELTRYIWAED

SEQ ID NO: 20350 - protein, 586 aa, Candida albicans SC5314
MSDRYRPRGPRNPQRGGYQSRSSYIPQRRDNRNRDSYIPSGPKRSAERDNYRPDNDRYQQQENRPASSIPHRESPSSLSGATASHPSPKGPRDSYASGMKRPLPSGPASFRKRRDFNSNSNRIPIPKGPRQGFNEMDGGNGNGNGNVDNYRRARQPEKQKLSLEQIYCIKTTNRPNIYQRVSQVGEGTYGKVYKAQHKLTGEYVAMKKLRLESEKEGFPITAIREIKLLQSFDHANIVGLLEMMVEYNQIYMVFDYLDHDLTGLLTHPDLQLQECHRKFIFKQLMEGLNYLHKKRIIHRDIKGSNILLDNIGRLKIADFGLARTMKIVGANEKPDYTNRVITIWYRPPELLLGATDYGREVDVWGVGCLLIELYCKMAAFRGMDEVSQLCRIFNIMGTPTLQNWPEIDQLPWFEMLKPKINVKSKFAQKYSESMSVPAFKLAEQLLQLNPKLRPTAEEALNHEYFQQDPQPKPLYFLKDIQGEWHEFETKKRRRAERKRIKEEEDAQLAASKKAAAAPAVASAPAEASAVNSIKEEVDSVDAITYSEKLVNGDDNKNRSSEIDSKIVDSVEEHNKMEEKSLDTKTT

SEQ ID NO: 20351 - protein, 483 aa, Oceanobacter sp. RED65
MPSQLLKTQSYVNGQWKDAQSGQEYQVVNPATGELIAKVADCAAADAEVAVELAHEAFLSWRKTTAKERSQIMRKWFDLIMTNQDELAEIMTMECGKPLAESKGEVAYGGSFIEWFGEEAKRVYGDMIPAPAGDRKVLVNKQPVGVCSAITPWNFPLAMITRKCAPAIAAGCTIVIKPAEATPLTALALCELAEQAGLPKGVLNVVTASSGKEVGEVLSTHPLVKKISFTGSTPVGKILLKQSADTVKKLSMELGGNAPFIVFDDADIDAAIKGAMASKYRNTGQTCVCANRFIVQSGIHDEFVKALAKASDELKLGNGLDEGITQGPLINKAAIDKVSGLVDDAKKKGADVVTGGEPFSSKGGYFYKPTVLTGIKDGMDIATEEIFGPVCPVFKFDKEEEAIAIANDTPFGLAAYFYSQNLSQIWRVADELEYGMVGINEGIISTEVAPFGGVKESGMGREGSKYGIDEYIEMKYLCMGGLA

SEQ ID NO: 20352 - protein, 624 aa, Oryza sativa (japonica cultivar-group)
MAHRAGCLSMLLTAAVVLLALAPRGAAYPWQVCGTTGNFTANSTYQANLDAVAAALPRNISSSPDLFATAMVGAVPEQVSALALCRGDANATECSGCLATAFQDVQNMCAYDKDAAIYYDPCILYYSNVPFLSSVDNAASTSRVNLQNVTSDPGRFNGMVAALVNATADYAAHNSTRRYASGEAVLDRESEFPKVYSWAQCTPDLTPAQCGDCLAAIIAKLPRLFTNRIGGRVLGVRCSYRYEVNPFLNGLVMVHLTAPPIPTASPPAAAAAAAGEDSSNSAESENISSVESMLIDISTLRAATGCFAERNKLGEGGFGAVYKGTLPDGDEIAVKRLSKSSAQGVGELKNELALVAKLQHKNLVRLVGVCLEQEERLLVYEFVPNRSLDQILFDADKRQQLDWGKRYKIINGIARGLQYLHEDSQLKVVHRDLKASNILLDMNMNPKISDFGLARLFGRDQTQGVTNLVIGTYGYMSPEYAMRGNYSLKSDVFSFGVMVLEIVTGKKNNDCYNSLQSEDLLTLVWEQWTARAVSEAVDPVMGGGFSWSDVMRCIHIGLLCVQENPADRPVMSSVVMMLGSDTVSLRAPSKPAFCARRNGGTGGAGASSGGTSSGTSTAASVQGK

SEQ ID NO: 20353 - protein, 157 aa, Solanum commersonii
MAHYENQYSAGQALQKDEYGNPVRQTDEYGNPIQQTGGTMGEYGTTGTGYGTQAGHTTGVLGGDQRQHGTLGGMLHRSGSSSSSSSSEDDGHGGRRKKKGIKDKVKEKLPGGHRDDLAHSTATTTTTGYGMDGTHEKKGIMEKIKEKLPGHHGPGHH

SEQ ID NO: 20354 - protein, 456 aa, Chondrus crispus
MVTGFVPCAAPLRATTRQTAAVSVVSRSASTFVAPSRRVTAPAAPVPTVRMTTAAATTKKSIKDLSPADIAGKRVLVRCDLNVPLDGKTITDDTRIRASVPTIKFLMEAGAKVLLSSHLGRPKDGPEDKFSLSPVAARLTQLLGKDVTMAPDCIGDGVTKIVSGMANGDVTLLENVRFYKEETKNDPDFAKKLAANADFFVNDAFGTAHRAHGSTAGVTAHLKPSVAGLLLEKELAYLAGTVSDPARPFAAIVGGSKVSSKIGVIDSLLQKVDKLIIGGGMVFTFLKAKGLNVGSSLVEDDKLELARELVKTAEAKGVSIILPTDVVLADKFAADANTQVTSVDSIPDGWMGLDQGEDSTKLIQNELKECKTVIWNGPMGVFEMEKFAKGTFAIADTLADLTESGCITIIGGGDSVAAVEKAGLAEKMSHISTGGGASLELLEGKVLPGVAALDDN

SEQ ID NO: 20355 - protein, 647 aa, Xanthomonas campestris pv. campestris str. ATCC 33913
MCGLAGLLLATPRMHGEQLEALVRPMGGALRHRGPDDAGTWCDAQAGVALAHQRLSILDLSPLGHQPMRSADSRYVLAYNGEIYNFAQLRAALAALGHRFRGHSDTEVLLAAVVEWGLDDTLARCNGMFALALWDERDHCLSLARDRVGKKPLYYGWAGDTLVFGSELKALWQHPDFDNGVDRDALTLLLRLGYIPAPACIHERTFKLMPGRVLRLDAQAVAAGAAAHRPDQAQQPFWNAREAMQRALAAPFTGTDAQAEEQLDSLLRDAVALRMVADVPVGVFLSGGTDSSIVTAMMQAQSDQPVHTFSIGFEGSHHDEAPLAREVATHLHTDHTELYVSGADALAVVPTLPDMFDEPFADASQVPTALVARLARGGVTVALSGDGGDELFFGYGRYQRALRNWRMHGLVPAPLRRLMAVAARKSGEASRTGGLAALVAEAGARGIGDIYRNRISRWRDPAAVVLGATEPDSFYSLADPLHGSGTPADAMMLADFAAYLPDDLLCKVDRTTMAVGLEARAPLLDWRVAEFAWSLPLSLKYRDGVSKYLLKRVLCRYLPEPMVYRGKRGFGAPVSAWLRGDLHGWADDLLAHGTLQREGVFAADTVAGLWRDFNGGERKWHTHLWTVLMFQAWQDHWRAQRAAIVRS

SEQ ID NO: 20356 - protein, 453 aa, Prochlorococcus marinus str. NATL1A
MKSSFDLIVIGAGSGGLAAAKKAASYGASVAIVEGDLVGGTCVIRGCVPKKLLVCGSSLLESFLSATSYGFDFDNLKIKSEVLLANVRKEVHRLNELHENFLNKANVELFKGWGEFRNSNCVEVKDRKNGETLNELYGERILIAVGGRPKRPSIEGASLGWTSDDMFLLKSFPKKITIVGAGYIACEFACILHGLGVEVTQLVRGDRILRGFDFELSSSLTEAMKNKGVNISFGEKISSLKGTPGSLIIKTNAGKEFDSNGLLFATGREPFLDGLKLEQAGIEILENKIKVDSEGKTNISNIFAIGDVTDRINLTPVAIDEGRKFADRNYGESDHKVNYNFVPYAVFSQPEIASVGMTEEKAIQSIGKDNIKVYRSIFRPLSKSLPKTGSKCILKLIVDKNNNKVLGCHMIGDNASEIIQMASISLMLGAKKTDFDNTMALHPTIAEEFVTMR

SEQ ID NO: 20357 - protein, 418 aa, Chondrus crispus
MSFSKLCIDALDLAGKRVFIRVDFNVPFDKETGKTITNTQRIDAALPTIKYALEKGAKSVVLASHLGRPSGRVNPKFSLKPVADVVSEKIGKTVTFLEDAVGSATEEACKDPETGSVFLLENLRFHIEEEGKGVDADGNKIKADAAKVTEFRKSLSTLADVYVNDAFGTAHRAHSSMVGVDLPQKASGFLMKKELEYFGKALQEPQRPFLSILGGSKVSDKIQLIENLLDKVDEMIIGGGMAFTFKKAVEGMAIGQSLFDEAGAKIAQEIVDKAKAKNVKLHFPVDFTIADKFAPVANTRVATDSEGIPDEWMGLDAGPKSQEAMREVVLRAKTVVWNGPVGVFEFEAFAKGTKAVVDAVVEATSSGAVTIIGGGDTATAVKEMGAADSVSHVSTGGGASLELLEGKTLPGVAALTDA

SEQ ID NO: 20358 - protein, 68 aa, Zea mays
NCIIDKNARIGKNVVIMNSENVQEADRPAEGYYIRSGITVVLKNAVILNGKLSVMLKNMELILLHMII

SEQ ID NO: 20359 - protein, 272 aa, Thermosynechococcus elongatus BP-1
MKYRILMATLLAVCLGIFSLSAPAFAAKQTLTYDDIVGTGLANKCPTLDDTARGAYPIDSSQTYRIARLCLQPTTFLVKEEPKNKRQEAEFVPTKLVTRETTSLDQIQGELKVNSDGSLTFVEEDGIDFQPVTVQMAGGERIPLLFTVKNLVASTQPNVTSITTSTDFKGEFNVPSYRTANFLDPKGRGLASGYDSAIALPQAKEEELARANVKRFSLTKGQISLNVAKVDGRTGEIAGTFESEQLSDDDMGAHEPHEVKIQGVFYASIEPA

SEQ ID NO: 20360 - protein, 340 aa, Oryza sativa
MGASPSRPLEQSPSSSEGENHRVKYASYTTQGFRPHMEDALAVELDLDATTSFFGVYDGHGGAEVAMYCAKRFHTMLLEDVDYINNLPNAITSVCFRLDDDLQRSNEWRESLNPCANRNCLTNICANLHHFTEDYVPPSYEGSTACVVIIRGNQIIVGNVGDSRCVLSKNGQAISLSFDHKPHHEAERERIQRAGGHVFLQRILGMLATSRAIGDFAYKQNRNMPPSQQMVTCVPDIRVENITDDTEFLVIASDGVWDGMRNNNVVQFVRQELRPGEENLRETCEKLVGHCLHSNDNATAILVKFKPIEEDPDEVASARDEHQHNPEGGDEKLDINNDND

SEQ ID NO: 20361 - protein, 340 aa, delta proteobacterium MLMS-1
MKAEKLKKQLQAAAGQIETVMAADLEGVTSPRLREVLEHALFAGGKRIRPLLTLLAARLTTAANHGGVPTEPPAADQATDQQRLAIAFEYLHTASLLHDDVIDHAAQRRGRETVNSRWDQGHAILAGDFLHARAMWLAGNYGGQPCLELIASATEAMVAAEFLQAEAAAARDWRRETYFAVLEGKTAALIAAACQCGVVAGGGDYRQGQALRVYGANLGLAFQIIDDLLDFLGDPRATGKAVGNDLQEGKMTLPLLLAHQRATPEQRCWLEQLLAAEPARRQAELDTVRQLLTETDAFAGCRSQARELIATGLAGLEIFPAGGERELLQGLGEYVLQRDH

SEQ ID NO: 20362 - protein, 264 aa, Oryza sativa (japonica cultivar-group)
MAAAAARSIPDRWTLAGATALVTGGSKGIGHAIVEELAGFGARVHTCARNAAELEASRRRWEERGLRVTATVCDVSARGDRERLVAAAAGEFGGRLDILVNNVGRTMFRAAAACSGEDFALLVATNLESCFHLSQLAHPLLLAAGGGGGCVVNISSVAGTVGIPALAVYSMTKGGMNQLTRSLAAEWAGDGIRVNCVAPGGVKTDICQDETIDPELIKSEMDRLPMRRLAEPEEVAATVAFLCMPAASYITGQVVGVDGGRTIT

SEQ ID NO: 20363 - protein, 627 aa, Kluyveromyces lactis NRRL Y-1140
MSDIAENMSNLSVQDNDSGATSGDSRRSYVPPHVRGQQRSGSGNYRGRSDNFGGNERSFFGNERRGGGYSRGGRGSVNWGGSNWGGRNDSRGSGGYGGGNSSGRWIDGKHVPAAKNANLELELFGVAEDKSFQSSGINFDNYDDIPVEASGNDVPEPISEFHSPPLDPLLLDNIKLARFTKPTPVQKYSVPIVAAGRDLMACAQTGSGKTGGFLFPVLSESFSSGPASTPEAAGNSYIKKVYPTAVILAPTRELATQIYDEAKKFTYRSWVKPMVVYGGASIDNQIKQMRYGCNLLVATPGRLTDLLERRYISLANVKYLVLDEADRMLDMGFEPQIRRIVEGSDMPSVDNRQTLMFSATFPSEIQHLASDFLKDYVFLSVGRVGSTSENITQKILYVEDFDKNDTLLDLLAASNEGLTLIFVETKRAADSLTDFLIMEGFKATAIHGDRTQGERERALSAFKTGRATILVATAVAARGLDIPNVTHVINFDLPNDIDDYVHRIGRTGRAGNTGVATTFFNRGNKNVAKELVSLLSEANQEVPSFLTTIMREASSGRGGARGGRGGYNRGNSTRDFRRGGAPSGGFSSGGGSSGGWGNGGGSSGGWGNSSGNWGNSSNSSNSNSGWW

SEQ ID NO: 20364 - protein, 377 aa, Haemophilus ducreyi 35000HP
MAKKDYYEVLGLQKGATEKDIKRAYKRLAAKYHPDKNQGSKDSEEKFKQITEAYEILTDDQKRAAYDQYGHAAFEQGSSNGGFNGFGGGFGGFEDIFSEMFGGGFGGGSRRQHVVRGQDLRYDIEISLEEAVKGCKKDIRLSTLAECDNCHGTGAEAGTKVENCPHCHGAGRIRRQQGFFVTEAVCPSCHGTGKKIEKPCHSCHGDGRVQKAKNLSVTIPAGVDTGNQLRLSGEGEAGENGAPAGDLYVVIHVREHNIFTRDGANLYCEVPISFSMAALGGEIEVPTLDGKLKLKIPTETQTGKLFRVRGKGVVSPRGGYAGDLICKVVVETPVQLNEEQKELLRQLEISLDGKANHRPQQAGFLDSVKNFFTHLGK

SEQ ID NO: 20365 - protein, 420 aa, Arabidopsis thaliana
MALSSLLRSAATSAAAPRVELYPSSSYNHSQVTSSLGFSHSLTSSRFSGAAVSTGKYNAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 20366 - protein, 1064 aa, Shewanella sp. MR-7
MEAITMFKASEVLAGRYDSANLDELFKAVTDNYIVDEEQYLSELIKLVPSSDEAIERVTRRAHELVNKVRQFDKKGLMVGIDAFLQQYSLETQEGIILMCLAEALLRIPDAATADALIEDKLSGAKWDEHLSKSDSVLVNASTWGLMLTGKIVKLDKKIDGTPSNLLNRLVNRLGEPVIRQAMMAAMKIMGKQFVLGRTMKEALKNSEDKRKLGYTHSYDMLGEAALTRKDAEKYFNDYANAITELGAQSYNESESPRPTISIKLSALHPRYEVANEDRVLTELYDTVIRLIKLARGLNIGISIDAEEVDRLELSLKLFQKLFNSDATKGWGLLGIVVQAYSKRALPVLVWLTRLAKEQGDEIPVRLVKGAYWDSELKWAQQAGEAAYPLYTRKAGTDVSYLACARYLLSDATRGAIYPQFASHNAQTVAAISDMAGDRNHEFQRLHGMGQELYDTILSEAGAKAVRIYAPIGAHKDLLPYLVRRLLENGANTSFVHKLVDPKTPIESLVVHPLKTLTGYKTLANNKIVLPSDIFGSDRKNSKGLNMNIISEAEPFFAALDKFKSTQWQAGPLVNGQTLTGEHKTVVSPFDTTQTVGQVAFADKAAIEQAVASADAAFATWTRTPVEVRASALQKLADLLEENREELIALCTREAGKSIQDGIDEVREAVDFCRYYAVQAKKLMSKPELLPGPTGELNELFLQGRGVFVCISPWNFPLAIFLGQVSAALAAGNTVVAKPAEQTSIIGYRAVQLAHQAGIPTDVLQYLPGTGATVGNALTADERIGGVCFTGSTGTAKLINRTLANREGAIIPLIAETGGQNAMVVDSTSQPEQVVNDVVSSSFTSAGQRCSALRVLFLQEDIADRVIDVLQGAMDELVIGNPSSVKTDVGPVIDATAKANLDAHIDHIKQVGKLIKQMSLPAGTENGHFVSPTAVEIDSIKVLEKEHFGPILHVIRYKASELAHVIDEINSTGFGLTLGIHSRNEGHALEVADKVNVGNVYINRNQIGAVVGVQPFGGQGLSGTGPKAGGPHYLTRFVTEKTRTNNITAIGGNATLLSLGDSDA

SEQ ID NO: 20367 - protein, 309 aa, Salmonella typhimurium
MRGSHHHHHHGMASHMINKIFALPVIEQLTPVLSRRQLDDLDLIVVDHPQVKASFALQGAHLLSWKPVGEEEVLWLSNNTPFKTGVALRGGVPICWPWFGPAAQQGLPSHGFARNLPWALKAHNEDDNGVMLTFELQSSEATRKYWPHDFTLLARFKVGKTCEIELEAHGEFATTSALHSYFNVGDIANVKVSGLGDRFIDKVNDAKEGVLTDGIQTFPDRTDRVYLNPEACSVIHDATLNRTIDVVHHHHLNVVGWNPGPALSVSMGDMPDDGYKTFVCVETVYATAPQQATEEKPSRLAQTICVAKR

SEQ ID NO: 20368 - protein, 474 aa, Burkholderia xenovorans LB400
MNHYDVVVIGCGAGGYNTAIRASQLGLSVACVERASNIGGTGMRTGCIPSRLLLHTSEIYDLANKGKNAALGIGCAPTLDLTQMMAYKASTVEKMSNSIHKLLRKQGVTLIHGDALLAAAGQVIVRKTGGVQQTLSGTALVIATGSVPIPLPFAAFDHMRILDSADALSLGKVPRHLAIIGAGAVGVELGSIWQRLGSRITLIERCDRICHWLDRDVTATLERSLRQRGIDIRVSSDVVGLDKHSDSVSVQLRAAASGKITHIDADRVLVAIGRRPSTAGMNLASVGMQTGYKSTLSQQGPATPVTSMTNGSGIWVIGDAGPGPMLMSKAEEEAIACAERIAGLPGFVSYPSIPYVLHTSPEVAMIGRTEDELRGTGAAYRVGYYPLAANPRAAICGTSEGFVKLLVDADTNLIAGAHLIGPGAADLISQVAIAMEASMICEDFARICHPYPVWSEALRQAAMAAGGWMMHVAI

SEQ ID NO: 20369 - protein, 362 aa, Mycobacterium bovis AF2122/97
MSASLPVFPWDTLADAKALAGAHPDGIVDLSVGTPVDPVAPLIQEALAAASAAPGYPATAGTARLRESVVAALARRYGITRLTEAAVLPVIGTKELIAWLPTLLGLGGADLVVVPELAYPTYDVGARLAGTRVLRADALTQLGPQSPALLYLNSPSNPTGRVLGVDHLRKVVEWARGRGVLVVSDECYLGLGWDAEPVSVLHPSVCDGDHTGLLAVHSLSKSSSLAGYRAGFVVGDLEIVAELLAVRKHAGMMVPAPVQAAMVAALDDDAHERQQRERYAQRRAALLPALGSAGFAVDYSDAGLYLWATRGEPCRDSVAWLAQRGILVAPGDFYGPGGAQHVRVALTATDERVAAAVGRLTC

SEQ ID NO: 20370 - protein, 312 aa, Burkholderia xenovorans LB400
MKVSKETKQGRVLVVGSINTDLVARAPHLPRPGETIGGHEFSQVAGGKGANQAVAAARIGARVAMIGCVGSDANGAQRVKDLEVEGIDCSGVEVHPTQPTGVAMVTVSDDGQNTIVVVAGSNGELTPQSVARHEAAIKACDVVVCQLETPWDSVHATLALARRLGKITVLNPAPATGPLPAEWLPLVDYLVPNEVEAAILAGLPVESQSGARRAATELQQGGAHNVIVTLGAQGAYLLVEGGEGRHFPAPQVHAVDTTAAGDTFIGVFAAQLASRQPLEGAINLAQRAAAISVTRAGAQPSIPTRAEVDNAA

SEQ ID NO: 20371 - protein, 343 aa, Oryza sativa (japonica cultivar-group)
MAGSRAAGRGGRPLLGGGGGKRGGGGGGGGGGGGKSSSYTTTVILAALLLASVALLLLVALGALSLPSGGGVGVGHAGIGLPRPRPRFRRSAAFESGLEMRGGEKGEPWTEVLSWEPRAFLYHNFLSKEECEYLISLAKPHMKKSTVVDASTGGSKDSRVRTSSGMFLGRGQDKIIRTIEKRISDYTFIPVENGEGLQVLHYEVGQKYEPHFDYFHDEFNTKNGGQRIATLLMYLSDVEEGGETIFPSSKANSSSSPFYNELSECAKKGLAVKPKMGDALLFWSMRPDGSLDATSLHGEIPILWLLTNSNLSMLLLKERKEKRSFLAHVEDFNFSIEKHYNFF

SEQ ID NO: 20372 - protein, 289 aa, Corynebacterium diphtheriae NCTC 13129
MPGHFILTIMIHFRAAVLGHPIEHSLSPLLHNAGYAALGLSQWSYGRFDCDSQQLSELVDKCDPSFQGFSVTMPCKFEALEYATSVSERAQRIGSANTLVRAENGWYADNTDTEGVRGALEILFSDRGGAAEALKNTRAIVVGAGGTSRPAIWTLGTLGVAEIVVVNRSDRREELEPVLEGEPTKISFVGFDSNLRSHAQSASVVISTVPSVGVSDYIDDLVHAPVLDVIYDPWPTPLIQHAQKKGVPCIGGHIMLLHQALSQFEQFTGVKAPREAMQKALFDHLFGDN

SEQ ID NO: 20373 - protein, 540 aa, Aeropyrum pernix K1
MALWRIEKPKNEPFLEFRPGTKERELLKKKLEEVKSKTVEIPLIIGGKEVKTGETVEIRAPHDKDAVLAVAHLAGEEEIRDAIEKALDAWTKWSEMEWYHRASVFLKAADLLAGPYRLEADAVIMLNHSKTPWEAEIDLAELVDFWRFGAYYARFIFEQQPEQAPGELNRVEWRPLEGFVFAVPPFNFFSIGGNLPTAPALVGNVSIWKPSRWVIYSNYIIMRILMEAGLPPGVVNFVPFNTKYSSIVLSHPDFAGLHFTGSYSTFVRLWKMIAQNLDKYRNFPRIVGETGGKDFIVVHPSADITEAVVATIRGAFEYQGQKCSAASRLFVPKSMWPRFWEAMKAELDKVKVGPVDDFTVFMGAIISEEQFRKIVSYIEYAKQHPEEYQIIYGGKYDDSKGYFIWPTVVLTNNPKGKLMTEEIFGPVLTVYVYDDDKYDEILWVVDKAAPYGLTGSVFAKDREAILKAEKALRYAAGNFYINDKPTGSIVARQPFGGARWSGTNDKAGWFTNLLRWLNPRSIKETLVPPKEWRRPYMGED

SEQ ID NO: 20374 - protein, 123 aa, Prochlorococcus marinus str. NATL1A
MKKYTNFFFIKLRGFFLISICCTCFYLSLPKELNAIEADSGKNLFNHNCAGCHINGGNIIRRSKNLKISSLKRNGIDNPEAIANIARQGVGIMSGYEDELGDNGDQIVANWVWEQAQKAWVQE

SEQ ID NO: 20375 - protein, 357 aa, Bradyrhizobium japonicum USDA 110
MRTHSIAAIPADGIGPEVISAGVRVLEALARRSGDLAFNVKTFDWGSDYYKKHGVMMPADGLAELKKFDAIYFGAVGAPDVPDHITLWGLRLPICQGFDQYANVRPTKILPGVASPLRNVGVGDLDWVIVRENSEGEYAGMGGRAHRGLPEEVGTEVAVFTRVGVTRIMRYAFQLAESRPRKFLTIVTKSNAQRHGMVMWDEIAAEVAGEFPDVTWDKMLVDAMTVRMTLHPKSLDTIVATNLHADILSDLAGALAGSLGVAPTGNIDPQRRFPSMFEPIHGSAFDITGKGIANPVATFWTGAQMLEHLGEKDAAMRLMTAVERVCAAGVLTPDVGGKATTKEVTDAVIDAIHGSNV

SEQ ID NO: 20376 - protein, 470 aa, Yarrowia lipolytica CLIB122
MASIPHYDYLVIGGGSGGVASARRAASYGAKTLLIEGKALGGTCVNVGCVPKKVMWNASDLAGRIRQAKEYGFPDVDPKYADNFDWSGFKAKRDAYVKRLNGIYERNLQKEGVEYVFGWATLYKQEGQEFPLVHVKSDDGNTKLYSAKKIMIATGGKPRLPDVPGAEYGIDSDGFFALETQPKRVAVVGGGYIGVELAGVFHGLNSETTLFCRGQTVLRAFDIMIQDTITDYYVKEGINVLKGSGVKKIVKKDNGELLVTYEQDGAEKDITLDSLIWTIGREPLKDTLNLGEFGIKTNKRGYIEVDEYQRSSVDNIYSLGDVCGKVELTPMAIAAGRKLSNRLFGPTEFKNQKQDYTDVPSAVFSHPEVGSIGITEAAAKEQYGEENVKVYTSKFVAMYYAMLEEKAPTAYKLVCAGKDEKVVGLHIVGADSAEILQGFGVAIRMGATKADFDNVVAIHPTSAEELVTMR

SEQ ID NO: 20377 - protein, 213 aa, Prochlorococcus marinus str. NATL1A
MFFIDNLHFDQNGLIPAIAQDWIDGAVLMMAWMNKESITKTLESGEVHYWSRSRKELWHKGKTSGHFQKLKGIRTDCDSDTILLSIEQIGSIACHTGERSCFFKDLETNKDVLHPPSNACSELFNVIESRKSNPEEGSYTNTLLKEGDNKILKKIGEETAEFIMACKDKNPISVANEAADLLFHMQVSLANQNVSWEEVLKVLVKRRGAPRRN

SEQ ID NO: 20378 - protein, 268 aa, Oryza sativa (japonica cultivar-group)
MAAAAARSIPYRWTLAGATALVTGGSKGIGHAIVEELAGFGARVHTCARNAAELEASRRRWEERGLRVTATVCDVSARGDRERLVAAAAAEFGGRLDILVNNVGRTMFRAAAACSGEDFAVLVATNLESCFHLSQLAHPLLLAAGGARGGGGGCVVNISSVAGSVGMPALAVYSMTKGGMNQLTRSLAAEWAGDGIRVNCVAPGGVKTDICQDETIDPELIKSEMDRLPMRRLAEPEEVAATVAFLCMPAASYITGQVVGVDGGRTIS

SEQ ID NO: 20379 - protein, 423 aa, Pyrobaculum aerophilum str. IM2
MLFERAKSVFPGGVNSPARALKHLPSPLVAKAASGAYLYTDRGKLVDYCMAFGAIILGHAHPRVKKAVEEQLEKGWIYALLTEQEVEFAERIRRHMPSVEKMRIVNTGTEATMSAIRAARGYTKRDVIIKFEGNFHGSHDYVLVKAGSGAATWGIPTSAGIPQEVARLTVVVPYNDIDAFIKAVREVGDRLAAVIVEPVAGNYGLIIPDVEFLKALREETQRAGALLIFDEVITGFRVGLGGAQGLFGIRPDLTTLGKVVGGGFPIGIFGGRGEVMDLVAPSGPVYNAGTYNAHPVSIAAGLAVLKELETGEPYRIANEAAERLAKGVEDVAGRLGFDVVVKRMASMFQFYFKKGDVKTPQDVRESNEKMYLKLHEIALKHGVYLTPSQYEVNFTSAAHGREVVEETLAALEKSFQELQREIG

SEQ ID NO: 20380 - protein, 512 aa, Torenia hybrid cultivar
MSPLALMILSTLLGFLLYHSLRLLLFSGQGRRLLPPGPRPWPLVGNLPHLGPKPHASMAELARAYGPLMHLKMGFVHVVVASSASAAEQCLRVHDANFLSRPPNSGAKHVAYNYEDLVFRPYGPKWRLLRKICAQHIFSVKAMDDFRRVREEEVAILSRALAGKRAVPIGQMLNVCATNALSRVMMGRRVVGHADGTNDAKAEEFKAMVVELMVLSGVFNISDFIPFLEPLDLQGVASKMKKLHARFDAFLTEIVRERCHGQINNGGAHQDDLLSTLISFKGLDDGDGSRLTDTEIKALLLNLFAAGTDTTSSTVEWAVAELLRHPKTLAQVRQELDSVVGKNRLVSETDLNQLPYLQAVVKETFRLHPPTPLSLPRLAEDDCEIDGYLIPKGSTLLVNVWAIARDPKVWADPLEFRPERFLTGGEKADVDVKGNDFELIPFGAGRRICAGVGLGIRMVQLLTASLIHAFDLDLANGLLPQNLNMEEAYGLTLQRAEPLLVHPRLRLATHVY

SEQ ID NO: 20381 - protein, 457 aa, Torenia hybrid cultivar
MAKTYGPLMHLKFGLKDAVVASSASVAEQFLKKHDVNFSNRPPNSGAKHIAYNYQDLVFAPYGPRWRLLRKICSVHLFSSKALDDFQHVRHEEICILIRAIASGGHAPVNLGKLLGVCTTNALARVMLGRRVFEGDGGENPHADEFKSMVVEIMVLAGAFNLGDFIPVLDWFDLQGIAGKMKKLHARFDKFLNGILEDRKSNGSNGAEQYVDLLSVLISLQDSNIDGGDEGTKLTDTEIKALLLNLFIAGTDTSSSTVEWAMAELIRNPKLLVQAQEELDRVVGPNRFVTESDLPQLTFLQAVIKETFRLHPSTPLSLPRMAAEDCEINGYYVSEGSTLLVNVWAIARDPNAWANPLDFNPTRFLAGGEKPNVDVKGNDFEVIPFGAGRRICAGMSLGIRMVQLVTASLVHSFDWALLDGLKPEKLDMEEGYGLTLQRASPLIVHPKPRLSAQVYCM

SEQ ID NO: 20382 - protein, 617 aa, Deinococcus radiodurans R1
MAAMVSHSSPVDGAPVSRPRSPVMATELKLPDVGDNIEKGTVVTVLVNPGDSVTEGQPIIEIETDKAVVEVPASAAGTIEAVNVKVGDTIPVGGVIATLGGGAASASDSAPSASAPSPANGGGDQAANVESTPATDSGTAQRVAQAQQDAQKEQAGQPTSGGTADANQAQATPSEGQSSGGQQVTLPDVGDNIEKGTVVTILVNVGDTVSEGQPVIELETDKAVVEVPANASGTVQSVAVKIGDSIPVGGTILTLSGAASTQPTAPAPESAQPASQSQQSTQPEPARPAGAPQAQAAAPQQSGTQNPQTFDGRPVVPAAPSVRRLAREIGIDIHAVHGTGIAGRISEEDVRRTAGTPSVQAQASAASAAAPAPMAAPLPNFEKWGTVRREDMSGIRKATVRSMTTAWTTIPMVTHFDKADVTAMEETRKRFGARVEKEGGKLTMTHILMKVVANALRKFPKFNASLDLGAEQVIYKEFVNIGVAVDTPVGLLVPVVKDADRKGITELVLDLSELAGRARERKLKPDEMQGATFTISNLGGIGGNAFTPIVNSPEVAILGVSRGGFEPVWNKEKGEFEPRNMLPLSLTYDHRLIDGADAARFLRYICESLEDPFLISL

SEQ ID NO: 20383 - protein, 933 aa, Deinococcus radiodurans R1
MTNSGGQSPELFMLEGVSGASYTAFMTPQPPPRPPRADLPEQQREQLNTVETQEWLDSLAYVFANAGSKRAADLLEDLDHYAYFHGAPIEFRQTTPYINTIAAEDQPEYPGDLELERKIRNINRWNSVAMVIKANKKSDGIGGHLSTYASAAELLEVGFNHFFRGHGAGQDRDLVFYQGHAAPGMYARSFLEGRFDEARLNRFRRELQPDGEGLSSYPHPWLMPDYWEFPTVSMGLGPIQAIYQARFIKYLENRGLKPQGNAKVWAFLGDGEMDEPESVGAIRFAAYENLDNLIFVLNANLQRLDGPVRANSKVIQEFEALFRGANWNVIKVIWDSKWDELLQHDYNGVIVKRFEDLVDGESQRYAAFGGKELREHFFNTPELKALIQDWTDADLELLNRGGHDVQKVHAAYASAMGHKGSPTIIIPRTVKGYGLGETAQARNVAHQVKKLEFDALKNLRDLLELPLSDEQVEHLEYYHPGSDSPEVKYTLARREQLGGLIPARQVNFPHLTVPQGSFYEEFAKGSGERQVSTTMAAVGIMSKLLRDKEIGKYIVPIVPDEARTFGMDALVPRIGIYSPRGQTYRPVDFGSLMAYKEAKDGQMLEEGITEAGAMASWIAAGTAYAHHGVPTIPFYVFYSMFGMQRIGDLVWAAADQRARGFLLGATAGRTTLAGEGLQHQDGNSLLQGYVVPTMKTYDPAFAYEVAVIFEEGIRRMYVEDVEEFYYVTVDNENEVQPPMPEHLSHEEIRHGIMKGLYRFQPSTLEGAQHHAQLLASGPAMGAAQEAVKLLEGYGVAADLWSVTSYKELHQEALMVQRHNMLHPTEEPQVSYVAAQLNEENAPGVLISVSDYVKLGADGLNGHLDRKLWTLGTDGFGRSEAREELRDFFEVDTKHVVLATLYALQQRGEVKGEVVAKAIADLGIDPSKPAPVLR

SEQ ID NO: 20384 - protein, 261 aa, Triticum aestivum
AARSLQVQPGRAAAAAVLALVGFFSLAAGAGRRAGAGASGGASSGGERIAGRDHKARCCNWCDQEMSLHSCPAAAGDAPTGTAEDLLERARGLVPAALDAARAATGFGARWKAIAARLERVPPCLSDLSSHPCFSKNALCRELLQSVAATLAEAAELGVLCREPPKAGKLQMQSDLDALAGKLDLNLRDCELLVKTRVLSDATVPSPPAEAAAAAASQTDVRELLARLQIGHAEAKHRAVEGLLDALREDEKSVLSALGRG

SEQ ID NO: 20385 - protein, 577 aa, Shewanella sp. MR-7
MHESQITSSATQTVKTSRLSWFDDVLLLGIMAVLAGCGLIYEYLLSHYAGRILGALEAAIYTMIGLMIVSMGLGAFAARKIKDAFTGFVVLELTVALCGSLAILITAAVIGFGQQLPMLIASTLGLPPDQLPEGGMIGSLQKLSEYLPYVWGVLLGLMIGMEIPLIARVRQSLSDEHLLHNAGTIYGADYIGAGIGAAIWVGFMLAIDIQLAAALTASFNLLAGFVFIWRFWPKIQRAKLLLAGHFVVTGVLLLLAIQGPSWELQFNNLLYKDKVVYAKATRFQQLTFTERLRGNGLSPIYSLYINGRLQFSSIDEHIYHAFLVHPTLAASARHNKVLIIGGGDGLGLKQVLRWEPEQVTLLDLDAALVQLFKTPDTDMPKRLSQALLALNGNAFNDPRVKVIHDDAFNGVDKLIAAGDKYDAIIVDLPDPSHPDLNKLYSDYFYRKLKELMSSDGALTVQSTSPYHAQKAFISVAKTLALAGFDVKQYHHNVPSFGEWGWSIATLSGKDAQHRLGELTTLPIADDWLTLGLVKGAFEFPANFYQDAASIKPNELGSLQLYHYHQQAWSETQGLDLF

SEQ ID NO: 20386 - protein, 264 aa, Panax ginseng
  misc_feature (13)..(13): Xaa can be any naturally occurring amino acid
  misc_feature (22)..(22): Xaa can be any naturally occurring amino acid
  unsure (1)..(264): unsure at all Xaa locations
QTPNLQSLSSDPXASTAWVQKXIKDYTPGVNFKYIAVGNEVDPNRENSRQYVNFVLPAMQNIHNAIKAAGLNQIKVSTATYSGLIGPNSSPPSLGSFDDNVKGFINPIVTFLAQNNLPLLVNIYPYFSHNEGNLPYALFTAQGVVVTDPEGNRGYNNLFDALVDVQYSALEKAGGPNVEVVVSESGWPSAGGINDASVENAQTYYQNLINHVRGGNGTPKRPGRPIETYLFAMFDEDKKAGDEVEKHFGLFTPSQQSKYQLSFD

SEQ ID NO: 20387 - protein, 260 aa, Bacillus licheniformis
MFRLYSDLKGKTAIVTGSSKGIGKAVAERFGKEKMNVVVNYHSDPGGAREAVDNIQAAGGNALAIEADVSSEEDVKKLINSAVEHFGSLDVMVNNSGFNGAGAFPHELELDEWQKVIDVNLTGAFLCAREALKYMADRRMKGSILNISSVHQQIPRPKNVHYSASKGGMKLLTETLALDYADKGIRVNAIAPGTIATESNEDLEGSRKSEQLKKIPMNEFGEPEQVASAAAWLVSQEAAYVTGATLFVDGGMTLYPSQLE

SEQ ID NO: 20388 - protein, 172 aa, Clostridium acetobutylicum ATCC 824
MDLKDSIRVIDGFPKEGISFKDVTTLIQDKEAYKYSVDKIGEYLKDKNVDLIVAPEARGFLFGAPVAYKIGAGFIPVRKKGKLPCETVEVTYELEYGEDILEMHKDAIKKGQRVAIVDDLLATGGTINSVAKLVEALGGEVVAACFVVELTDLNGKDKLGDYDTMSLVKYNV

SEQ ID NO: 20389 - protein, 861 aa, Mycobacterium sp. KMS
MAEAHPVGFQWVVEAKARGTDVVHIDPRFTRTSALADRYVSLRAGSDIALLGGVINYILSNELDFREYVTAYTNASFIVDERFSDAEDLDGLFSGYDDATASYDPSTWQYQTTDPEEGGAEAKEQSSGDRSGSGGPPVEGGAGDIPRDPTLQDPRCVYQILKRHYARYTPEMVERVCGVPAEQFLEVARKWAENSGRERTAALVYSVGWTQHTMGAQFIRAGAIIQLLLGNIGRPGGGVFALRGHASIQGSTDVPTLFNLLPGYLAMPHAGQETLADYLDDIKSRNQKGFWFNADAYMVSLLKEYWGEHARADNDFCFDYLPRISGDHGTYRTVMDMVDGKVFGYFLLGQNPAVGSAHGRLQRLGMANLDWLVVRDLVEIESATFWKSGPEVETGEITPQTCRTEVFLFPAASHVEKAGTFTQTQRMLQWREKAVEPPGDARSELWFFYHLGRILREKLAGSTDERNRPLLELSWDYVMDGDEPSGEDVLRRISGVDLTTGRAVDDYMSLRADGTTMSGCWIYSGVYADEVNQAARRKPHDQQGPYENEWGWTWPMNRRVLYNRASADPQGRPWSERKKLVWWDTEKQEWTGYDVPDFEKHKPPDYRPAPGAVGVEALHGDDPFIMQADGKAWLFAPNGLADGPLPTHYEPHESPVRNPLYAQQGNPARKVYGRADNPSNPSPPELHGEVFPYVFTAARLTEHHTAGGMSRQLPYLAELQPGLFVEVSPQLAAERGLTHMEWAHVITSRAAVDARVFVTDRMRPLRIDDHVVHQIWMPYHWGNAGLIDGDVVNDLLGVVADPNVFIQESKVATCDIQPGRRPRGPALLEYIAMYRDRARITVDTGTDLDTTKRSTEHTEET

SEQ ID NO: 20390 - protein, 191 aa, Zea mays
MRPPRGRGGGGRFGGGGGRGGGGGRFGGGGRGGRFGGGFRDEGPPAEVVEVSTFLHACEGDAVTKLTNEKVPYFNAPIYLQNKTQVGKVDEIFGPINESYFSVKMMEGIIATSYKEGDKFYIDPMKLLPLSRFLPQPKGQSQGAPRGGGRGGRGGGRGRGGSFRGGRGPPRGGGRGPRGGSRGGFRGRGRF

SEQ ID NO: 20391 - protein, 518 aa, Aspergillus oryzae
MVQPGTSQSSWVDFIKHPFVGTFTFFYLLFQAVLNWFFAPAPPPPASLVNGLPKKRVAVIGAGLTGVSAAAHCVGHGFDVQIFEARSKAKGLGGIWSRVNSTSSLQIHSIMYRFHPSVKYDNAYPTQGEIREQIVDVWKRYGLQKHTAFETPVTSVKQAKDGKWIINDDEEKYGRFDGVVASVGVCGDPKMPPLPDQEQFKGNIYHSSELDGKDVEGKKVLIIGGGASAIEALEFAVQSKAAEIDVLSRSDKWIIPRNVLVQSLLALNIFGMETSFSWIPEWFLHKFFYRDLQDIAPSGGLFTTTPMANSELFDKIREGKARWLRGDIVSVKENGILFNRRARKVPKGGPGHESVVTGDVIIMATGFKRPSLSFLPDDAFEEPYTPPSWYLQVFPPKYPEICANNSTYVDAIGTVGNMHIGIYTRFLLMFLTDPLTQPTEGRMKTWIDFTRFVKQHSPTNAFDFFTYSELIYWFVFVILVNPFRWKWAPFVLFGVGRALPMGVVRQEESFRKQLKQQR

SEQ ID NO: 20392 - protein, 306 aa, Sporothrix schenckii
MDGKRQLNSFQQLEKLGEGTYATVFKGRNRHTGEFVALKEIHLDSEEGTPSTAIREISLMKELKHENIVALHDVIHTESKLMLVFEYMDGDLKKYMDTNGERGALKPMLIKSFMYQLLKGIDFCHQNRVLHRDLKPQNLLINGKGQLKLGDFGLARAFGIPVNTFSNEVVTLWYRAPDVLLGSRTYNTSIDIWSVGCIMAEMYTGRPLFPGTTNEDQMLRIFRIMGTPAEHNWPGISQFPEYKATAPRYATQDLRQILPQIDATGIDLLQRLLQLRPELRISAHDALQHPWFHDILQYQHCQQAAG

SEQ ID NO: 20393 - protein, 624 aa, Xanthobacter autotrophicus Py2
MLDEASTSSLKVTTGALPHSHKVFVSATRPDVRVAMREITLSTPEERPVRVYDTSGPYTDPQAVIDLTKGLPLLRAQWIRERGDVEEVDGRQVKPEDNGLKDGQSSTLPQFDLTGRRPLRAKAGKRPTQMAYARAGIITAEMEYVAARENLARANGGVHPHHQAMGLGAVIPSDITPEFVRQEVARGRAIIPNNINHPETEPMAIGRNFLVKINANIGNSAVTSGVAEEVDKLVWATRWGADTVMDLSTGKNIHTIREWIMRNSPVPIGTVPMYQALEKVNGVAEDLTWEIFRDTVIEQAEQGVDYMTVHAGVRLPYIPLTANRVTGIVSRGGSIMAKWCLAHHKESFLYENFEELCEILAQYDVAFSLGDGLRPGSIADANDAAQFAELETLGELTEIAWKYDCQVMIEGPGHVPLHLIRENVEKQLKVCHEAPFYTLGPLVTDISPGYDHISSAIGAAMIGWFGTAMLCYVTPKEHLGLPDRDDVKAGVISYKIAAHAADLAKGHPAARIRDDALSRARFSFRWRDQFALSLDPETAERFHDETLPAEGAKVAHFCSMCGPKFCSMKISQELKLEAGDIARAQADNLASAGMAEMAQKFREGGGLIYTPAPEVAEPPPAAAE

SEQ ID NO: 20394 - protein, 509 aa, Zea mays
TQDRQANEARVLTTTIPCCNDAIANPDEGRMVGHYWLRDPALAPNSFLRNKIETALDRILAFSQDVVSGKILSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVQNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 20395 - protein, 122 aa, Idiomarina loihiensis L2TR
MAEETIFTKIINRDIPADIIYEDDKALAFKDINPQAPFHCLIIPKQPIATANDINEDNAGLVGHLYVVAAKLAAEHNFSQDGYRLVMNCNEYGGQTVYHIHLHMLAGKQMGWPPYTDKKKEA

SEQ ID NO: 20396 - protein, 411 aa, Anaplasma platys
MKENAVLMCGDKKVSLPMLSGTDGIQLIDITTLYRDHKVLTYDPGFMSTAACSSEITFIDGEKGILRHRGLDIADLIGIKGGFCSVAHLLLYGVLPSDTVFEQFLAAIGAQHALSSDVLGVISSFRRDAHPMAILMACFSTLAAKYHGDNRGNEELAVLAIAQVPSLVAAIYRHRMGLELVSPDPSLSYTGNFVKMMFGALEKTRADAIEEALDAIFIMHADHEQNASTATVRMAGSAGTELFACLAAGTATLWGPAHGGANEAVIRMLESIGSPDKVEEFIGFVKDNNSKVRLMGFGHRVYKSYDPRAKILGQISRSVLDNLGCSDELLGVAEELERCALQDEYFVERKLYPNVDFYSGIVLRAMGVPVEMYTTFFALARTAGWVSQWCELLRGSESLKICRPRQLYAGK

SEQ ID NO: 20397 - protein, 219 aa, Haemophilus ducreyi 35000HP
MTQQEMKKIAAQAALQFVKPDTIIGVGSGSTVNCFIDALASIKDEIKGAVAASKASEDQLRAMGIEVFNANEVAGLDVYIDGADEITPQGAMIKGGGAALTREKIVSSLAKQFICMVDSSKQVDVLGSSFPLPVEVIPMARSYVARQLVALGGSPEYREGVVTDNGNVILDVHNFNIYEPLKMEHTINNIAGVVTNGIFAQRYANIIIVGTAEGAKIIK

SEQ ID NO: 20398 - protein, 140 aa, Brassica napus
MSHSAASSGKRRIRDLLTQSDNRVCADCGAPDPKWASANIGVFICLKCCGVHRSLGTHVSKVLSVTLDEWSDEEVDSMIEIGGNASANSIYEAFIPDGSSKPGPDASHDHRMRFIRSKYEFQEFLKPSLRITSGKTSSTK

SEQ ID NO: 20399 - protein, 204 aa, Oryza sativa (japonica cultivar-group)
MEFVAHAAAPDSPHSDSGGGGGGMATGATSASAAGASPSRYESQKRRDWNTFGQYLRNHRPPLSLARCSGAHVLEFLRYLDQFGKTKVHAPACPFFGHPAPPAPCPCPLRQAWGSLDALVGRLRAAYEENGGRPENNPFGARAVRLYLREVREHQARARGVSYEKKKRKKPPHPSSAAAAHDDAANGALHHHHHMPPPPPGAAA

SEQ ID NO: 20400 - protein, 720 aa, Deinococcus radiodurans R1
MPYKSLTLRPGSPFPLGATWDGKGTNFALYSENATGVELCLFDAEGHETRFPLTEQTAFVWHGYLPGIQPGQRYGYRVHGEYAPEKGLRFNPNVVLLDPYAKALDGTEQFDRGVFGYVAGGEDDSQMQEEEQRGAPLGLVVDPMFNWVGDQKPGIPFHQSVIYEAHVKGLTMTHPDVPEELRGTYAGVATPAILDYLRDLGITAIEFLPVHQHVDDPFLLDKGLTNYWGYSTLNFFAPDVRYSAEARKGNPSGAVPEFKNMVRALHDAGIEVILDVVYNHTAEGNHMGPTMSFKGIDNPTYYRLVADDQRFYFDYTGTGNSLNVRHPQTLQLIMDSLRYWVTEMHVDGFRFDLASTLARGLHEVDQLSGFFTIIHQDPIISQVKLIAEPWDVGEGGYQVGNFPVNWAEWNGIYRDDMRSFWKGEGGLASEIGYRITGSSDLYEFNGRKPYASINFVTAHDGFTLRDSVTYEQKHNEANGEGNNDGHNHNITWNCGVEGPTDDPEINRLRGQQMRNFLATLLLGQGTPMILGGDEFGRTQGGNNNAYCQDNDISWYDWEKVDEELLAFTRKLIALRKAHPSLHRRKFFAGRNIRGEDVRDIVWLRFDGAEMSDEDWNNPQTQSLGMFLAGDGLADVDAEGKPLTDDHLLLLLSSSYVDLPFKMPDLGGCGEWDLLLDTSDDGAEEKVAAGGETTLRGRSVKLYRCQVPEKELEKLAEPAEA

SEQ ID NO: 20401 - protein, 507 aa, Pseudomonas sp. KIE171
MSGDYMVQATTNLVGAAYWRGRADEIQFEGRCLIDGKMVEAQSGYTFDCVSPVDGRVLTKVSAGGEADVNRAVAAARSAFRDRRWSGQSPVSRKRTLQAFAALIRLHRDELALLETLDMGKPISASRSVDVEAVASCFEWYAEAIDKLYEQIAPTAETDLALITREPLGVVGAIVPWNFPMLTAAWKTAPALACGNSVVLKPAEQSPLTAIRLAQLALEAGVPEGVFNVVPGLGGSAGRALACHMDVDGIFFTGSTATGRLLTEYAAKSNLKRVCLELGGKSPNIILASYGDIEKAAVASAESMFNNQGEVCIAPSRLIVERSIHKRVVEIVAEVAKRRQPGDPLDPTTRMGALVDANHADRVMGFIGRAKADGATLVAGGTRALTETGGSYVVPTVFDNVSNCMEIARDEVFGPVLSVIPVANVGEAVAVANDSPYGLGAGVWTDRLSDAHKISRELRAGVVYVNCYNDCDITTPFGGVKQSGNGRDKSLYALDEYTELKTTWIKL

SEQ ID NO: 20402 - protein, 265 aa, Pyrococcus horikoshii
MVLYFIGLGLYDERDITVKGLEIAKKCDYVFAEFYTSLMAGTTLGRIQKLIGKEIRVLSREDVELNFENIVLPLAKENDVAFLTPGDPLVATTHAELRIRAKRAGVESYVIHAPSIYSAVGITGMHIYKFGKSATVAYPEGNWFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLHIVEAEYLVEIAGAPREILRVNV

SEQ ID NO: 20403 - protein, 173 aa, Coccidioides immitis RS
MATQHSHSHSHAHDAGSHGHTHEVLDGPGSYLNREMPIVEGRDWNDRAFTIGIGGEDAEFLTQNKALSPERIRAIETGGCPHAAVREDISANLLALQQLQRKFGTDLLLIESGGDNLAANYSRELADFIIYVIDVAGGDKIPRKGGPGITGSDLLVVNKTDLAEARVEVHWSV

SEQ ID NO: 20404 - protein, 82 aa, Arachis hypogaea
MADTAMKGGTRCNDRCGCSVPCPGDSTCRCASGNEGGGGTQHLTCPCGEHCECNPCTCPKTVAAGAGCKCGPGCTCASCRRA

SEQ ID NO: 20405 - protein, 265 aa, Pyrococcus horikoshii
MVLYFIGLGLYDERDITVKGLEIAKKCDYVFAEFYTSLMAGTTLGRIQKLIGKEIRVLSREDVELNFENIVMPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLHIVEAEYLVEIAGAPREILRVNV

SEQ ID NO: 20406 - protein, 96 aa, Zea mays
  misc_feature (76)..(76): Xaa can be any naturally occurring amino acid
  misc_feature (82)..(83): Xaa can be any naturally occurring amino acid
  unsure (1)..(96): unsure at all Xaa locations
MPPSVDAMPAPGDAAGGGDVRMISSKELRSHASADDLWISISGDVYDVTPWLPHHPGGDLPLLTLAGQDATDAFAXYHPPSXXPLLRRFLVGRLSE

SEQ ID NO: 20407 - protein, 265 aa, Pyrococcus horikoshii
MVLYFIGLGLYDERDITVKGLEIAKKCDYVFAEFYTSLMAGTTLGRIQKLIGKEIRVLSREDVELNFENIVLPLAKENDVAFLTPGDPLVATTHAELRIRMKRAGVESYVIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLHIVEAEYLVEIAGAPREILRVNV

SEQ ID NO: 20408 - protein, 294 aa, Alteromonadales bacterium TW-7
MINNFNLDDYALWTALVTPFDQQGNVDYDTLTTLVSEQEAAHNGILLLGSTGEGLALTLKEQQAIVEHVCQLKPSVPLMVAVGGSNLAQQKEWVSYCNQLPIHSYLLGSPLYAKPGAVGQTLWYESLLNESAHPCMLYNVPGRSGVSIPIETIENLKAHPKLWALKEASGNITQFEAYRQAAPNLALYSGDDALMPYFAQAGAKGLVSVAANAWPKQTHEFVKRSLSGQHPNLFAQWTRAINSLFAVANPIPVKVLMHQQGRLSSPLLRPPLTHLELTQTDCITTANDTILSWH

SEQ ID NO: 20409 - protein, 401 aa, Alteromonadales bacterium TW-7
MSFLSTPIKTAVNKLTQQLDTPFFVYDLDKLNAHLTRLVAQTDVKLWYAVKANPLSKVIQSLDSAGFNFDVASKGELEQVLAQGISSQRVLNTGPAKSPKQIKYFIERGVRIFVAESLNQVRWLNQQAQLQNTQLQVLLRVQLRWPEGEKNPLGGDSLTPFGLGCDEWQALNTGDYPALNFDGLHIFQWGNMLSTQKLSELWSQMIAPLTTLANNLNINLKILDLGGGLGIPYTQNETILEWDGLIAALAKIKKEACVDELWMELGRYAVGECGHYANPVIECKQNYGQQQVILTGGINHLLRPAVTSQDFPAALLRESTAPEQAMSLYGPLCTALDCLGEHTLPSDLKEQDWLVFSQCGAYGFTESMPYFLCHELAAEYVLQNGELTCVRQAEDASHYLR

SEQ ID NO: 20410 - protein, 425 aa, Pisum sativum
MWMGKEDEEMRGEIEERLINEEYKIWKKNSPFLYDLVITHALEWPSLTVEWLPDRQEPPGKDYSLQKLILGTHTSENEPNYLMLAQVQLPLDDSENDARHYEDDRPEVGGFGCANGKVQIIQQINHDGEVNRARYMPQNNFIIATKTISAEVYVFDYSKHPSKPPLDGSCNPDLRLRGHNTEGYGLSWSTFKQGHLLSGSDDAQICLWDINGTPKNKSLDAMQIFKVHEGVVEDVAWHLRHEYLFGSVGDDQYLLIWDLRTPSVTKPVQSCIAHSSEVNCLAFNPFNEWVVATGSTDKTVKLWDLRKIISPLHTFDSHKEEVFQVGWNPKNETILASCCLGRRLMVWDLSRIDEEQSAEDAEDGPPELLFIHGGHTSKISDFSWNPCEDWVVASVAEDNILQIWQMAENIYHDEDDMPEQSVKAP

SEQ ID NO: 20411 - protein, 574 aa, Oryza sativa (japonica cultivar-group)
MVKGAHKMGEMSDLWREAQCLETVICTVLSNLEIVLIEIDNGVQPSAYHYIVSKKVTQGEEGEDDAAAMGEEKQNDERKNKYAVGCSIIGSIISVLMGYDTGVMSGAMLFIKEDLKTNDTQVQVLAGILNVCALVGSLTAGRVSDCVGRRLTISLAACIFLVGSVLMGLAPNFATLLAGRCVAGVGVGYALMIAPVYAAEIASADIRGSLTSLPEICISFGILIGYVANYLLAKLPLVYGWRAMLGLGALPSAALALGVLAMPESPRWLVVQGRAEEALSVLRRVCDRPSEADARLAEIKAAAGLADDDGAAANAGSGGKGVWRELFLHPTPPVRRIVIAALGIHFFQHLTGIEAVVLYSPRIFKAAGIASRNSVLAATIGVGVTKTAFILTAILLVDRIGRRPLYLSSLAGIIASLACLGMGLTVIERSPPHHSPAWAVVLAIATVFTFVASFSIGVGPITWAYSSEVYPLRLRAQGASVGVAINRVMNAGVSMTFVSLYKAITIGGAFFLFAGLAVAAATFFYLLCPETQGKPLEEIEEVFSQGWRARRRASAAAVEMPASGGGGGGGAPMA

SEQ ID NO: 20412 - protein, 184 aa, Corynebacterium diphtheriae NCTC 13129
MTVPLYADAREAIACKTRFVPDFPVPGVIFEDLTPVLADAAAFSLIVDELAKNAMRLGADFIGGLDARGFLLGSAVAYKAGTGILAIRKKGKLPPPVHSEEYSLEYGTAALELPAEGLELEDKKVVLVDDVLATGGTLDAARKLIEACGATVSGYAVVLEVDGLGGRERLNDAPLVVINESATA

SEQ ID NO: 20413 - protein, 793 aa, Aspergillus oryzae
MVLSAVSRKFSRATEDPLDTPSPVTDNDSDRISNVDKKLASVDERSSSDEEHVKKPSETYAIEQETEEDPEIAALPREVRQLVSLTDDPTLPTITFRYFLLSIIFIVPGAFLSQMSHFRTTQAPYSIFFVQIATHYVGNFFARVFPAWEIRVPFTKWSFNLNPAPWSAKEHVLVTLTAASGATYNLGYTPIALAELFYGEKLNPAVAIFFMFAIVWVGYAFAAIARQLLLYDPTYVWPQALMQTTLFETFRKQDVSSPLARRQLKIFFLSLVGMTLWQFLPEYVFPFTSSLAFLCWVAPHNPVANFIGSGLGGMGFLNLTFDWSNINWNGSSILLTPWWTQVILFLAYVVSCWVLLPAAKWGNLGSYKHGLMSNSLFMANGTKYPVLDVLTPDFRLNQTAYEEHGLMYMGLHNAWATFFDYAKVTAAVTWIATFGFYQVKSNLKKAIASRRKSEKAKGQNINYQYHDRLNVLQRQYKEVPLWWYVALFMAGFIILLVATACGYLWIPVWTLFVGLATAGVFVLPFGWLYAISNYQLAVGTFNEMLYGYMVHTKAGASHRHPCGPSTYGAIAGDAWYRAQYMLQDQKIGHYMHIPPRTVFFSQIFGTVLGIPVNYGVIRWVLNTKGNILKGVEKDPLNQWTGQSIIGSNTLGVQYAVIGPQKMFENPELRILPYSFLVGAVIPPILYILHRCFPRLRVDLWNVTIFFSGLSVFYGNISTGYTSAIIGGYVVMYWAYRRRFETWKRYSYMVAAAFDAGFNLNMLLIFLFFGSGKQIKMPNWWGNNADSVERCFAL

SEQ ID NO: 20414 - protein, 768 aa, Yarrowia lipolytica CLIB122
MSGNNSPINAQLFPDARDVTKDALQTFVELPECTYMKGLGSSQQAEVMACDCKPGPTACDEDSGCINRLTSIECVRCCKGCQNKRFQGKKYASVDVISTEKKGFGLRATKDIAAGEFVYEYVGEVIDEPTFKERTAIYTTQGVKHFYFMMLQKGEFIDATAKGGLGRFCNHSCAPNGHVEKWVVGKRLRMGIFASRHIQRGEEVTFDYNVDRYGAEAQACYCGEKNCVGFLGGKTQTESASKVSGTLTAALGLTSRDINAILRGKKSAEDLRPRDLTVQDVSKVMASLMMNQEAWQVNLMLQRIALCTDTSVQAAVMKMHGYQIFAQILTATWGDNPLGLDDSDRVNVTLMLLRVLQKWPRITKNKISSSQIENVVKSLTSNDNSDIATIAQELLSEWANLKMAFRIPRRKIDPDGDEHSVSRGTSEEVTKESSKSEEPNDVEVVKVNKKADNNGNGVTDSPSTRSESPFTFIPTPYSNKTAPKGPKKAVKQPASPMVPPRSLPKGWQFANDPQGKVYYYNLELNIQQWDFPKASRASSPSTPKGPKGPKGPRGNRRDERRDNSETREPLSLQSQRESDLQRIIEQARLQEVKNNSEPAPSASAKPVNAQAHRLTKLLAKVVPNQVSKYDVDRERAKKCSKDIVQILVDKELKRPEPMTEISDEKAKKIKEFVKGYMGKVVKRLEEKEGGAKDFGRGRQGNRRDSERQSDRRGRQGQSDRDHSDNHGRKRKGEENQPYEAGPMYDDESAETSTETVKKPKVDMEIDLE

SEQ ID NO: 20415 - protein, 496 aa, Triticum monococcum
MARKMLKDGEAPLVADDGGTYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAEAKNDLLVYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 20416 - protein, 347 aa, Prochlorococcus marinus str. NATL1A
MNLLAGDLGGTKTILAIYSNENYPKKIFERYYISSEWKSFYSLFEDFIKHLPDHISLPQYGSIGVAGPIQNQEVKITNLGWDIESKKLSLLSKINNIELINDFSVLIYGIPFFNRNQYEVIQGTLNSDYKNDQKLIAIIGAGTGLGMSRGLITPKSISIFPSEGGHREFSPRTENEWALVKWLKKKLNIQRISIERIVSGTGLGMIARWKLDDPINESHPLQVILKNMDSDKSDSTDLPALVWEKAKNGDKLMTEALQLWLNAYGSAAGDLALQELCSSGLWISGGTAAKNLDGINSSNFLNAFSNKGRFQSYLKEIPLIVLKDPEATLFSSACRARLSAESNGRLS

SEQ ID NO: 20417 - protein, 522 aa, Xanthobacter autotrophicus Py2
MASFPRTGEIAAQVKAVLERLGVSPERLSGPNAARSPLTGEVVAHWGALSGAAADLAEANPGADPTEAAIGRAHAAFLQWRSVPAPRRGELVRLLGEELRAAKVDLAALVTLEAGKIASEGAGEVQEMIDICDFATGLSRQLHGLTIVTERPDHRMMETWHPMGVVGVISAFNFPVAVWSWNAALALVCGNAVVWKPSEKTPLTALAVDAIFSRATARFGGVPEGLSTLLLGGREAGEALVDDPRVPVVSATGSTAMGRAVAPRIARRFGRAILELGGNNAAIVCPSADLDLTLRAVAFAAMGTAGQRCTSLRRLFVHESVYDALVPRLHQAYGSVPVGDPRELGTLVGPLIDENAYTAMQSALEDARAAGGLVSGGERLGAEDALDAYYVRPALVEMPFQADCVAAETFAPILYVIRYSNLDEAIGLNNAVPQGLASSIFTTDLREAERFLSATGSDCGIANVNIGPSGAEIGGAFGGEKETGGGREAGSDSWKAYMRRATNTINYGSTLPLAQGVTFEVG

SEQ ID NO: 20418 - protein, 616 aa, Rhodospirillum rubrum ATCC 11170
MCGLVAILERRGPADEAAVSKALARLARRGPDGEGRAAFWDGRLLLGHRRLAIFGKGADGAQPMVDPETGSVLVFNGALYNYVELRQALQALGQRFAGESDTEVALLAWRQWGEAAFARFNGMWAMVLLDAPGDRLVVSRDRLGVKPLYLCDTGGRVTFASTIAATLAASGIAPRVDDDAVFDFLVGGLTDHRGGSFFAGIVEVPAGALWSVDRSGGIDRRRFHDWRKEGSGEAAPPSAEALRATLSDAVRLRLRADVPAVALLSGGLDSSIVTRLATAPDMPRGALAGLLTYGYRDATEADETREAGRFAATLDSALPHDILRVAPLPAAPDLDALLAAQEQPFNTPSLVAAFRLYRLIAARGVKVAITGEGADELFAGYTNRYGALLAREHLRLGRLRPLGALLGSAHCPPRLVANRLAWDLPLAIVRPLMAGRVHGRVIARSFWQDSAERFEALAAYHHQPLASRLRDDALRALLPYSLRFADRSGMASGVEVRSPFLDYRVVEAALALPVAAKIDDRGGKRILRQAFRHDLPAEIIGAGKTHGLGMAEQFQVGHLDWAALAEAPPTLAARYLDLGRLKTALAAHPSDPRLWWPLCLLRWLAWVEGGMADAPR

SEQ ID NO: 20419 - protein, 665 aa, Chlamydophila caviae GPIC
MVNREVDVDILEKISGTLKQLSIEIIQKAGSGHPGLPLGCAELAAYLYSYVLRHNPKDPLWIDRDRFVLSAGHGSALLYACLHLAGYDVSLEDLQQFRQLHSRTPGHPEFGETEGVEATTGPLGQGVGNAVGMALSMKMLQVRFNRPEHEIFNGKVYCLAGDGCMMEGVSHEVCSLAGTLGLDNLVVIYDYNNIVLDGFLGEVSSEDVKKRFESYGWEVYEIDGYDFSSIHETFVKIKQSQQRPVLIVAHTIIGHGSPKEGSHKAHGSPLGEDGVEQTKRFWHLPEEKFFISPAVKSFFSHKLQEDRKVQEEWQNDFRVWSRQFPDLHQEFLSLKAPISSETLETILESVEMPEVIAGRAASNKIIQNLAKNIPSLIGGSADLSSSDGTWIAEAKEINSQDFSGRNIKYGVREFGMGAIMNGLAYSQVFRPFGGTFLVFSDYLRNAIRLAALAKLPVIYQFTHDSIFVGEDGPTHQPIEQIMSLRAIPGLQVIRPGDANEVKGAWHAALRHLGPTALILSRQNLPTLAQTDRPFKEGVGRGAYIVLKETEGKPDYTLFATGSELHLALAVAQELIYLDKKVRVISFPCWELFEQQDFEYRESVVGGDLGLRVSIEAGSALGWYKYIGLDGLAIAMDRFGYSGAPADVAEACGFTADCILQRILSQ

SEQ ID NO: 20420 - protein, 265 aa, Pyrococcus horikoshii
MVLYFIGLGLYDERDITVKGLEIAKKCDYVFAEFYTSLMAGTTLGRIQKLIGKEIRVLSREDVELNFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLMIVEAEYLVEIAGAPREILRVNV

SEQ ID NO: 20421 - protein, 1073 aa, Kluyveromyces lactis NRRL Y-1140
MSDSLFDVFGETPNEDFELPPEALEESENEKSVVKNSGTKRSNGDDAEQLQNSDISSSKKVKMGITLIEDKKNKSVVIPVVADAFEREASREVEASAGLGNTQTVQLESDGKVKLRHQVRHQVALPPNYDYKPIGDHVRTNEARTYPFTLDPFQDTAISCIDRMESVLVSAHTSAGKTVVAEYAIAQSLREKQRVIYTSPIKALSNQKYRELLAEFGDVGLMTGDITINPDAGCLVMTTEILRSMLYRGSEVMREVAWVIFDEVHYMRDKERGVVWEETIILLPDKVHYVFLSATIPNAMEFAEWICRIHSQPCHIVYTDFRPTPLQHYLFPAHGDGIHLVVDEKGTFREENFQKAMASISNQTGDDVHTINGRGKKGQSYKGGAAKGDAKGDIYKIVRMIWKKKYNPVIVFSFSKRDCEELALKMSKLDFNSEEEKEALTKIFKNAIDLLPESDRELPQIKHILPLLRRGIGIHHSGLLPILKEVIEILFQEGFLKVLFATETFSIGLNMPAKTVVFTSVRKWDGQQFRWVSGGEYIQMSGRAGRRGLDDRGIVIMMIDEKMEPQVAKGMVKGQADRLDSAFHLGYNMILNLMRVEGISPEFMLENSFFQFQNAISVPVMEKKVAELTSVLESIKVDDEPAVKEYYEIRKTLDGYNEDVRTIITHPANSLAFLQPGRLINVKIDNKYDYGWAAVVDFVKRTNKRNPTAVYSDEESYIVNVVVNTMYADSPINLIKPFNPTFPEGIRPAEQGEKSTCTIIPITLSSIQSIGNIRLYMPNDIKAESQQATVGKTLREALRRFPDGVPIVDPVKNMKIDDDDFLKLLKKIEVLEGRLYSNPLTNTVRLRELYEKYSNKVAIEADIKNLKHKINEAQAVIQLDDLRRRKRVLRRLGFCTQSDIIELKGRVACEISSGDELLLTELIFNGNFNELSPAQAAALLSCFAFQERCKEAPRLKPELAEPLKAMREVAGKIAKIIKDSKIELVEKEYVESFRHELMEVVYEWCQGASFTQICKMTDVYEGSLIRMFKRLEEMIKELIDVSKTIGNATLKEKMEAALNLIHRDIVSAGSLYL

SEQ ID NO: 20422 - protein, 426 aa, Cryptococcus neoformans var. neoformans B-3501A
MPLHNPIWEVIEPHLVRHNLYTVKDPTYGRYLLPHHPPHLELVNDPAVSHNYRRVFLRPFNSFRSYHEAYDTTQIIHAENISLIPEELDSGVKRGGRWVAYSTWEMHEPPEGGWEGGGRGKGKDLVLVHGLGDYGLRYAPHIKFFLKAGFRVIIPDLPSYGRSTGINSYLPSLLLLTAAVHVVLTDVVLNDLSQGREQRKVFLNGSSMGGWTVLYYLLKYPPTAQPEKVASQGQKPDIAPPEEGSGQGYDQLERSRRDEKVRIHVAGAFVLCPMIEVSKESRPNILLEYLGRGVNSFAGSLPLAKAVRGNVSDDPRVEEDFFADPLCYHGMLRVGTGLACLEGMTELQERAEEVNVPIRLVHGNKDRATSHKGTLRLFDRLPNEDKEIEIYDGYEHVMLKLGVDAMDDEKRQRVLADWRSWLVQRC

SEQ ID NO: 20423 - protein, 292 aa, Arabidopsis thaliana
MAGIDTQKQLLSLIRDFTSERSRGEQRVVGLKKRIEILQSEVEAANSEVEKAKRIKEVAEEELNGYEVELSLNDATIQSLEARISLLQDEVTTIGSEVDALKNKEGLLRDQFISQMEELNKEIREFQKTVDSSLSSDDGIGITANVKASEDGSGADLEAIKGMLSEVNSQLAKEEEGYLAEQKIQEQLQKELDDYEKKMSLMEAITDKTNSVQVLTRYPLILLADIGFTWGGAAKEMPMPTLRGGKFGSPELTSSGRSRYGGVLVKSRSHLWLLGKRLIYSGLKMDLRNILV

SEQ ID NO: 20424 - protein, 452 aa, Medicago sativa subsp. x varia
MKEVAPGTQDQKQPLRANSKRALSDVTYLPHKKRAILQDVTNNCGVNTKRSCLNPTEIQAKKRKVAKPAQPHVSNEVPSAAELPPFIADSKPVSSMEMRLRSSEDFRCLDDLEDNAPFRMSSNQCGTNNNLLQSQTSRISARPLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLSLTVYLIDWFLSKNCIERERLQLLGITCMLIATKYEEINAPRIKDFCFIQDNTYTKEEVVKLESLVLKSSSYQLFAPTTKTFLRRFLRAAQASYKRPSIELEYLANYLAELTLMNYGFLNFLPSMVAASSVFLARWTLDQSSHPWNPTLEHYASYKASDLKATVLALQDLQLNSNDDCPLTTIRKKYTQDKLNCVAALSSPKLLETLF

SEQ ID NO: 20425 - protein, 560 aa, delta proteobacterium MLMS-1
MKLANAQQMRQADRLAMESWGIAGLVLMENAGRLAAELIARRFGSPAGREIVLVAGPGNNGGDALVAARYLHLAGARPWVLLLVEPERLTGDAAANLVPLRALAVPLSVAADEQALAALEPRLRQSWLAVDGIFGTGLSRPPEGRFLAAIQLLNRFPGPVLALDAPSGVNGDDGSILGEAVGAAATITFALAKPGLVLSPGREAAGELEVADIGIPPEIHRQLDIRLELLEAPRLAPWLPRRRRADHKGDSGHLLLLAGSLGKTGAALLAARGALRGGVGLLSAGVPLPLLHIFATALPELMTIPLPASDRAAAMADLELIRTSLADKTAVVLGPGLGTRPETVDLVRTLYRELPQPLVVDADALNILAMRPQALGEAAGPRLLTPHPGEMARLLNLSSGEVQEQRLQLAAALACQYQVWVVLKGADTVVAAPDGRLALNPTGNPGMATGGMGDVLAGLLGALLCQGLEPWRAACLGVYLHGLAADLQAAEYGINFGFTASEVAEAIPAAGCRLLAEAGQGKHKNRKRSPGPMSADLTGRKRSAVPHITASSQAPRTPCT

SEQ ID NO: 20426 - protein, 149 aa, delta proteobacterium MLMS-1
MKSAREIMTREVVSVKPEMPVEELAALLWEKRISGVPVVDDDGKLVGVATESDLIDQAKKFHIPTAITILEAVIFLDRGKKVEKEVSKMAGSRVRDICTSEPVTVGPETPLDELATIMAEKHLHTLPVLEDGQLVGVIGKADIIRTLST

SEQ ID NO: 20427 - protein, 441 aa, Chlamydia muridarum Nigg
MTGKRTKEEQINRQRSHFYRDNVGVIVLCGGEGKRLSPLTCWRCKPTVSFGGRYKLIDVPISHAIASGFSKIFVIGQYLTYTLQQHLFKTYFYHGVMQDQIHLLVPERRDGSQVWYQGTADAIRQNLLYLSDSPVEYFLILSGDQLYNMDFRSIVDYAIDVQADMVIAAQPVSDKDVSRFGVLRVDDEWKLVDFYEKPQSEEILKHFRLSNAAMKKFGLDPQQGNFLGSMGIYLFRKECLFQLLLDETGDDFGKELIHRQMHRGKTVAYLYNGYWTDIGTIASYYEANMALTQRPSQNVRGFNCYDDGGMIYSKNNHLPGAIISDSKISSSLLCEGAMIESGQVSNSVIGVRGVIGQGSIFDHSIMMGSDSYVSGSVPFGVGKNCEIHKTIIDENCCIGNGVRLQNLQGHKDYDSPDGKLVVRDGIIIVPKGTKIPDNYVF

SEQ ID NO: 20428 - protein, 893 aa, Moorella thermoacetica
  misc_feature (358)..(358): Xaa can be any naturally occurring amino acid
  unsure (1)..(893): unsure at all Xaa locations
MVNLTIDGQRVTAPEGMTILEVARENGIHIPTLCHHPKLRPLGYCRLCLVDIEGAAKPMTACNTPVAEGMVIRTSTPVIEEMRKGIIEMLLSLHPEDCLTCEKAGNCQLQDCAYTYGVKHGELPVKREELPVLKENPFIVRDYNKCIVCGRCVRACQEVQVQRVVDLVGKGSAARVGATKAGAEVSLEEGGCVFCGNCVQVCPVGALTEKAGLGQGREWEFKKVRSICSYCGVGCNLTLYVKDGKVVKVRGYENPEVNNGWLCVKGRFGFDYIHNPDRITRPLIREGDREKGYFREASWEEALALVSQKLTQIKGSYGSEALGFLCSAKCTNEENYLLQKLARGVLGTNNVDHCARLXHSSTVAGLATTFGSGAMTNSIADIASADCIFVIGSNTTENHPVIALKVKEAVRRGARLIVADPRRIELVNFSYLWLRQKPGTDLALLNGLLHVIIKEELYDKEFIAQRTEGFEALKLAVEEYTPAKVSEVTGVPAGDIIEAARTYARGPSSTILYAMGITQHITGTANVMALANLAMACGQVGKEGNGVNPLRGQSNVQGACDMGGLPNVLPGYQPVTDPGVRHKFSETWGVPDLPGEPGLTLMEMMAAAQEGKLKGMYILGENPVLTDPDVSHVKEALKNLEFLVVQDIFLTETARMADVVLPGASFAEKEGTFTSTERRVQLLHKAIEPPGEARPDWLILNDLLLLMGYPRKYSSPGEIMQEIAGLTPSYAGITYERLEDKGLQWPVLSLEHPGTPVLHREKFSRGYGQFQVVHYRPPAEEPDEEYPFLFTTGRNLYHYHTVISRKSRGLEEMCPAPVVEINDNDAARLGIREGEMIEIVSRRGKVRVKALVTDRIPRGQVFMNFHFHEAAANLLTIAALDPVAKIPIIKPVL

SEQ ID NO: 20429 - protein, 427 aa, Bacillus licheniformis ATCC 14580
MLNHPIQKKSNVRWVVAFMMWAAIAINYIDRTVLSAAAPYITEEFNLTPGQMGIIMSGFFWSYALLQLPSGWAADKYGQKKTLGFAVVWWSVATALTGLATGFKSLLGLRVALGVGEAAAYPSNAGIAAKWFPKKERATVAGIFDSGSKFGGAVAMPLIAWMIAVFDWKLTFLLIGLVGVAWGIVWMIFFKENPADHKRVNEAELAHIREGQAHMEETGGGQPLKWYQLFKYRNIWAMCIGFFMINYNSYFFITWLPTYLVKERGMDLIEMGIMASLPLLTAMVVEVGAGWMSDRIYAKGKLSLTAVRKLFLIIGLVMASCIGFAAFADSAILAVILLCVAKSGTTVAASQVWALPGDVAPKNMTSMVAGIQNTVSNMGGVVGPIITGFIVGATGSFVPALLFSAALIIIAILNYLFLLGKVKQIQV

SEQ ID NO: 20430 - protein, 500 aa, Medicago truncatula
MHNTDTATMNDQLSNQTSIFGLRLYVILGIIVGVIIVLLLFFISIYLAFKHNNSKKTKTTIPNISKDVPEITLDVPPQPDPSPQPDPPSEQSHPEEETAPLSYKRIQFEIGKNHRISYPEQRGSVEHSGERESRPLDQVNAVIPQVSHLGWGHWYTLRELEDATNEFSPDNVIGEGGYGIVYHGILKDNTNIAIKNLLNNRGQAEREFKVEVEAIGRVRHKNLVRLLGYCAEGAHRMLVYEFVDNGNLEQWLHGDVGPCSPLTWEIRMNIILGTAKGLTYLHEGLEPKVVHRDIKSSNILLSKQWNSKVSDFGLAKLLSPESSYITTRVMGTFGYVAPEYASTGMLNERSDVYSFGILIMEVITGRNPVEYSRPAEEVNLVEWLKKMVSNRNPEGVLDPKLPEKPTSRALKRALLVALRCTDPNAQKRPKMGHVIHMLEAEDSPYKEERRVRRDPGVGSSPTTSIEDRSKEEAAVSIDDGMLENEKCTNETSSNHEVEKQ

SEQ ID NO: 20431 - protein, 449 aa, Sorghum bicolor
MGGVLGALLHRRSGGRPPAQGTRNRHLGLTRQPSTYDATAAAAGGHRKAMLSKKYSYIPDTYTSLDQVAAALREQGLESSNLILGIDFTKSNEWTGKQSFGGQSLHRISDDAPNPYEQAISIIGKTLAPFDEDNLIPCFGFGDATTHDNNVFSFHRDNTPCHGFEEVLACYRTVVPHLRLSGPTSFAPIVEAAVDIVDRSGGQYHVLVIVADGQVTRSVDTGDGDLSPQEKRTVDSIVMASSYPLSIVLVGVGDGPWDDMRRFDDKLPARDFDNFQFVNFTSIMSRAATAQQKESAFALAALMEVPIQYKATMELGILGRSTGNAKRVSPAPPPLPNAQRQSSLRRGASNVGAAAAPRDDQVCPICLTNAKDLAFGCGHMVRTDSDISIFHDLITNAMQLQPIETKEKKNLICILIFLCIFVHASNRRAGSVGRASPDARFVDSRYDQS

SEQ ID NO: 20432 - protein, 253 aa, Prochlorococcus marinus str. MIT 9313
MPCRGGNQKETMTRWRRLGNVWGLWPAQPIALVEMVGGSYLAASPQLSYRRLLEGLADHNLAVHAWGYVPGFDHQAQANEAWKHLRRCRQQLEARVGALPTPLRLGHSLGCKLHLLAPDGGRNSRALVALSFNNFTADRSIPMLRELAPKLGFYTEFSPSPNETLRLIRESYHQPQNLLVSFGNDSLDQSPSLLNSLQQRVEDATQSLHLPGDHLTPASAGLRQNLLGDWADDSARAETLNQLVETISSWASP

SEQ ID NO: 20433 - protein, 506 aa, Vibrio vulnificus CMCP6
MIYAQPGSDNAVVNFKSHYDNYIGGEWVKPVSGEYFDNISPVNGQAYCKVARSSAADINLALDAAHSVRYQWAKTSVTERANILLKIADRIEAHLEELAVAETWENGKPVRETLAADLPLVVDHFRYFAGCIRAQEGSAAELDANTASYHFPEPIGVVGQIIPWNFPMLMAAWKLAPALAAGCCVVLKPAEQTPTSILVLMEKIGDLIPAGVVNVVNGFGAEAGQALATSDRIAKLAFTGSTEVGNHILKCAAESLIPSTVELGGKSPNIYFPDVFDHEDAYLDKCIEGTLLAFFNQGEVCTCPSRVLVHESIYDQFIAKVAERAKSIKQGNPLDTDTQVGAQASQEQFDKILSYLEIGRQEGAKVVFGGEIAKQEDDLASGYYIQPTLLQGHNKMRVFQEEIFGPVIAVTTFKDEAEALAIANDTEYGLGAGVWTRDQNLAYRMGRNIEAGRIWINCYHAYPAHAAFGGYKKSGIGRETHKMMLNHYQNTKNLLISYDVNPLGFF

SEQ ID NO: 20434 - protein, 352 aa, Oryza sativa (indica cultivar-group)
MGGLSMDQAFVQAPEHRPKASVAEADGIPVIDLSPLLAAGDGDADGVDALAAEVGRASRDWGFFVVVRHGVPAEAVARAAEAQRAFFALPQERRAAVARSEAAPMGYYASEHTKNVRDWKEVFDLVPRQTPPPPTTAVADGDLVFDNKWPDDLPGFREAMEEYGEAVEELAFKLLELIARSLGLRPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 20435 - protein, 323 aa, Prochlorococcus marinus str. MIT 9313
MATVTELLQPVELDLETLLTDLRSLIGAGHPILQAAAEHLFSAGGKRLRPGIVLLISRALSADGDLSARHRRLAEITEMIHTASLVHDDVVDEAATRRGVATVHSRFNHRVAVLAGDFLFAQASWHLANLDNLAVVKLLSRVIMDLADGEVKQGLYRYDTGQSFATYLEKSYCKTASLMANSVQAAGVLSGESVEHQKLLHHFGRQLGLAFQVVDDILDFTGSEQQLGKPAASDLASGYLTAPALYALEEHLALARLIEREFSEEDDLDQALELVRNSQAISRSRQLAEDFARESREAIAWLPDSPCQRALMELPDFVLSRLY

SEQ ID NO: 20436 - protein, 123 aa, Oryza sativa (japonica cultivar-group)
METDINAPPPPAPAPAGAGEGSSSAAGPSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 20437 - protein, 393 aa, Xanthobacter autotrophicus Py2
MAAAPLPRSIALSRRSAVEPFIVMDVMEHAARIEAGGGHVIHLEVGQPAAPAPTVARRAAAAALEAGQVGYTAALGIPALRARIARHYGEIHGVAVDPERVVVTHGSSGGFVLAFLALFEPGDRVAIAAPGYPPYRHVLHALGCEPVLIETRAEDRHALTPERLLEAHRKAPLKGVLVASPANPTGTMMDRAALTALHACARDLNLAFISDEIYHGLDYAFPAVSAVEIGEDVTVINSFSKYFCMTGWRVGWMVVPPGVSRTMERLQQNLSISVPTLSQIAADAAFEGRAEMDLVKATYVENRRILTEGLPQAGLKRFLPADGAFYLYADVSEFTDDSAAFARRMLDAAHVATTPGVDFDPFHGHQFLRISYAGSAPDMAEAVARIGAFLKRG

SEQ ID NO: 20438 - protein, 160 aa, Neisseria meningitidis
MPEGAEQDILKGMYLLKAGGKGDKKVQLMGSGTILQEVIAGAELLKADFGVEADIWSCPSFNLLHRDAVEVERFNRLHPLEAEKVPFVTSQLQGHDGPVIAATDYIRSYADRIRAYIPNDYHVLGTDGFGRSDSRANLRRFFEVDRYNVAVAALSALAEQ

SEQ ID NO: 20439 - protein, 160 aa, Neisseria meningitidis
MPEGVEQDILKGMYLLKAGGKGDKKVQLMGSGTILQEVIAGADLLKADFGVEADIWSCPSFNLLHRDAVEVERFNRLHPLEAEKVPFVTSQLQGHDGPVIAATDYIRSYADRIRAYIPNEYHVLGTDGFGRSDSRANLRRFFEVDRYNVAVAALAALAEQ

SEQ ID NO: 20440 - protein, 449 aa, Oryza sativa (indica cultivar-group)
MERVLKDDAVEEKGERARMAAFIGAMAIADLVKTTLGPKGMDKILQSTGRGRSVTVTNDGATILKSLHIDNPAAKVLVDISKVQDDEVGDGTTSVVVLAGELLREAEKLVNMKIHPMTIIAGYRMAVECARNALLERTMDNKENIDKFRSDLMNIAMTTLSSKILSQDKEYFAELAVDAVLRLKGSTNLEAIQILKKPGGSLKDSFLDEGQLIYNFPEELFADAGILAIEHADFEGIERLALVTGGDIASTFDNPESVKLGHCNVIEEIMIGEDKLIHFSGVAMGQACTIVLRGASEHVLDEAERSLHDALCVLSQTVNDTRVLFGGGWPEMVMAKAVDDLARKTPGKKSHAIDAFSRALQAIPTIIADNAGLDSAELISQLRAEHHKENCTAGIDVITGSVGDMQKRGISEAFKVKQAILLSATEAAEMILRVDEIITCAPRRREDRM

SEQ ID NO: 20441 - protein, 573 aa, Haemophilus ducreyi 35000HP
MITGIAASPGAVFGKALVLKEEPIVLNTKKITADQIEIEKEKFFAGRAKAAAQLTAIKEKARHTLGEEKEAIFEGHLMILEDEELEEEILEFITNNLVTADFATHKIIEMQATMLAEIDDEYLKERATDLRDIGNRLLRNILNMYIVDLGDIQEEVILVAYDLTPSETAQLNLDKVLGFVTDIGGRTSHTSIMARSLELPAIVGTNNITEQVKTGDILILDAINNQIKINPSVDEISAFKAIQAKVEAEKAELVQLKDLAAETLDGHKIEVAGNIGTIRDIGGVLRNGGESIGLYRTEFLFMDRCELPDEEEQFEAYKEIVEAMQGKQVILRTMDIGGDKELPYLNLPKEMNPFLGWRAIRIGLTRREILDTQLRAVLRASAFGKLAVMFPMIISVEEIRELKAIVAELKAQLRAEGKAFDEHLQLGIMVETPSAAVNARHLAKEVDFFSIGTNDLTQYTLAVDRGNEIIAHLYNPLSPSVLNLIKQVIDASHAEGKWTGMCGELAGDVRATALLLGMGLDEFSMSAISVPHVKKLARSIHYTDAKALADEALAQPTVADVERLVNAFYAKLN

SEQ ID NO: 20442 - protein, 187 aa, Chlamydomonas reinhardtii
MQRSILSALLPRLPLGVREFATASADYSIAMKKAAEITGAAESAMGPKEGGFTAGVPLDTFTRKARIYAPARTASQSGLARTVDFATTTPAWKIEFEPTAKWQNPLMGWTSSADPLENVGRSALVFYTKEEAMRFCEKLGWEYEVTEPNKRRTQRTKRYMQYGDNFGTKRAGVPDLSTLPSNRAAAK

SEQ ID NO: 20443 - protein, 683 aa, Medicago truncatula
MKNFFVSLYFLFPTIFTIILVLLTPIPSAQLTNSETRILLQLQTLLEYPQEYPQLLQNNLTNFCNISSSPSFNIVCTKNHVTELTIIGNKTRPVSWKSRKTLSERFSIDSFFTVVTKLSKMKVLSLVSLGLWGPLPSKISRFKSLEVFNISSNFLYGKIPSSVSSMKSLKSLVLADNFFNGSVPNLKRLTSLEEINLANNKLGPGFPSFLFSLPLIQKLNLASNQFNGSFSMNISCGSSLTFVDISNNSLEGKLPSCIDSTLSLNRTIVYSGNCLSARNVSDQHSSSHCKNSTVLAAKPRFEKPKKSMMQLGVLFGIIGGFVGIVGLLILLFLFILRKSKAEREDRSVDISRESRLNIYARSNVPQLMRLTTLGLPPYNIFTIEEIGDATNNFDPSNLIGEGSQGELFKGWLKDGSMVMVNLVKVKQKSLIKVSDQNLKVLPYLRHRHLVSVLGHCAITYEDQPKMTSTIFIVFEHISNMSLRIHLTDKRQREMLKWQQRMAIIIGIARGIQFLHTGVNPGIYGNNIKIENILLDNNLNPKVSGYSIPLIPSKKGSDRKLKEQNAHNHIGSINSAEKEDIYQFGVILLEVITGKLITSSIEVEVLKYELERGLSEVASPIALKSAIDPSLHGTYTHESLKTAVQLTINCLNKVPGNRPSIEDVIWNLQYSVQVQEARSSKTST

SEQ ID NO: 20444 - protein, 188 aa, Candida glabrata CBS 138
MSEKAIRRKLVIIGDGACGKTSLLYVFTLGKFPEQYHPTVFENYVTDCRVDGIKVSLALWDTAGQEEYERLRPFSYSGADVILIAFSVDNVESLHNARTKWAEEAFRYCPDAPVILVGLKEDLRKSKQEGIVFVNREDAEQVAKAIGAKKYLECSALTGEGVDDVFELATRSSLLMHKEPDHFCCSIS

SEQ ID NO: 20445 - protein, 1075 aa, Haemophilus ducreyi 35000HP
MPKRTDINTILIIGAGPIIIGQACEFDYSGAQAVKALREEGYKVILVNSNPATIMTDPDMADVTYIEPIQWQTLEKIIEKERPDAILPTMGGQTALNCALALSKNGVLKKYGVELIGATEDAIDKAEDRGRFKDAMTKIGLNTPKSFICHSFEEAWQAQEQVGFPTLIRPSFTMGGSGGGIAYNRDEFQAICERGFEASPTHELLIEQSVLGWKEYEMEVVRDKADNCIIVCSIENFDPMGVHTGDSITVAPAQTLTDKEYQIMRNASLAVLREIGVDTGGSNVQFAINPANGEMIVIEMNPRVSRSSALASKATGFPIAKVAAKLAVGYTLNELRNDITGGLIPTSFEPTIDYVVTKVPRFAFEKFPQADDRLTTQMKSVGEVMAMGRTFQESLQKALRGLEIGICGFNLRSESPETIRRELANPGPNRILYVADAFGAGFSLEEVHHYSKIDPWFLIQIQDLVQEEMALEKRAFTELDYAELRRLKRKGFSDKRIAQLIKVSESDVRAKRYALNLHPVYKRVDTCAGEFKADTAYLYSTYEDECEAKPTTRQKVMILGGGPNRIGQGIEFDYCCVHAALALREAGFETIMVNCNPETVSTDFDTSDRLYFEPLTLEDVLEIIYKEQPWGVIVHYGGQTPLKLAHALEQNGVNIIGTSADSIDAAEDRARFQKILTDLGLKQPNNRTARNAEEAVKLAEEVGYPLVVRPSYVLGGRAMQIVYNVDELNNYMQEAVSVSNDSPILLDHFLKNAIEVDVDCICDSEQVLIGGIMQHVEQAGIHSGDSACSLPAYSLTNEVQGEIRRQTSAMAFALGVKGLMNVQFAVQNETIYVLEVNPRASRTVPFVSKATGNPLAKIAALVMAGKSLAEQNATTEIIPPYFSVKEAVFPFIKFPGVDTTLSPEMRSTGEVMGTGQSFAEAYYKAQLGAGERIPSTGKVFLSIADEDKPQIIRVAQYLQAEGYGLCATIGTAQYLRENGVGVQIINKVREGRPNIVDSIKNNEIAMIINTVNNLPESIKEAQEIRRNALKLHIPTYTTLAAAEAISEAVRHINKYDVNALQQLHLSSALANQITR

SEQ ID NO: 20446 - protein, 555 aa, Cryptococcus neoformans var. neoformans B-3501A
MISVPGGPGVLSAPLSPERVEAPVTVKAYLLCVFASFGGIFFGFDSGYMNGVLGMNYFINMMTGLPIPGADADQATKDAFTLPAWEKSLITSILSAGTFFGAIIAGDLADYFGRRITIVSGCCVFIVGCCLQTASTGLGLLVAGRLIAGFGVGFISAIIILYMSEIAPRKVRGAIVSGYQFCITIGLLLSSCVCYATQNRTDSGSYRIPIAIQFAWALILGGGLLLLPESPRWYVKAGKIEQARKALSRVRGQPVDSDYIKDEIAEIVANHEYETELTPNVTYLSSWAACFTGGIRNPGSNLRRTLLGISMQMMQQWTGVNFIFYFGTTFFTDLGTISNPFLISLITTLVNVCSTPVSFWTIERFGRRPLLIYGALGMLICEFIVGIIGVAKPGDTTVVKVQISFICIYVFFFASTWGPGAWVSIGEIFPLPIRARGVGLSTASNWLWNCIIAVITPYLVGTDEANLGSKVFFLWGSTCILCFIYAYLFVWETKGLTLEQVDRMMEECGSPRRSAGWKPHTTFAAEAAQGTHGLDQNEKAKVGPVLSQSEMLEQV

SEQ ID NO: 20447 - protein, 111 aa, Agrobacterium tumefaciens str. C58
MSGIHDIIDSEVKSNDIVLFLKGTPQFPQCGFSGQVVQILDYLGVEYKGVNVLADADIRQGIKDYSNWPTIPQLYIKGEFVGGCDIVKEMFQSGELQSHFQEQGISVRGAA

SEQ ID NO: 20448 - protein, 468 aa, Alteromonadales bacterium TW-7
MSQSVLDFIKENDVKFIDLRFTDTKGKEQHVSIPHHQVDEDFFEDGKMFDGSSIAGWKGINESDMVLMPVAESVKLDPFTEETTLIVRCDVVEPSTLQGYERDPRSVAKRAEDYMRSTGIADTVLFGPEPEFFLFDDVKYKSDMSGSMYKVDAVEAAWNSDKDYEGGNTGHRPGVKGGYFPCSPVDSSQDWRSATCLVLEELGQVVEAHHHEVATAGQNEIATRFNSMVLKADEIQEMKYVIHNMAHLYGKTATFMPKPIVGDNGSGMHCHQSLAKDGVNLFAGDKYGGLSEEALYYIGGIIKHAKAINAFANASTNSYKRLVPGFEAPVMLAYSARNRSASIRIPVVPSAKGRRIEVRFPDPTANPYLAFSAMLMAGLDGIKNKIHPGDAMDKDLYDLPAEEAAEIPQVASSLGEALDALSADREFLTQGGVFTDDLIDAYIALKGQEVEKLNMTTHPVEFEMYYSC

SEQ ID NO: 20449 - protein, 82 aa, Arachis hypogaea
MADKAMKGGARCNDRCGCSIPCPGDSTCRCASGSEGGGETQHLTCPCGEHCECNPCTCPKTFAAGAGCKCGPGCSCASCRRA

SEQ ID NO: 20450 - protein, 365 aa, Oryza sativa (japonica cultivar-group)
MAPPLGGQPGWWNGSLPHTNSFGPVSSDCGMDIHPPGGFLSMLQTGQQPLVPPHVLFLATWPPMPPMAPTTNSGTTHARSRSKAKPVINLDDGDDVRTAKRLTWASDEDLRLVSAWLYHSNDPINGNGKKNESYWGDVVELYNSTTPINRKREVKHLKDRWQRIKRWVGFFCASWKKAALVYTSGYSDDQLRDFANQFYVDDYPNEGPFTVLHCWKVLRDEPKWHAVLEELEKPHKRSLDDGSDTLSQKDIGEKERPIGRNEAKKQRNGKGKGKGKDDDDSLREDMKKYMDVQAAASKRHEEFLGTQHRISDAKVEVARLRREAVLTESYQKMMSMDTSQMTDEMKAEHVMGLKMLREKLLGDII

SEQ ID NO: 20451 - protein, 337 aa, Glycine max
RIFLCDKRLDWKKGKVNPFMSSIRARLRPRPMPLNIFPDMEGLPRIILTEATGSSAEVLLYGGQVVSWKNERKEELLFMSSKANWKQSKANRGGISVCFPQFGNLGSLEQHGSARNRLWSLDRDPSPLPPSDNQSSVDLIIKSTGVDLKNRPCSFEFRLRISLSAGKLILIPRVRNTDNKTLSFTLSISNYLSVSDISEVRVEGLETLDYLDNLLNRSRFTEQADAITFDGQMDRLYLRTPTKIAVIDHEKKRTFVLQKNAMPDAVIWNPGYRKAKALPDLGDADYKFMICVDSAAIETPLMLKPYEEWKGYQELSNVSSSYCSGQLDPSKVLYGFH

SEQ ID NO: 20452 - protein, 694 aa, Glycine max
EGACMVCKGLPGQEERLLCVTCDTPWHVPCLFAPPPTLSATARWLCPDCSILDSDVPPVPAPARNQLVAAMLAVENDASLTQHDKARKRQELLTGKAPADDDDDDEQENKSSLSDILSRSLNCSICIQLPERPVTSPCGHSFCLKCFEKWVRQGKRNCAKCRQIIPAKMTSQPRINSALVFAIRMARQASNSSGSGRGGVRSVNHFLHNQDRPDEPFTTERAQRSGRANAASGKIFVTVPTDHFGPITAENDPLRNQGLLVGESWRDRLECRQWGAHFVPVGGIAGQSDRGAQSVVLSGGYVDDEDHGEWFLYTGSGGKDLSGNKRTNKSHSFDQKFEKYNRALQVSCLQGYPVRVVRSHKEKRSSYAPETGVRYDGIYRIEKCWQIAGLQGFKVCRYLFVRCDNEPAPWTSDDHGDRPRPLPVIRELKKATVIHERTESPSWDFDEEDSRWKWKKPPPPSRQKVQNVEPVEVARAKSNKEVKKFQLKSIKEQLQRGFSCMICKEVMVSPVTTPCAHNFCKSCLEGEFAGQAFVKERSKGGRTLRSQKNVMKCPSCSIDISDYLQNIQVDIDLKSAIESLKAKVEEIGESVESSEDADGLQDDGAGKDEDTDSRNKNSVQELNGLPEGSDVGELEDTTNKEPDPAMKCNGKRKKGDYGNQSPDDKMEKRGKNYKTTEEELHEENDSSSSPLHPQ

SEQ ID NO: 20453 - protein, 565 aa, Shewanella sp. MR-7
MSEQKLALNEYLKTDSDYLRGTIKEGLDSSVTGSFSDGDQQLIKFHGFYQQDDRDLRNERKEQKLEPLYSFMLRARVPGGVCTPKQWLGVDEIASTLTSSNSIRLTTRQTFQYHGIPKRNLKTIIQGLDREALDSIAACGDVNRNVMCNPNPVESKLHAQAYEVAKKLSDHLLPHTRAYAEIWLDEEKLLTTEDETVEPVYGKTYLPRKFKMAVAVPPDNDVDVYTNDLGFIAVAENGELVGFNLTAGGGMGSTHGEVETFPRLADDFGFIKTEDVMKFAEAVMTVQRDWGNRTNRKRSRLKYTIVDHGYEKFKAEVEARAGVKFEPKRDVVIGDRGDRYGWVEGVDGKWHLTLFIESGRIKDVPGKSLQTGMREIAKIHKGDFRMTSNQNMIIAGVAPEDKATIEGLARKHGLLGQVLTQTRGHSIACVALPTCPLAMAEAERYFPEFIDHIDALQAKNGISDQAIVVRMTGCPNGCARPFAAEIGLVGKAPGRYNLYLGANFEGTRLNKMYRENIQEAEILAELDALFARYAVERNAGETFGNFTVRTGVVKAVIDAAKDFHG

SEQ ID NO: 20454 - protein, 531 aa, Sorghum bicolor
MERGNNGGSGRPPSPPPTPVERKAAWAWRDGAVTYFHLLFYIAISGGQIFFNKASHAAPHLPTSRSPARSPPGLRPSSPDPPRPWVLSSKEINFPYPVALTLLHMVFSSVVCFAITKVFKYLPELVIFFLLYRSKFICVHAMLVRTHGFIRSLYISSVIPIGAMFAMTLWLGNSAYLYISVAFAQMLKAIMPVAVFLLGAAFGLEEMSYKMLSIMSVISVGVIVASVGEITISWVGVVYQMGGVVAEALRLIFIEIFLKKKGVKLNLISMMYYVSPCSAVCLFIPWLFLEKPKMDDSISWNFPPFTLFLNCLCTFILNMSVFLVISRTSALTARVTGVVRDWSVVLLSAAIFADTQLTFINIIGYAIAIAGVVAYNNHKLKVKPQANPQQDVYAASHDSQPKVPKRILKSSRMEEPDCPEGSVSDRGGERQTASLPLPDAFLEFLSENGLDPAVYSMAATIPRYIRELDLVFFLIPRLKPGMESQITEIESELKCVLEKVSWLPGFYAIPPEIQIAGSKAYQQGKARGIHI

SEQ ID NO: 20455 - protein, 542 aa, Zea mays
NSGGKCDFDLAATFFCSVVYLVVGGDMQFALALDTNSGPHQIRSCEGDGIDRLEKLSIGGRKQEKALRNRCFGGRVAATQQCILTSDCAPETLHSQTQSSRKNYADNARVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVPIGIGRNTKIRNCIIDMNARIGKNVVITNSKGIQEADHPEEGYYIRSGIVVILKNATINECLVI

SEQ ID NO: 20456 - protein, 655 aa, Sorghum bicolor
MARRVRPSHLILALAAAYLLLISLKFRRVLDLAAADLAAGDPAAAAASAFSSPSSSDHLPSPTFVSSSDDDATSPFPVRPFWHRYDRVSLPDLASRNRSALDRMADDAWALGLTAWEDAAAFAGDPWALLAAATSRASDSAKCPSAVSQRARGRVVFLPCGLAAGSSVTVVGTPRAAHREYVPQLARMRQGDGTVMVSQFVVELQGLRAVDGEDPPRILHLNPRLRGDWSQHPILEHNTCYRMQWGAAQRCDGTPPGDNDDKVDGFPKCEKWIRNDIVDTKESKTTSWLKRFIGRAKKPAITWPFPFVEERLFVLTIQAGVEGFHIYVGGRHVTSFPYRPSRHLGAPGDYFQGFTLEDATGLFVKGDVDVHSVYATALPMSHPSFSLRQVLEMSEKWRSRPLPKGPVSLFIGILSASNHFAERMAVRKTWMQTPEIKSSEAVARFFVALNSRKEVNVMLKKEAEYFGDIVILPFIDRYELVVLKTIAICEYGVQNLTAANIMKCDDDTFVRVDMVLRHIKLNNNGDKPLYMGNLNLLHRPLRTGKWAVTGEEWPEDIYPPYANGPGYVISGDIAKFIVSQHANQSLRLFKMEDVSMGLWVEKFNATKPVQYSHSWNFCQYGCVFNYYTAHYQSPRQMLCLWDKLIRGQPSCCNYR

SEQ ID NO: 20457 - protein, 254 aa, Medicago truncatula
MTGTTRPSHHQIFDIEWEIISQSDSDDDGRLKRTAVIGSGVLSLAWAIAQLGWVAGPAVMILFSLVTAYTYCYRTGDPDSGKRKYTYMDAVRSILGGAKVTFCGIFQYLNLFGIVIGYTIAASISMTAIKKSNCFHQHGDKSPCHMSSNLYMIMFGVIQIFLSQIPDFDQIWWLSSVAAFMSFTYSLIGLALGIAKVAALAGIGIGAVSDTQKIWRISQALGNIAFAYSYAVVLLEIQDTLKSPPSEVKSMKKR

SEQ ID NO: 20458 - protein, 103 aa, Zea mays
  misc_feature (22)..(22): Xaa can be any naturally occurring amino acid
  unsure (1)..(103): unsure at all Xaa locations
MSGRGKGGKGLGKGGAKRHRKXLRDNIQGITKPAIRRLARRGGVKRISGLIYEETRGVLKIFLENVIRDAVTYTEHARRKTVTAMDVVYALKRQGRTLYGFGG

SEQ ID NO: 20459 - protein, 160 aa, Neisseria meningitidis
MPEGAEQDILKGMYLLKAGGKGDKKVQLMGSGTILQEVIAGAELLKADFGVEADIWSCPSFNLLHRDAIETERFNRLHPLEAEKVPFVTSQLQGHDGPVIAATDYIRSYADRIRAYIPNDYHVLGTDGFGRSDSRANLRRFFEVDRYNVAVAALAALAEQ

SEQ ID NO: 20460 - protein, 160 aa, Neisseria meningitidis
MPEGAEQDILKGMYLLKAGGKGDKKVQLMGSGTILQEVIAGAELLKADFGVEADIWSCPSFNLLHRDAIEAERFNRLNPLETAKVPFVTSQLQGHDGPVIAATDYIRSYADRIRAYIPNDYHVLGTDGFGRSDSRANLRRFFEVDRYNVAVAALSALAEQ

SEQ ID NO: 20461 - protein, 323 aa, Prochlorococcus marinus str. NATL1A
MTTATEILQPVELDLEALLLDLRSLIGAGHPILQAAAEHLFSAGGKRLRPGIVLLISRALTSEKELPLKHRKLAQITEMIHTASLVHDDVVDEADTRRGVETVHSRFDPRIAVLAGDFLFAQASWHLANLENLEVVKLLSRVIMDLAEGEIKQGLNRFDSSQSFESYLEKSYCKTASLIANSSKAIGVLSDVDQESLNSLYFFGRQLGLAFQVVDDILDFTGNDEQLGKPAASDLQSGYLTAPVFYALEENPRLSELINGKFSQKDDLDQALSLVRDSSAIKKSRELAEQFASESKDSISWLPDSPSKTALLELPEFVISRLY

SEQ ID NO: 20462 - protein, 90 aa, Oryza
MARIRARGSSRVDLARFAVTEHNKKANSLLEFEKLVSVKQQVVAGTLYYFTIEVKEGDAKKLYEAKVWEKPWMDFKELQEFKPVDASANA

SEQ ID NO: 20463 - protein, 244 aa, Prochlorococcus marinus str. NATL1A
MSTFRRISDVSCQWPSRPVGLIELIGGSYISIKPEVTYKRLISCLLKRNFAVHSWGYIPNFDHQLQANQAWKQFRQSRKILEKRVGLIPKSIRLGHSLGCKLHLLAPDGGRNCDGLVAISFNNFRADKSIPLLRKMSKKLDFQTEFSPSPSETLNLVREHYEQINNLLIKFKNDNLDQNDFLLKSLKERSADKSKIINLDGNHLTPVSAGLREKLLKANLQNSLKYENINLIVDQITHWEILTS

SEQ ID NO: 20464 - protein, 705 aa, Arabidopsis thaliana
MTENGVVTGGGHTVMVGVKFDESSNELLDWALVKVAEPGDTVIALHVLGNEIVDRADNSSLVSIVKNFDSVLEVYEGFCKLKQLELKLKLSRGSSTRKILVKEAKMCSASKVVVGISRRFHTIHSSVSVAKYLARKVAKDCWVLAVDNGKVMFQKDGSSSIIHHSKGKSDARRNTLSSFFQMPVTLRKNTKVVNHSEVEEEEAEEDHSNGQSLRRSLVYACLGNCSVRDMNSLPTPGNLSRSSSCNGDQDDNADLHKAMALVPAKFPEDLTPFITMLVKELPEFRPGWPLLCRVASSDVLASAPRSSSFRKIPVVQWVLKLPARTNSVVGSSDTKQIGFDSSESEENDKLSSSNVERQAIVPDESMIVKCSLDHSSGRFPENVEGLQARISTSCQFFTYKELVSVTSNFCAGYCFENNNLLLVYNYLSRGSLEENLHGLRLRLGNKKDLVAFRWNERYKVAVGIAEALDYLHNDAPQPVIHRDVKSSNILLSDDFEPQLSDFGLAKWASESTTQIICSDVAGTFGYLAPEYFMYGKMNNKIDVYAYGVVLLELLSGRKPVNSESPKAQDSLVMWAKPILDDKEYSQLLDSSLQDDNNSDQMEKMALAATLCIRHNPQTRPTMGMVLELLKGDVEMLKWAKLQVSNPLEDSMLLKDEKLRRSNLQSHLNLAFLDMEDDSLSMGSMEQGISVEEYLKGRTSRSSSFN

SEQ ID NO: 20465 - protein, 946 aa, Xanthobacter autotrophicus Py2
MSLVHEIDYGTPASKSEKLVSLTIDGMSVTVPEGTSIMRAAMELGNQIPKLCATDMLESFGSCRLCLIEIEGRNGTPASCTTPVAEGIVVKTQTERLKQIRKGVMELYISDHPLDCLTCSANGDCELQDMAGVVGLRDVRYGYEGENHTKLGKDESNPYFTYEQSKCIVCNRCVRACEEVQGTFALTISGRGFGSRVSPGMDEPFLTSECVSCGACVQACPTATLNEKAMYDIGTPEHSVVTTCAYCGVGCTFKAEMRGDELVRMVPYKDGKANRGHSCVKGRFAYGYATHQDRILKPMIRSSIHEPWKEVTYEEAIAYAASEFKRIQEKYGKRAVGGITSSRCTNEETYLVQKLIRGGFGNNNVDTCARVCHSPTGYGLSQTYGTSAGTQDFDSVEETDVVLIIGANPTDGHPVFGSRLKKRLREGAKLIVVDPRRTDIVRSPHIEAAYHLPLKPGTNVAIVTALAHVVVTEGLVNEQFVRERCDWDEFQDWAAFVADERHSPEAVEKYTGVDPALVRGAARLYATGGNGSIYYGLGVTEHSQGSTTVMAIANLAMATGNVGRNGVGVNPLRGQNNVQGSCDMGSFPHELPGYRHVSDDATRSTFEALWGVPLDDEPGLRIPNMFDAAVDGTFKGLYVQGEDILQSDPDTKHVSAGLAGLECLIVQDLFLNETANYAHVFLPGCSFLEKDGTFTNAERRIQRIRKVMAPKNGYADWEVTQLLANALGFPMNYTHPSQIMDEIAALTPTFAGVNYAKLDELGSVQWPCNDSAPEGTPIMHIGGFVRGKGKFVLTEYVPTDEKTGPRFPLLLTTGRILSQYNVGAQTRRTANVAWHPEDVLEIHAHDAENRGIRDGDFVKLDSRAGSTSLRAVISDRVAPGVVYTTFHHPVTQANVVTTDYSDWATNCPEYKVTAVQVSPSNGPTQWQEDYENLSRTSRRIAAEAAE

SEQ ID NO: 20466 - protein, 142 aa, Arabidopsis thaliana
MFKTLDKNQDGLVTLDELLWILDKLGWAEHTPDELELIVGKQSLDLDEFLRFYYDAVLDSKGSKKNIDVVADNDEAIARAFNVFDVNGDGYISAEELRDVLERLGFEEEAKAWDCGRMIRVHDKNLDGFVDFEEFKNMILHV

SEQ ID NO: 20467 - protein, 227 aa, Chlamydophila caviae GPIC
MAFLILLRHGKSVWNEKNLFTGWVDIPLSQQGIDEAIHAGQVIKDLPIDCIFTSSLVRSLMTALLAMTHHSSKKIPYIIHDDEQQKLMSRIYSDEEKSMIPLYRSSALNERMYGELQGKNKKETAEEFGEEQVKLWRRSYKISPPGGESLYDTGLRTVPYFQETIFPLLKNSKNVFISAHGNSLRSLIMDIEKLSEEEVLSLELPTGKPIVYLWTGHTFERHPEPLG

SEQ ID NO: 20468 - protein, 444 aa, Kluyveromyces lactis NRRL Y-1140
MRRFGIRSVSNMTQQGKTGIRANKYFMGNVPKDVWTLTNEAAQAASKNEKNQGRSILNLGQGFFSYSPPKFAIEQAVSALNVPLNNQYSPTRGRPSLLKSLTDFYSPIYNETLNESNVTITTGANEGILASLVGLLNPGDEVIVFEPFFDQYISNIEIPGGKVRYVPLVAPKELSERVTIGAEWKIDFDILNKTINERTKCIILNTPHNPIGKVFTREELTQLGDICVKNNIYIISDEVYEHLYFGDEFTRIATISKEIGDLTLSVGSAGKSFAATGWRIGWVVSRNAELLSYVSKAHTRICFSSPSPFQEACAHSIDIGLHNGYFENMREEYKEKFAILTRVFDELGLPYTKPDGTYFVCVDFSKVQIPDEYPFPRELNERAKDFKLSYWLVNELGVVAIPPTEFYIKEHEKAAENLLRFAVCKDNQYLEESVERLRLLKDYL

SEQ ID NO: 20469 - protein, 565 aa, Alteromonadales bacterium TW-7
MSEQDKNVKLSDNERLKRESNFLRGTIEQDLKDEITGGFTADNFQLIRFHGMYQQDDRDIRPERAKQKLEPLHNVMLRARMPGGIIKPEQWLAIDKFADEKTSYGSIRLTTRQTFQFHGVLKPNIKGMHQMLNSVGIDSIATAGDVNRNVLCTTNPVESELHQEAYEWAAKISEHLLPKTKAYAEIWLNGEKAETTEEPILGSNYLPRKFKTTVTIPPNNEVDVHANDLNFVAIAEDGKLVGFNVLVGGGLAMTHGDTATYPRKADDFGFIALEDTLKIAEHVVSVQRDWGNRSNRKNAKTKYTLDRVGSDVFKAEVEKRAGVSFAPSRPYEFTHRGDRIGWVEGIDGKHHLTLFIQSGRILDYPDKPLKTGCRKIAEVHQGDMRMTANQNLIIAGVPADQKAVIEEIARNHGLIDDGDTEQRKNSMACVALPTCPLAMAEAERYLPSLIEKTEALLAKHGIPDDSIIMRVVGCPNGCGRAMLAEAGLVGKGPGKYNVYLGGNLEGTRIPKLYLENVGEDVYLEAFDKLIGQWASERSDGECFGDFVIRKGIVAEVKVSVTDFHA

SEQ ID NO: 20470 - protein, 221 aa, Brassica napus
MEDLRVNSQSSLSDVDDLSRLLDRPRLNIERKRSFDERSFSEMGIMDSGINSPGGRSGWETPASSTRNSFEPHPMVAEAWDALRRSLVHFRGQPVGTIAAYDHASEEVLNYDQVFVRDFVPSALAFLMNGEPEIVKNFLLMTIQIQGREKRIDRFKLGEGAMPASFKVIHDPIKKTDTVIADFGESAIGRVAPVDSSFWWIILLRAYTKSTGDLSLADTPE

SEQ ID NO: 20471 - protein, 154 aa, Aspergillus nidulans FGSC A4
MGRGSKSDNSGTIDRDEFLSLPQVSTNPLATRMIAIFDEDGGGDVDFQEFVSGLSAFSSKGNKEEKLRFAFKVYDIDRDGYISNGELFIVLKMMVGNNLKDVQLQQIVDKTIMEADKDHDGKISFEEFTDMVESTDVNLSMTLNADVIDSRPII

SEQ ID NO: 20472 - protein, 264 aa, Glycine max
PVPTLLCLNTIGYRAPPRVSYVGPPPLGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNALSETGGIPIGIGKNSHIRKAIIDKNARIGENVKIINFDNVQEAVRETEGYFIKSGIVTVIKDALIPSGTII

SEQ ID NO: 20473 - protein, 363 aa, Aspergillus nidulans FGSC A4
MIAIGLEGSANKLGVGIMLHPKDGSTPQVLANIRHTYVSPPGEGFLPKDTARHHRSWVVSLVKKALKEARISVDDVDCICYTKGPGMGAPLQSVAVAARTLSLLWGKELVGVNHCVGHIEMGRLITGASNPVVLYVSGGNTQVIAYSSQRYRIFGETLDIAVGNCLDRFARTLHISNDPAPGYNIEQLAKKGKQLVDLPYTVKGMDCSMSGILAAIDALAATYGLNGEQPDEEEDVTDVTPVSDGALESRKPTRADLCFSLQETVFSMLVEITERAMAHVGSKEVLIVGGVGCNERLQEMMGIMARDRGGSVHATDERFCIDNGIMIAQAGMLAYKTGFRTPLKESTCTQRFRTDDVFVQWRD

SEQ ID NO: 20474 - protein, 148 aa, Brassica napus
MQSPSTATQESAASSSFGFFTRLTCLASRNRSPRSNPDGYTLSTSNALFFNGSLTTLPARRRTRTALASMSLNAKSSAGSSLSRFIDEFNSFIRFHCEKVVPDSFASIGVSSHESGARGNDSGGVLGEEGLQLNGVQADRPKKVLILM

SEQ ID NO: 20475 - protein, 160 aa, Neisseria meningitidis
MPEGAEQDILKGMYLLKAGGKGDKKVQLMGSGTILQEVIAGADLLKADFGVEADIWSCPSFNLLHRDAIEAERFNRLNPLETAKVPFVTSQLQGHDGPVIAATDYIRSYADRIRAYIPNDYHVLGTDGFGRSDSRANLRRFFEVDRYNVAVAALSALAEQ

SEQ ID NO: 20476 - protein, 160 aa, Neisseria meningitidis
MPEGAEQDILKGMYLLKAGGKGDKKVQLMGSGTILQEVIAGAELLKADFGVEADIWSCPSFNLLHRDAVEAERFNRLNPLETAKVPFVTSQLQGHDGPVIAATDYIRSYADRIRAYIPNDYHVLGTDGFGRSDSRANLRRFFEVDRYNVAVAALSALAEQ

SEQ ID NO: 20477 - protein, 437 aa, Candida glabrata CBS 138
MAVSKVYARSVYDSRGNPTVEVELTTEKGVFRSIVPSGASTGIHEALEMRDGDKSKWLGKGVENAVKNVNDVIAPAFVKANVDIKDQKAVDDLLLSLDGTANKSKLGANAILGVSMAAARAAAAEKNVPLYQHLADLSDSKTSPFVLPVPFLNVLNGGSHAGGALALQEFMIAPTGAKSFREAMRIGSEVYHNLKSLTKKRYGSSAGNVGDEGGVAPDIQTAEEALDLIVDAIKAAGHEGKVKIGLDCASSEFFKDGKYDLDFKNPNSDASKWLSGPQLADLYHSLVKKYPIVSIEDPFAEDDWEAWSHFFKTAGVQIVADDLTVTNPKRIATAIEKKAADALLLKVNQIGSLSESIKAAQDSFAAGWGVMVSHRSGETEDTFIADLVVGLRTGQIKTGAPARSERLAKLNQLLRIEEELGDKAVYAGDNFHHGFKL

SEQ ID NO: 20478 - protein, 150 aa, Escherichia coli CFT073
MNSNRMLFHVPLPRRSDAGGCMKKIIETQRAPGAIGPYVQGVDLGSMVFTSGQIPVCPQTGEIPADVQDQARLSLENVKAIVVAAGLSVGDIIKMTVFITDLNDFATINEVYKQFFDEHQATYPTRSCVQVARLPKDVKLEIEAIAVRSA

SEQ ID NO: 20479 - protein, 160 aa, Neisseria meningitidis
MPEGAEQDILKGMYLLKAGGKGDKKVQLMGSGTILQEVIAGADLLKADFGVEADIWSCPSFNLLHRDAVEAERFNRLNPLETAKVPFVTSQLQGHDGPVIAATDYIRSYADRIRAYIPNDYHVLGTDGFGRSDSRANLRRFFEVDRYNVAVAALSALAEQ

SEQ ID NO: 20480 - protein, 160 aa, Neisseria meningitidis
MPEGAEQDILKGMYLLKAGGKGDKKVQLMGSGTILQEVIAGAELLKADFGVEADIWSCPSFNLLHRDAVEAERFNRLNPLETAKVPFVTSQLQGHDGPVIAATDYIRSYADRIRAYIPNDYHVLGTDGFGRSDSRANLRSFFEVDRYNVAVAALSALADQ

SEQ ID NO: 20481 - protein, 194 aa, Oryza sativa (japonica cultivar-group)
MATTSACCYRPLSAPPLHRRRGPPPQQQQLRTAVGGPRPRPSLQVAAAAATGGGQSVKAATDAEFFQTSDTRPIMLFDGVCNLCNGGVRFVQEHDPNRSIRYIPLQSESGRKLLQRSGRAPDDISSVVLVEKDRSYIKSEAVLRIMGYLNLPFPQLATFLNFVPLFLRDFAYDNVADNRYAVFGRSESESCEIL

SEQ ID NO: 20482 - protein, 564 aa, Oryza sativa
  misc_feature (83)..(83): Xaa can be any naturally occurring amino acid
  unsure (1)..(564): unsure at all Xaa locations
MSLWKHPAAAGDGEVVETVVELLARVRGMVPPALGAAGAAEGFPGRWKAIAAKLEGLPACLSDLSSHPCFAKNALCRELLQSXVAATLAEAAELAARCREPPAAGKLQMQSAIDALAGKLDLNLRDCALLVKTGVLSDAFTPPPPTDEATSTATAAQADVRELLARLQIGHTEAKSLAVDGLLEALNKDEKSVLSVLGRANVAALVQLLTAPATKVREKAATVICQLAESGGCEGLLVSEGALPPLIRLAESGSLLGREKAVITLQRLSMSSDTARAIAGHGGARPLIEMCQTGDSISQSAAAGALKNLSAVPEVRQALADEGIVRVMVGLLDCGTVLGSKEHAADCLQNLTSSSDSFRRAVVSDGGLRSLLVYLDGPLPQESAVSALRNLVSAVSPDSLVSLGVLPRLAHVLRVGSTGAQQAAAAAICRISTTTDMKRVVGEHGCVPLLVRMLDAKSNGAREVAAQAMASLVGYPPNAREVRRDGKSVPCLVQLLDPSPANTAKKYAIACLLSLAAAKRCKKLMISHGAIGYLKKLSDMDVAGAKKLLERLERGKLRSLFSRD

SEQ ID NO: 20483 - protein, 361 aa, Ashbya gossypii ATCC 10895
MVSAKQWVLKNEADPNHDFNFDMGTSGSTFEMLDVELSSEQVKEGQLLVQTQYLSNDPAQKFWICSGDKNYAAGVAIGEVIPARGIVKVLFSRNQNVKQDEYLAGPIGWRTHAVIEDVSVYSKVSLRAVGELWGHLSVLGSTALTAYFIFKEYLNVAQDESGHHKVFLISGAAGSVGSLCIQLALNVYKASKVIAVAGGAEKVKYVESFGQQVVGVDYKDPEFKKNLLAASGGANTVDYFIDNVGGDILDIGIDLLKVHAVITACGSISGYTDASKFVLKNSSRILTKRLVIKGMLVTDHANKFPEAIEQLASYVQSGEISLEKSATIRDATGDAFKDVPLIWRGLFQGINKGKLITKVSA

SEQ ID NO: 20484 - protein, 310 aa, Aspergillus nidulans FGSC A4
MDVFLDVLDTFFFDRLYALILPATNPVEDTVRESQKLYNQNIGRYVPLAPSPYVDASIWKRDDIVRQATSLFLIAWIFGLAMYLIGSMIVYHTMFDKRLMRHPHFLPNQIRLEIRQGVTAIPVIAILTAPFFLAEVRGWSKLYDFASEAPFPAYTWLQYPLFVCFTDFGIYWIHRWLHVPMVYRWLHKPHHKWIVPSPFASYAFHPVDGWSQSLPYHIFPLLFPLQKSAYLGLFVFVTLWTVLIHDAEYLTNSVVVNGPACHTMHHLYFNYNYGQFMTLWDRLCGTYRKPKEDGFLQKENLQAQSIKKHE

SEQ ID NO: 20485 - protein, 265 aa, Neisseria gonorrhoeae
MHALPRYAVFGNPAAHSKSPQIHQQFALQEGVDIEYGRICADIGGFAQAVSTFFETGGCGANVTVPFKQEAFHLADEHSDRALAAGAVNTLVWLEDGRIRGDNTDGIGLANDITQVKNIAIEGKTILLLGAGGAVRGVIPVLKEHRPARIVIANRTRAKAEELARLFGIEAVPMADVNGGFDIIINGTSGGLSGQLPAVSPKIFRDCRLAYDMVYGEAAKPFLDFARQSGAKKTADGLGMLVGQAAASYALWRGFKPDIRPVIEH

SEQ ID NO: 20486 - protein, 307 aa, Triticum aestivum
MADAKQQQQPPQTALAASGVWKTVKPFVNGGASGMLATCVIQPIDMVKVKIQLGEGSATSVTKKMLANEGVGSFYKGLSAGLLRQATYTTARLGSFRVLTNKAVEANEGKPLPLVQKAAIGLTAGAIGACFGSPADLALIRMQADSTLPAAQRRHYKNAFHALYRIIADEGVLALWKGAGPTVARAMSLNMGMLASYDQSVEVLRDKLGAGELSTMLGASAVSGFFASACSLPFDYVKTQVQKMQPDATGKYPYTGSLDCAMKTLKSGGPFKFYTGFPVYCVRIAPHVMMTWIFLNQIQKVEKRVGL

SEQ ID NO: 20487 - protein, 1055 aa, Idiomarina loihiensis L2TR
MFKASEVLSKQHQAEDLKSLQQAITDNYIVDEDEYMRELLPLVPADDDTVSAVTERAAKLVEQVREQADNGVVDAFLQEYSLDTKEGIILMCLAEALLRIPDAYTADALIQDKLSGGDWQKHMGQSASWLVNSGTWGLALTNSVTNPTGKAMETPRGAFRRLVRKLGKPIIRKATYTAMQIMGKQFVLGRTIEEALKESRDNRDKGYTHAYDMLGEAALTMKDADYYKQQYVNSIKTITKEEFNNPDAPRPTISIKLSALHPRYEASNHERVLTELATTLTELVKLAKEADVGVTIDAEEADRHELSMELFEKVYRSGVCKGWPRFGLVVQAYSKRALPTLCWITALAKECGDEIPVRLVKGAYWDNEIKWTQENGLLGYPVFTRKSHSDISYLACARYLLSDDTDGAIYPQFATHNAQTFMAIQQMNETHQRRIEYQRLHGMGDSLYDTIMEQNPGMVVRIYAPVGPHKDLLPYLVRRLLENGANSSFVHKLLDADTPVNDLVEHPMKTASGYEKYANSKIPLPSEMYGDRTNSLGLNMNIHSQADDFIAAVQQYRDKQWQGGPIVDGKTIETDHHVSITSPQETSKQVGSIYWGDKKLSEQALKSANAAYKSWRKVPTDERAECLEKFADLMEANRNELIALCSVEAGKGLQDGIDEVREAVDFCRYYANQARELMGGPIQLPGPTGEDNELFVEGRGTFICISPWNFPLAIFVGQVAAALVTGNSVIAKPAEQTGLIAYRAVQLALEAGIPGNVLHFMPGSGAEVGSYLTSQEDIGGVCFTGSTYTAQAINRALAARTGPIVPLVAETGGQNAMMVDSTALPEQVVTDIVASAFQSAGQRCSALRVLFVQDDVADRVLDLLRGAMEELQVGDPLLHETDVGPVIDGIAKTNLEQHISDIQQAGRLIARAPLPDYAMGGTFVAPTAIEIDSISQLVKENFGPILHVIRFKTSEIDEVIESINNTGFGLTFGIHSRNETFAHDVASRIDVGNVYINRNQIGAIVGVQPFGGRGMSGTGPKAGGPHYLTRFITEKTRSDNITAVGGNATLLSLDD

SEQ ID NO: 20488 - protein, 251 aa, Aspergillus nidulans FGSC A4
MLSASERNPAVMDPSRTKVSALDLNHSHSHTTTNQISSSSEQQASFMPSQCPQHIWVVTGPAGSGKSTVGRYLQQELGVPFLEGDDFHPAANKAKMSAGTPLTDADRWDWLISLRSAATTLLSTPAPTSTNPTSTSTRAQAPTGVVVACSALKKKYRDVMRVAAYGSPNVRIHFVYLKLEPATLYARVSARQAHYMKQGMVESQLRDLEEPGQGEWDVITVPVQVGMGMGEVQREVMNAVEKVIRGYEGGL

SEQ ID NO: 20489 - protein, 545 aa, Oceanobacter sp. RED65
MFGQMQDSPLLVSQLIDHAAKVHGHQQIVTKTVEGHWHEYTFKDAQKRSKQLAQALLKLGIKDGDVIGTLAWNTHRHYECWYGISGMGAILHTINPRLFPEQLIYIINHAEDQYLFLDTTFVPLVEALLEHIGKVKGFVIMTDEAHMPETKLPNVHCYESLINAEDGDYVWPELDERQATSICYTSGTTGNPKGVVYSHRSSLLHSWGIAGKEIAELDNNTRVLPIVPMFHANAWGLVYATAMMGAKVVLPGPHLDGASVCDMINRYDVNISAAVPTVWTMLMKHLEESGDKLPSLDSVLIGGSAVPRSMIQKFHQDYDVDVWQAWGMTEMSPLGSLNKPRPEDLKLSYEEQLDIKVKQGRPCFGVEMKIVDDQNNELPHDGKAFGRLLVRGPWIIKRYFKAQEDATDAEGWFDTGDVATIDASSNMQITDRSKDVIKSGGEWISSIDLENAAMGHDAVLEAAVIGLSHPKWEERPFMAVVAKDPSNPPNPDDIRTYLESKVAKWWLPNAIEFVEEIPHTATGKINKVALREQFKDYELPDSVQR

SEQ ID NO: 20490 - protein, 531 aa, Acidobacteria bacterium Ellin345
MATTLTSRVEVRVPTKFSNEPLTDFSREDNARKMRSAIEKVRGELGREYDLIIGGKRIKLAKKLQSVNPSNPTEVVGVFQEAGAAEVEPAMQAALKAFETWSRTSWEERANLLFRVANMLQERKFEFSAWMVFEVGKNWVEADADVAETIDFAYFYALEALRLSQAKTPIQLPGEVNTLKYIPLGVGAVIPPWNFPCAIMAGMTMASIVCGNTVVLKPSSDSPAIAAKFMELLEEAGLPDGVVNFCTGGGRSFGGNVVNHPKTRYIAFTGSKEVGLDIHEHAAKTQPGQVWIKRTILEMGGKDSIVVDADADFDAAVEGVAQAAFGFSGQKCSACSRAIVDERIYDRFIGALRERVAKITVGDTTKNPGMGPVINESSMKKILGYVEKAQQEGGRLILGGVRDEEAGPGYFIKPTIIADVAPNATISQEEIFGPVLAVMKCRDFEEGVKIANNTEFGLTGAVYTGTQDKLDYAAQEYFAGNLYLNRKCTGAMVGAHPFGGFNMSGTDSKAGGPDYLLLFTQAKSIAEKVIR

SEQ ID NO: 20491 - protein, 346 aa, Glycine max
MAEKEVRNKQLVLRDYVTGFPKESELYVTSNGTIKLKLEGDSKRVLVKNLFLAADPHLRPLMKKADNLSVLQSFTPGLPLYGYGVAKVVDSRHPDFEEGDFVWGITGWEEYTIISSFEHLFKIQHSDVPLSYYAGILGMPGLTAYSGFFEVCDPKKGEHVFVSAAAGGVGQLVGQYAKLMGCYVVGSAGSKEKVDMLKDKFGFDEAFNYKEEHDLEAALKRYFPQGIDIYFDLVGGKMLDAALVNMRVHGRIGVCGVISQLTLKEPEALKNAMCLVYKRVRMQGFNVVDYYHIYPKFLDLLLPQIREGKISCLEDIVEGLENGPHALIRVFSGHAIGKQVVSVANE

SEQ ID NO: 20492 - protein, 328 aa, Oryza sativa
MASDFKAIPLIDISPLVGKIDDPSMANDEDLLQVVRLLDDACREAGFFYVKGHGIADSLMKQVRDVTHKFFQLPYEEKLKIKMTPQSGYRGYQRLGENITNGKPDMQEAIDYYAPIEPGKYGDLAKPMEGTNLWPKYPSNFDALLKNYISLLRDLSRKIMQGIALALGGPVDAFEGRTAGDPFWVCRLIGYPVSTDIVEEHHTDIGCGAHTDYGLLTLVNQDDDICALEVKNQSGEWIYAKPIPGTFVCNIGDMLKVWSNGIYQPTLHRVVNNSPRYRVSVAFFYESNFDAAIEPVEFCRERTGGVAKYEKVVYGEHLIKKVLNNFIK

SEQ ID NO: 20493 - protein, 526 aa, Arabidopsis thaliana
MSFDELLRFVSEVQGERHAGLDYVQDIFHSVKHHNVFHHHGLVHLNAFYRYLFSDTNSPLPMSGQVHHDMKAPLSHYFVYTGHNSYLTGNQVNSRSSVEPIVQALRKGVKVIELDLWPNPSGNAAEVRHGRTLTSHEDLQKCLTAIKDNAFHVSDYPVIITLEDHLPPKLQAQVAKMLTKTYRGMLFRRVSESFKHFPSPEELKGKILISTKPPKEYLESKTVHTTRTPTVKETSWNRVANKILEEYKDMESEAVGYRDLIAIHAANCKDPSKDCLSDDPEKPIRVSMDEQWLDTMVRTRGTDLVRFTQRNLVRIYPKGTRVDSSNYDPHVGWTHGAQMVAFNMQGHGKQLWIMQGMFRGNGGCGYVKKPRILLDEHTLFDPCKRFPIKTTLKVKIYTGEGWDLDFHHTHFDQYSPPDFFVKIGIAGVPRDTVSYRTETAVDQWFPIWGNDEFLFQLSVPELALLWFKVQDYDNDTQNDFAGQTCLPLPELKSGVRAVRLHDRTGKAYKNTRLLVSFALDPPYTFR

SEQ ID NO: 20494 - protein, 1166 aa, Ashbya gossypii ATCC 10895
MDVPETRETNMEAVELGKTFEEVLPPLEGEETEYEGRFTWRIERWSELRGEKHYSPRVQVGRWEWDLLVFPHGNSTKGIAMYLAPHPVQAEADWYVCAQFAIVLSRPGDDARTQLVSRSQHRFNAVDKDWGFSNLIELEHLRFATRGRPSGFLSGDQLNVTVYVRVLRDPTGVLWHNFANYDSKKVTGYVGLKNQGATCYLNSLLQSYYFTKYFRKLVYQIPTEGETPANSVSLALQRAFFQLQRSSEPLDTCELTRSFGWDTGDAFTQHDVQELNRILMDRLENKMKGTEVEGKLNGLFVGKMKSYIKCVNVDYESSRVEDFWDIQLNVKGLKGLQQSFENYIEVEMMDGENQYAAQGHGLQDAKKGVLFESFPPVLHLQLKRFEYDFNYDQLIKINDRYEFPESIDLSPYLDPEVQEDSPANAKYNLHGVLVHTGDISTGHYYAMIKPGLEDAWYRFDDDKVWRVTKKQVFEQNFGFDKLSEYDLRSLTKEQYQNYLIARQTSAYMLVYIREDMESTILQEVTDADVPEYIVNTIEEELKERERFQKEREEMHLYAKVYVHSMKNFIHYQGYDLSPNERSKLYIPELHGEDEYALSVKLPKNTKVKEIYTLFNEKLGIKRTDLVRYWTINYRTNTSLRLDLPILPSYDEMTLESLMTSQGRNTAIDLFVEESYFDLGYIHSIWDELDTSQNFADVLQQVKDMVNEGLLPSSETYIREKDQTQILLLVKKFDIGAQRLTGLGHILLSQYSKLSQLGTILSKLLNISEEITFVEEYGPDGVETVDNHTELVRTELMDGDIITFAINPAEESLTYPFYSSIIEYYDYLRNRVKLKFTKTMSYDEEYVLPDNDGPNEFEFWISVKCTNEELARVVSKYVNVSPEYLRLYAIYSNGKFSMESGSLLTDYLVKRYNRNSIPPFGYEVLTIPLKELEHLRSIKFYWLEDSYVHFQSYEFRVANSSTVSEFLDKVQARIGFDDEKKKQVLLWTNSDFRFQGILSLDSKIESIDDSFLIFARVLPEEVSVVYHLEQLPSAEATDKSSENDLSISKHSNAEETIVIVQQYFKDWENKHGISFLFTLLPGETFPETKKRLHERFGLGQKEFSKIKLGILYNTEEGPIFKSLSSDDEEVGEIVLHDLMNNLDFITMDHPDRSRNQTHQDRPMMIKN

SEQ ID NO: 20495 - protein, 541 aa, Oryza sativa
MAEAATTTPLLTSHEAEPSIDDVIEAYIGATGARQLLKAMLLAFAWAFDAQQVFMSVFTDAEPPWHCTGVVDAAAAAAADSGSSCSPPAASASPCALPPGTWEWDRPAETSVVSDWALNCGPALVSLPASSFFAGNLAGGFLLATLADTHLGRRKMLLLSLVTMSVAAALTAFSPNVWVYSALRFVSGFGRSMVGTSAMVLSTELDGKRWRNTVSAAGFVFFSVGFVSLPALAYTFREASWRNMYVWTSLPSLCYAVLLYLLVQESPRWLLVRGRKQEAIEAVRQIASLNGGGGGITTSSFSMLDACAVELGDGGEGMFATLHSIWERRRALRRLAAITAASFGVGMVYYGMPLNVGSLSPSNLYLSVAYNAVAELPSSILAWLLMGRWFNRRGSVVALTTASGLCSLAACVPAVVLPDGARMAAEVASFFASCTAYDMMLMYTIELFPTSVRNSAVGLVRQAVALGGVVAPVLVALGRETTSYWSSSFGVFGLAVGCLGLLVTCLPETRGRRLSDTMEEEEAAVLSSSGASDMDNNGELV

SEQ ID NO: 20496 - protein, 642 aa, Arabidopsis thaliana
MDFFTSSKAKKDSKKSSGLFGKKTVSKSTPGSPAHPPGARSPPPSYLSNKRAETEYDFPMSNEQRPYWKQPASERVPNSHPRPPVYGYGTPDHRRDHGRERMEAMSYEPETNAPSSPYHPAGNRTPERPRKSTEYRREHQDRMYEADTRSNASPFHPFRSPSPSPFHTPDRRRDHYDMYEPEANTMLQNSAPGSPFHPAGSRSPPPYRTPDRRSNYDKEQFEDLYEQDGDVTPRNSSPPSPFHPAAYKTVGTQKLDTGFFLGISKSNSLSSESLRLTIEYVLVMLQSDQRSNHGKEQIEDFYEQDDDVTPRNSSPPSPLHPAASHSPPPPQPYRTPDHRRSHQDNEDFEAMYELDGDLIHQKSAPPSPVHGPYYSSSDDDNHSTYLYPEIRSPLRSRIVSENSTIVAAETYEQDKQFEPPELPDESQSFTMQEITKMRGLKNYESGKEESQSMISEAYVSVANYRVRQSVSETLQAIIDKHGDIAASSKLQAMATRSYYLESLAAVVMELKKTVLRDLTKTRVAEIAAVVKDMESVKINVSWLKTAVTELAEAVEYFGQYDTAKVEKEVCERDLTAKKGEMEEMTAELVKREKEIKECREKVTVVAGRLGQLEMKGSKLNKNLDLFQSKVHKFQGEAVLLHL

SEQ ID NO: 20497 - protein, 353 aa, Prochlorococcus marinus str. MIT 9313
MPSPRTFLAGDLGGTKTLLALYSWDEKQLKQQHRRRYLSNQWTSLEPMLSHFIAHLPGEMEQPNNGCIAVAGSVRHGEARITNLPWSLKEKDLCSATGLKHLELINDFGVLIYGLPFLNDAQQVELQRPQQHLSAQGPIAVLGAGTGLGMARGLPTKDGMVALPSEGGHREFAPRSECEWQLCEWLKADLQLERLSLERVVSGTGLGHVARWRLQHSDADGHPLRGLADAWRHGANDHCDHLDLPALASQAASEGDSILQEALQLWLAAYGSAAGDLALQELCVGGLWVGGGTAAKQLQGLRSSTFLEAFRNKGRFRPFLEQLPVMAVIDPEVGLFSAACRAHMLAEQGGTLT

SEQ ID NO: 20498 - protein, 277 aa, Xanthobacter autotrophicus Py2
MTTPQPTREITGHTRVYGILADPIHHVKTPQMLNALMAREGRDGVMVPFQVAPDDLATLVAGLKTMKSLGGFVVTVPHKTAIVDLCDAVSDSARRIGAVNTVRREADGRLIGEMLDGKGFVGGLLAAGIDPKDKSVYLAGAGGAANAIAFAFVEAGISRLTIANRTRAKAEDLAVRLAEAYPKAQVDIGNPDPSGHDIVVNGTSLGLKDGDALPLDTARLSPEQIVAEVIMQPEETALLAAAKAKGCRIHFGKPMLACQLDLMAEFLGMRALPGAGK

SEQ ID NO: 20499 - protein, 568 aa, Idiomarina loihiensis L2TR
MSTAPSNNRLNRQQAESFLSSLSGHYYPNSSREFISGSNKDIQVPFRRIHLSETLHQPTPGVKLPPNEPVDVYDTSSVYGDPDATIDVKAGLKKVRENWIQERHSENQQYNHGITQLAYARRGVITPEMEFIALRENMGRGHLKNPITPEFVRDEVASGRAIIPVNTHHPESEPMIIGRNFLVKVNANIGNSSVSSSIEEEVEKLVWATRWGADTVMDLSTGRNIHQTREWILRNSPVPIGTVPIYQALERVNGVAEDLSWPVFKDVLLEQAEQGVDYFTIHAGVLHDFIKLTAKRVTGIVSRGGSIMAKWCMAHQQESFLYQHFRDICKICAKYDVSLSLGDGLRPGSIADANDEAQFAELRVLGELTQIAWEYDVQVMIEGPGHVPMHKIQENMDEQLKHCHGAPFYTLGPLTTDIAPGYDHITSCIGAAMIGAFGCAMLCYVTPKEHLGLPNKEDVKQGMIAYKIAAHAADLAKGHPGAQARDDAMSKARFEFRWEDQFNLALDPVTARSYHDETLPQDSNKTAQFCSMCGPKFCSMKISHEVRQYNPDTRIDVKVKDAATEGAE

SEQ ID NO: 20500 - protein, 265 aa, Neisseria gonorrhoeae
MHALPRYAVFGNPAAHSKSPQIHQQFALQEGVDIEYGRICADIGGFAQAVSTFFETGGCGANVTVPFKQEAFHLADEHSDRALAAGAVNTLVWLEDGRIRGDNTDGIGLANDITQVKNIAIEGKTILLLGAGGAVRGVIPVLKEHRPARIVIANRTRAKAEELARLFGIEAVPMADVNGSFDIIINGTSGGLSGQLPAVSPKIFRDCRLAYDMVYGEAAKPFLDFARQSGAKKTADGLGMLVGQAAASYALWRGFKPDIRPVIEH

SEQ ID NO: 20501 - protein, 366 aa, Bacillus coagulans
MKMKLAVLPGDGIGPEVMDAAIRVLKTVLDNDGHEAVFENALIGGAAIDEAGTPLPEETLDICRRSDAILLGAVGGPKWDHNPASLRPEKGLLGLRKEMGLFANLRPVKAYATLLNASPLKRERVENVDLVIVRELTGGLYFGRPSERRGPGENEVVDTLAYTREEIERIIEKAFQLAQIRRKKLASVDKANVLESSRMWREIAEETAKKYPDVELSHMLVDSTSMQLIANPGQFDVIVTENMFGDILSDEASVITGSLGMLPSASLRSDRFGMYEPVHGSAPDIAGQGKANPLGTVLSAALMLRYSFGLEKEAAAIEKAVDDVLQDGYCTGDLQVANGKVVSTIELTDRLIEKLNNSAAGPRIFQ

SEQ ID NO: 20502 - protein, 178 aa, Brassica napus
MPKERKQRSVSHERFKGSSLYCESSRALKPSEKQVKEWEEARCPVCMEHPHNGILLVCSSYDNGCRPYMCDTSHRHSNCFDQYRKASKQTPTETEGVVAEVASVVTVVDPREGEGIVEAEAEQENGKPNLTCPLCRGNIKEWVVDESARCFMNAKRKSCSSETCEFSGTYSDLKKHAR

SEQ ID NO: 20503 - protein, 265 aa, Neisseria gonorrhoeae
MHALPRYAVFGNPAAHSKSPQIHQQFALQEGVDIEYGRICADIGGFAQAVSTFFETGGCGANVTVPFKQEAFHLADEHSDRALAAGAVNTLVWLEDGRIRGDNTDGIGLANDITQVKNIAIEGKTILLLGAGGAVRGVIPVLKEHRPARIVIANRTRAKAEELARLFGIEAVPMADVNGGFDVIINGTSGGLSGQLPAVSPKIFRDCRLAYDMVYGEAAKPFLDFARQSGAKKTADGLGMLVGQAAASYALWRGFKPDIRPVIEH

SEQ ID NO: 20504 - protein, 241 aa, Zea mays
  misc_feature (229)..(229): Xaa can be any naturally occurring amino acid
  unsure (1)..(241): unsure at all Xaa locations
VLSSLVPPPPPPDYSLKYIVASIRVLVLTINTHISLSLISASLRQQMSTAPLSGFFLTSLSPSQSSLQKLSLRTSSTVACLPPASSSSSSSSSSSSRSVPTLIRNEPVFAAPAPIIAPYWSEEMGTEAYDEAIEALKKLLIEKEELKTVAAAKVEQITAALQTGTSSDKKAFDPVETIKQGFIKFKKEKYETNPALYGELAKGQSPKYMVFACSDSRVCQGRRKSPRSXASAPLPPQLFAS

SEQ ID NO: 20505 - protein, 366 aa, Bacillus coagulans
MKMKLAVLPGDGIGPEVMDAAIRVLKTVLDNDGHEAVFENALIGGAAIDEAGTPLPEETLDICRRSDAILLGAVGGPKWDHNPASLRPEKGLLGLRKEMGLFANLRPVKAYATLLNASPLKRERVENVDLVIVRELTGGLYFGRPSERRGPGENEVVDTLAYTREEIERIIEKAFQLAQIRRKKLASVDKANVLESSRMWREIAEETAKKYPDVELSHMLVDSTAMQLIANPGQFDVIVTENMFGDILSDLASVITGSLGMLPSASLRSDRFGMYEPVHGSAPDIAGQGKANPLGTVLSAALMLRYSFGLEKEAAAIEKAVDDVLQDGYCTGDLQVANGKVVSTIELTDRLIEKLNNSAAGPRIFQ

SEQ ID NO: 20506 - protein, 417 aa, Oryza sativa (japonica cultivar-group)
MAEGAKFHGIVGAVGAHDVGGNFCDMGYYQKLGEGSNMSIDSLNSMQTSIYGGSVAMSVDNSSVASSDSRTGMLKHPGLRGPVIVSSYSVGNSIFRPGRVSHALSDDALAQALMDSRFPTETLKDYEEWTIDLGKLHIGMPFAQGAFGKLYRGTYNGGDVAIKLLERPEADPEKAQLLEQQFVQEVMMLATLRHSNIVKFVGACRKPMVWCIVTEYAKGGSVRNFLNRRQNRSVPLKLAVKQALDVARGMAYVHGLGFIHRDLKSDNLLISGDKSIKIADFGVARIEVKTEGMTPETGTYRWMAPEVIQHRPYDQKVDVYSFGIVLWELVTGNLPFANMTAVQAAFAVVNKGVRPAIPHDCLPALAEIMTRCWDANPDARPPFTEVVRMLEQVEMEVVNTVRRARFRCCISQPMTLD

SEQ ID NO: 20507 - protein, 176 aa, Triticum aestivum
  misc_feature (21)..(21): Xaa can be any naturally occurring amino acid
  unsure (1)..(176): unsure at all Xaa locations
MGPTEMASSATSVAPFQGLKXSTAGLPVSRRSNGASLGSVSNGGRIRCMQVWPIKGIKKFETLSYLPPLSTEALLKQVDYLIRSKWVPCLEFSKVGFIFREHNTSPGYYDGRYWTMWKLPMFGCTDATQVINEVEEVKKEYPDAYVRIIVFDNMRQVQCVSFIAFKQPSCEESGKA

SEQ ID NO: 20508 - protein, 236 aa, Aspergillus nidulans FGSC A4
MGREDQIEEREVLDSIFPEEITDVSDTSYRISITLDAPDNDEQSQEAEPPILILQVTYPEEYPDVAPELDLTAPTNAPKHPRLDISEDRDRLLEALQPTIEENMGMAMVFTLVSALKESAELLMVERVNAVHAVQEMEAAKAEEEENRKFQGTAVNRETFLEWLDKFKKEMEEEVRKKREEKEAEEKKANKKGPVKEEKKLTGKQLWERGLAGKADFDEEYEETMPAAVDKMKITA

SEQ ID NO: 20509 - protein, 317 aa, Glycine max
ALLDCVSFHHSRVTGPESVAFDRNGGGPYVGVSDGRILKYAGPTEGFKEYAFTSPNRNKTICDGLADFSELQATCGRPLGLRFNHQTNELYVADAYSGLIKIGPNGGAPTQCFKDIQPQQENVNTTLGFLDGLDVDVNSGVVYFTQASANYRFKDAQALQSSRDQSGSLFSLDPKTNQTRVLMRGLALASGVAVSRDGSFVLVSEYLANRIQRFWLRGPRANSSELFLQLTGRPDNIRSNQRGQFWVAVNGALGPNPPPRPTILPGGLRISENGVILQILSLVKEFGSEAASEVHEHNGTLYSGSLRASYVPISSMI

SEQ ID NO: 20510 - protein, 833 aa, Deinococcus radiodurans R1
MKKKQFLLLSGTALAAAWLNSKRARTAAQVPADLRSALTIFRTPSYTPGNLRLLRSGTLKASEIHPDVQVRHETIPGPPGAPAVPVFVYLPRQRQGVTPALFYTHGGGFIAHSAAFYHRVCSGYAAALGVPVISPDYRLAPETPFPGPLEDVYAALKWTFTQAAPLSIDPERVALAGESAGGGLTACLAQLAHDRGEVRPAFQALICPMLDERTVLKTDWQGRGEFVWTPTSNLTGWSSYLGFRPGTQTPPPYAVAARREDLSGLPPAWIGTSDLDLFYDENREYARRLMAAGVPCEWAEVAGGYHGFHLLKPEAEASRQFNTSFLSALRRALGLPDQNTDALPRVNTTPPTQAAALDVLIIGAGLSGIGAAHHLKTKNPGKTFEILEARQAMGGTWDLFRYPGVRSDSDVFTLGYSFKPWLGRKSIADGGDIRQYIQDAADEGGITPHIRFGHRVKSAEWSSEESLWTVTAEQEDGTPVLRQAKFLFLCSGYYSYDEAHRPEFPGEASFQGQIIHPQFWPEDVDYSGKRVVVIGSGATAVTLVPAMTDKAAHVTMLQRSPSHIAVRPLVDGTAAAFQKWLPAPVAHGVTRWKNVLSSIFYYQIARKAPDLFMRGLLDEAQKHLGERFNPADFTPSYKPWDQRVCAIPDADLFQAIRDGKASVLTETIQTFTPHGIRLTGGQELPADIIVTATGLKMNVLGDIEFALDGRPVDLSQTLIYKGMMLSSLPNFAYAFGYTNSSWTLKAELTADYVCRLLTYMDRHAFRAVSPQADSDLGERPLLDLNSGYVTRSLDVLPKQGSKQPWQVYQNYLLDKYAIQVAPINDGTLRFMRR

SEQ ID NO: 20511 - protein, 430 aa, Idiomarina loihiensis L2TR
MSKIVKVVGREIMDSRGNPTVEADVYLESGHMGRAAAPSGASTGSREALELRDGDTSRYLGKGVETAVANINGAIAEALSGIDAINQEAVDNIMLRLDGTDNKEKLGANAILAVSLAVAKAAALSKGIELYEHIANLNNTSGKYSMPLPMMNILNGGEHADNNVDIQEFMIQPVGAESFKEGLRMGAEVFHALKKVLQKRGLSTAVGDEGGFAPNLASNEEALQVIVEAVENAGYKMGSDITLALDCAASEFYRDGKYELSGEGKSFTAEEFADYLAELCDRYPIISIEDGLDESDWDGWKVLTEKLGSKVQLVGDDLFVTNTRILKEGIDKSIANSILIKFNQIGSLTETLAAIAMAREAGYSAVISHRSGETEDATIADLAVGTAAGQIKTGSLCRSDRVAKYNQLLRIEGDLNGQAPYRGRQEVNAG

SEQ ID NO: 20512 - protein, 374 aa, Guillardia theta
RSLLLIGVIASSSAFVPSVSLRGASPARSSLPAASRVARHGAVVATKMNTETKPEGFGASHTSFYTSAKAKDSYATLDEVLNQKMKDEGVRQVTREMLDAAVKITEALRVNLVTVADAQNSVFGDVQLGVDVIADNIMWDAAKASKVVKEAASEEEPVLVETNPNGRFTICWDPLDGSSIVDNNWAVGTMIGIWDKKTGMLGATGRDQVTSIVVLYGPRTTALVACDDGVYEFTCGAGNKWIASREKIQIKKDSKIFSPANLRCCQEDAGYDALVKHWMEKRYTLRYSGGLVPDVYQHFTKEMGVFANPTSPKSPAKLRVAFEIAPFSLLVEKAGGKTSDGVTGNSCLDIKIEAVDQRTPACLGSANEVDLFNK

SEQ ID NO: 20513 - protein, 478 aa, Aspergillus nidulans FGSC A4
MNENDENGPSTRLTRAKAAALTTDAPAANGALKKPLQTKKAATGANGTQRKRAALGDVSNVGKADNGETKDAKKATSKTGLTSKATMQSGGVQKLSRSNLSRTAVGAKDNNVKKPATEAKRPGSGSGMGSAMKRTSSQKSLQEKTIQQEEPPRKKVDIEKVVEKQAEAVSVKGDVKAGAQTEELEKPQDFVADLDTEDLDDPLMAAEYVVEIFDYLRELEMETLPNPDYIDHQPDLEWKMRGILVDWLIEVHTRFRLLPETLFLAVNIIDRFLSAEVVALDRLQLVGVAAMFIASKYEEVLSPHVANFSHVADETFSDKEILDAERHILATLEYNMSYPNPMNFLRRISKADNYDIQTRTLGKYLMEISLLDHRFLGYPQSQIGAAAMYLARLILDRGPWDATLAHYAGYTEEEIDEVFRLMVDYLHRPVCHEAFFKKYASKKFLKASIMTRQWAKKYHHLYIDSALTEPYNSIKDNE

SEQ ID NO: 20514 - protein, 98 aa, Brassica napus
MGLLIEDDNDGGEVLIPPANFSMVEDGVYRSGFPQLENFGFLSTLNLKSIIYLCAEPYPEENLRSLQSNNIKLFQFGIQGKTDPPTPMPKDTVLSALR

SEQ ID NO: 20515 - protein, 462 aa, Chlamydophila caviae GPIC
MSTDFDCVVIGAGPGGYVAAITAAQQGLKTALIEEQQAGGTCLNRGCIPSKALLVGAGIVSQIKHAKQFGIHIDGYSVDYPTMVQRKNTVINGIRQGLEGLIRSNKITVLNGRGSLISSTEVRVKGQDTTVIKAKHIIIATGSESRPFPGVPFSSRVLCSTGILNLTELPKKLAIIGGGVIGCEFASLFNTLGVEVTIIEVADQILSVNNADISKTMLDKFSQRGIQVITRASINQLEDLGDRVKITVNDQPQEYEYVLVAIGRQFNTTDIGLDNAGVIRDERGVIPVDEMMRTNVANIFAIGDITGKWLLAHVASHQGIVAGRNAAGHNEIMDYSAVPAVIFTFPEVAMVGLSLEAAQKQNIPAKLTKFPFKAIGKAVAMAEADGFAAIISHETTQQILGAYVVGPHAASLIAEMTLAVRNELTLPCIYETIHAHPTLAEIWSESALLATNHPLHLPPPRL

SEQ ID NO: 20516 - protein, 156 aa, Glycine max
SSQLRRPPPPIFDPTDLDIDVTPEKVEEALAENQQQRALILSLRLNEDLLIKKCIFAVDPADVRAICSAIPYKYLQRLIDTFASLLESCPHLEFILLWSQELCKVHGHYIQQNSRTLLPSLKSLQKSITRLHQDLADTCSSNEYLLKYLCTAGTKN

SEQ ID NO: 20517 - protein, 640 aa, Candidatus Desulfococcus oleovorans Hxd3
MPDCFYITTPIYYVNAKPHLGHAYTTIMADVAARFHAMAGKKVFFLTGTDEHGDKIMKAAAARGVSPKAYADTISALFRDLWTELDIGYSHFIRTTDENHKQVVSRVLAAIYEAGDIYFSEYEGLYCFGCERFYTERELVNGKCPDHDTPPERIQEANYFFKMSKYQQWLIDHITDNPDFIRPEGYRTEILSFLKEPLDDLCISRPTSRLDWGIPLPFDDRYVTYVWFDALLNYVSALGYPDDDRYMTFWPAVQHLTAKDIIKPHGIYWPIMLKAAGIPLYNHLNVHGFWQIESCKMSKSLGNVVNPLDMKNTYGTDAFRYFLCREMSFGLDAGFSEEALVQRINADLANDLGNLFSRVLAMTAKYFKNRVPAADDANLPPCDIDIGALARTTVAAYEAQMATFHMNRALAAVWDLISAMNRFIDYSAPWTLAKDPAKADALAAVIYTLLEGLRIVAGLVYPVMPGTGKTMMAHLGLDGPDSELFRLEDFKQWGRLVPDTVVAKPASLFPRVELAPSTDNACAPEDAPPAIAFAPEIDIDAFSKVDLRVGTVTAAEKIPKARKLLKLTVDIGEIRTVVAGLAEAYAPEDLVGRQVVIVANLKPAVLMGVESHGMVLAAVDGKNGITATVDKPAPPGTRLK

SEQ ID NO: 20518 - protein, 362 aa, Debaryomyces maramus
IDNGSGMCKAGFAGDDAPRAVFPSIVGRPRHQGIMVGMGQKDSYVGDEAQSKRGILTLRYPIEHGIVTNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSLPHGILRIDLAGRDLTDHLMKILSERGYTFSTTAEREIVRDIKEKLCYVALDFEQEMQTSSQSSAIEKSYELPDGQVITIGNERFRAPEALFRPADLGLEAAGIDQTTYNSIIKCDVDVRKELYGNIVMSGGTTMFPGIAERMQKEITALAPSSMKIKIIAPPERKYSVWIGGSILASLSTFQQMWISKQEYDESGPSIVH

SEQ ID NO: 20519 - protein, 308 aa, Bacillus anthracis str. Ames
MKQLYGVIGNPIGHSLSPVMHNDAFEHLKMDAHYHAFLVKEEVLGEAVRGLKALGISGFNVTTPHKVAIMDYLDEIDPLAKQIGAVNTVVHKDGKLIGYNTDGIGFVRALQSISSEPLQEKRILLLGAGGASRAIYFSLADAGVKEIDVANRTVDKAKELIAACTATVHSVALSLEKATKEQGNYDIIIQTTTIGMHPRVEHTPLQISSLKKGTIVSDIIYNPFETKILCEAKEQGAIIQNGIDMFVYQGALAFEMWTGCVPNIERMKQLVIRNLEANIYVNRKTKKIFTCTSTSFNTNFSSRKRRSK

SEQ ID NO: 20520 - protein, 477 aa, Oryza sativa
MEKAILRSLRRYQKFSVKFVLVKYFFSSTTNNLTAEKKFHHFCFQSPKDTCRSLQLLRLPPPRRLRGYDLVTSAKKFVKEAQLRLRAIVGQKLIKWNDLILRLANITLSNEKNCFVWSLHKNGQFSVKSMYAAIMNYNIWIKKRILWDLKIPLKIKVFYVVSSKESYLHVFLLAPLLVYDATTGGAGYYAQWCYTLGIGSQGLIFYETNDYSLSPKIEFRTVIYARWVRLAVIGSEDGEIPVLGNGLDSLRWGEPVKLRCSLKMQQNRAAKLRICADGGANRIFDEMFQMTNDPDYESTRKRYIPEIIEGDMDSIRPEVKQFYSSQGSKISDKSHNQETTDLHKCISRIHRCTPDHEKTNLCVLVTGALGGRFDHEAANINILYLFSDMRIVLLSDDCLIRLLPKTHKHEIYIESSVEGPHCGLFPVGAPSGSTTTTGLKWNLSTFLSQVAYSCSFHVKLYASVLSNRRILKILKHI

SEQ ID NO: 20521 - protein, 475 aa, Arabidopsis thaliana
MKSMVKKLKQSLRSGSLEKRKEKEKDIQEEKWFLDNGSIFLKELIADCNGKSIPIRNFSSDQILKATSNFGSSCFVTAEGFYVWYKGIIEDRSYMIKRFSEYKVTQYRVAEVYNEIVLSARMSNHNNFLKLIGFCLEFSLPVLVFEYAEHGVLNHRGGVIVNGEEVILPLSLRLKIGKEIANAVTYLHMAFPKILIHRHIKPRNVFLDENWTPKLSDFSISINLPEGKSRIEVECVQGTIGYLDPVYYTTKMVTEYTDVYSFGVFLMVILTGKPALASTSSDGDYKHIASYVKGFHENGQLDGVIDPKVMEDITSAQKVHVEAQVPDYGVKEIYNDIVLCDRMSNRSNFLKLLGCCLEFPFMILVFQDAELGVMNHRGAIKMVVLTARPALVSAGFDGEYRGITGYVKGLYENGKLDKVIDRMMFKDNTNGQRSQVEACVVLALRCCEERDEDRPKMIQVAKELKRIETSLKGVS

SEQ ID NO: 20522 - protein, 447 aa, Rhodospirillum rubrum ATCC 11170
MSDFDPALAGGLSRAELEAHWMPFTANREFKANPRMVVGAEGVHYIDARGRKLYDSLSGLWCCGAGHGRREIIEAVSAQIAALDYAPAFQFGHPSSFKLANKVASLTPKGLDHVFFTNSGSESVDTALKMARAYWRLKGEPARTKLIGRAKGYHGVNFGGLGVGGIGGNRKLFGVGIDADHLPHTMLPENAFTKGCPETGAELADALEDLVALHDASNIAAVIVEPLAGSTGVLPPPKGYLQRLRAICDKYGILLIFDEVITGFGRMGAAFGADAFGVVPDIMTIAKGLTNGAVPMGAVVASGEIYRTFMENSGPDHLVEFPHGYTYSAHPVACAAGLAALEIFEKDQLAARAAALAPYFENSLHGLRGLKHIVDIRNYGLAGAVQIENAPGQPAKRPLEIGRKCWEAGYYVRFGGDSLQFGLPFFSEPAQIDGLMNAVADAVSSVA

SEQ ID NO: 20523 - protein, 311 aa, Ralstonia eutropha JMP134
MALDEQARYILDMIASAGRPPLHTCTPEQARQSFDFRPLAGVPDAVAQIEEVTIPGPAGDIRVRIYTPDGEGPFPALVYCHGGGWVVGDLDTVDVPCRRLATRASCVVVSVDYRLAPEHRFPAATEDAYAAFQWLVSNARAQQVDATRIAVGGDSAGGNLAAAVALMARDRAAPQPCFQVLLYPVTDGTLDTPSYRENAEGYLLTRDSMVWFWNHYVGDADRTHPYASPLRADHHRGLPPAFVVTAEFDPLRDEGEAYARRLAEAGTPVECKRYDGTIHGFCWMPGVLDKGRQALDDTAAALAAAFQSDNR

SEQ ID NO: 20524 - protein, 489 aa, Sinorhizobium meliloti 1021
MQSYQIREMATPLCQPAASHFIDGTFIEDRTGPEILSVNPVDGEIIAKLHGATSCIIEKAIASAKRAQKEWARKEPAERGRVLSRAADIMRARNRELSVLETRDTGKPISETLVADAASGADCLEYFGAIAATLSGDSIQFGEDWVYTRREPLGVCLGIGAWNYPIQIAAWKAAPALACGNAMIFKPSEVTPLSALKLAEILTEAGLPPGVFNIVQGAGDVGAELATHPAIAKVSLTGSVKTGARVASAAMAGIRPVTMELGGKSALIVFDDADVEAAVSGAILGNFYSAGQICSNGTRVFLQRGIREAFLARLLARVAALKIGDPMDEETDIGPLVSAAHRNRVATYVARAEVEGAYQMAPPRKLPPGDAWHEPVVFTNVTDWMTLAREEVFGPVMAVLDFDDEQDVVARANATDFGLAAGIFTRDLVRAHRLAAELEAGTVWINAYNLTPAGMAFGGIKRSGIGRENGRVAIDHYTQLKSVFVSMQT

SEQ ID NO: 20525 - protein, 440 aa, Clostridium perfringens SM101
MGKPKLKKEIGLFTATALVVGNMMGSGIFMLPSSLAGVSGPGSTIMAWLLTGLGSLILALTFANLGSKIPKTGGTYEYSRLAYGNFMGFMTAWLYWNGSWIGNATIFIVITTYLGEVITSLTNSSIIGFLFCSSILWICTYINIRGTKLAGRVASVITVFKVLLFIFFIVVGLIYFDPSNLTPMFPEGKGVSTIPVAASLTLWAFMGLETASVAGGEIKDPEKNVKRSTILGMLISTVLYILISVVAMGVMSQSELASSTAPISDIIVKVLNLKSLNFLNIAIAISILGTAMGWLLSTARVGYAAGEDGIFPSVFAKVHPKYNTPYVALIIGSIFINIIFLMNFTKGLAGAYSFIVVLATLSYLPIYAISTIAEIILMVKEDKKPSFKKHLGLITRCLIGFAFAIWAIYASGAEIVMYGFILILLGVPIYGYMSIKKHFR

SEQ ID NO: 20526 - protein, 451 aa, Neisseria gonorrhoeae
RFVDLRFTDTKGKQHHFTVPARIVLEGPEEWFENGQAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 20527 - protein, 480 aa, Idiomarina loihiensis L2TR
MSSLTKKDCFIEGHWVPTDKRFSVTNPATGEVIAEVADADEDLTQRAINVAETALKSWRKKTARERAMLLRKWYEAMMDNKQALGELMSAEQGKPVAEAVGEVEYGASFVDWFAGEAERIDGDILPNADSSKRVMVTKEPVGVCAAITPWNFPNAMITRKIAPALAAGCTIVVKPPQLTPLSSLALAQLASEVGIPDGVINIIPTSDAKSVGKRLATSPQVRKLSFTGSTGVGKILMQQCSEHVTKLSLELGGNAPFLVFDDADIEQAAEQLIACKFRNAGQTCVSANRILVQQSVAEKFTDAVVSKVKALKVGPGTEENVDLGPLIDQDAVDKVQRLVLAAKSDGATIETGGSVMTELGDLFYAPTVITGVTEEMDISEEEIFGPVVAINTFETEEEGIEKANNTPFGLASYFAAKDTARIFRVSDALEYGMVGVNTGGISHAYNPFGGIKESGVGREGSKYGIDEYLELKTVTLGGLG

SEQ ID NO: 20528 - protein, 283 aa, Idiomarina loihiensis L2TR
MSESNIVNLDLQNFQQVLLEGSKEKLIIIDFWADWCEPCKQLMPVLEKLAMQYSDQVILAKINCDEQQELAAQFGIRSLPTVAFFKDGQPVDSFGGVKTEGEIQEILTKHLPSPSDDLIQQAQTAMGEGDANTAYTLAKQAYDLDNTNMQALKLLAEAAVDAGRLDQAKELVAKIPLVEQDGDYQRIKGKLELAEDAADSPELRALQEQVENTPDDLALKLQLALKFHEASRDEEALQQIFTVLGKDVNFADAKKYALDIINSLPDGDPLAATYRRKLYSTMY

SEQ ID NO: 20529 - protein, 526 aa, Rhodospirillum rubrum ATCC 11170
MPLTQSGPRFWQSALPLPGELGGRARPVLGVAEMAAADQAAAAAGRPGLVLMEAAGAAVVREIAARWSKRPVRVLCGPGNNGGDGYVIARLLAARGWPVRVMALEGAPPPGGDAAGMAHLWRGRVDPMTAEDLRPGDLVVDALFGAGLSRPLAGAAAEAVARINALGLTCVGVDVPSGVDGDSGRILGAAPFCALTVTFFHPKPGHLLVPARERIGELVIADIGLPETVLDAAPPRAFVNGPGLWTLPRPAVEGHKFARGHAVVIGGARMTGAARLAARACRRVGAGLLTIACAEEARLIYALDQPGAMVWGIGGEGPIARLLDDPRRNAFLLGPGYGRGAETAALALMLAKGGRALVLDADALTSLSGKLEEFSRTLCYDCVLTPHEGEFRALFAAALGAEAAPERGRLARARAAARASGAVVVLKGPDTVIAAADGRAAISVGAPADLATAGSGDVLAGLVLGLLAQGLPGFEAAAAAVWLHGAAGRAAGPGLIAEDLPEALPALLAALRSAPSPNRRPTDRTV

SEQ ID NO: 20530 - protein, 164 aa, Xanthobacter autotrophicus Py2
MSSEISSPFAFPAPGKGAALEEDTLLSPRFDANGLITCVAVDAVTGEVLMLAHMNAQALALTIETGEAHYFSRSRGKLWKKGETSGHTQKVREMRIDCDQDAVVIKVEMGGTGAACHTGRRSCFYRTIPLGAAPSAELKLAFTGDAPRFDPAAVYGKDGHGHDH

SEQ ID NO: 20531 - protein, 451 aa, Neisseria gonorrhoeae
RFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 20532 - protein, 222 aa, Candida albicans SC5314
MSREALINRITNETKIQIALNLDGGKLELKESIFPNQSIIIDEHHAKQVSGSQYINVQTGIGFLDHMIHALAKHSGWSLIVECIGDLHIDDHHTAEDVGISLGMAFKQALGQIKGVKRFGHGFAPLDEALSRAVVDLSNRPFAVIELGLKREKIGDLSTEMIPHVLESFAGAAGITIHVDCLRGFNDHHRAESAFKALAIAIKEAISKTGKNDIPSTKGVLS

SEQ ID NO: 20533 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 20534 - protein, 710 aa, Pichia angusta
MSMRIPKAASVNDEQHQRIIKYGRALVLDIVEQYGGGHPGSAMGAMAIGIALWKYTLKYAPNDPNYFNRDRFVLSNGHVCLFQYIFQHLYGLKSMTMAQLKSYHSNDFHSLCPGHPEIEHDAVEVTTGPLGQGISNSVGLAIATKNLAATYNKPGFDIITNKVYCMVGDACLQEGPALESISLAGHMGLDNLIVLYDNNQVCCDGSVDIANTEDISAKFKACNWNVIEVENASEDVATIVKALEYAQAEKHRPTLINCRTVIGSGAAFENHCAAHGNALGEDGVRELKIKYGMNPAQKFYIPQDVYDFFKEKPAEGDKLVAEWKSLVAKYVKAYPEEGQEFLARMRGELPKNWKSFLPQQEFTGDAPTRAAARELVRALGQNCKSVIAGCADLSVSVNLQWPGVKYFMDPSLSTQCGLSGDYSGRYIEYGIREHAMCAIANGLAAYNKGTFLPITSTFFMFYLYAAPAIRMAGLQELKAIHIGTHDSINEGENGPTHQPVESPALFRAMPNIYYMRPVDSAEVFGLFQKAVELPFSSILSLSRNEVLQYPGKSSAEKAQRGGYILEDAENAEVQIIGVGAEMEFAYKAAKILGRKFRTRVLSIPCTRLFDEQSIGYRRSVLRKDGRQVPTVVVDGHVAFGWERYATASYCMNTYGKSLPPEVIYEYFGYNPATIAKKVEAYVRACQRDPLLLHDFLDLKEKPNHDKVNKL

SEQ ID NO: 20535 - protein, 810 aa, Oryza sativa (japonica cultivar-group)
MTQALHMLKFFGKLVEPKSEQSLKTLFKLSPDGSISSLFQNFVTYVQDSVSTELKDARAQCLQKLKHLSDHFELPNVFDKRSIEDFLVRNAKSILCTASSSSRLHYLPEASPFDLLVVDEAAQLKECESLIPLQLPGVRHAVLIGYEFQLPALVKSRVCEDAEFGRSLFERLSSLGHPKHLLDVQYRMHPGISKFPVSSFYENKISDGENVLHRDYERKPLAGPMYGSYSFINVDAGKESKGKHDKSLMNPIEVAAVTRIVQRLFKGTHCIMPLHSGMASLSSDSLVCAESVDTGRKLCVGVVSPYKGQVRAIQERLGKAYETHGGFTVKVRSVDGFQGAEEDIIIFSAVRSNTTGSVGFLSNVNRTNVALTRAKHCLWILGNANTLASSKDHLAGCLFNASEDKELNNAIIRAVIELDEVDDLLEMDSLRLSGSRFGVTYRGVGPPRPRNAMATAGVTEHLLSPRAGAGDDMSAGDGEGWCNALAKYEALASSLPSCHGLGSAPYRRYGGFWYPAHLMPATLAARDTFVARPSDVILATMPKSGSTWLKALAFCVVHRGRHAPAAGQHPLLHSSPHDLVPFLHSIYEISRSCRVAPGHRLDAMPSPRILAVHEPLSSLPASVKASGCRVVYLCRDPKDAFVSLRHYLDEIKPEGSTMTPFDEAFELLCDGVSPYGPMWDHAAEYWKESLARPEEVVFLRYESLKEDGVGSVRRLAGFLGCPFTGEELAGGVPETIVELCSMERMRNVEANRDGEHGATWSSFKNSAFFRKGEVGDWKEHMSPEMARRLDDVVEEKLRGSRMSLIRHRQY

SEQ ID NO: 20536 - protein, 411 aa, Arachis hypogaea
MLEGGAKFPGLIDLNKHTTDNYYDFSQGFYHKLGEGTNMSIDSMQTSNGGGSVAMSIDNSSVGSNDSHTRILNHQGLRRRANDNYSVQNSVNRRGRVTHALSDDALAQALMDSSSPTEGLENFDEWTIDLRKLNMGEAFAQGAFGKLYRGTYNGEDVAIKILERPENELSKAQLMEQQFQQEVMMLATLKHPNIVRFIGACRKPMVWCIVTEYAKGGSVRQSLMKRQNRSVPLKLAVKQALDVARGMAYVPWLGLIHRDLKSDNLLIFGAKSIKIADFGVAGIEVQTEGMTPETGTYRWMAPEMIQHRPYTQKVDVYSFGIVLWELIPGMLPFQNMPAVQAAFAVVTKNVRPIIPNDCLPVLRDIMPRCWDPNPDVRPPICRNCRNAETEIMTTVRKARFRCCMTQPMTAD

SEQ ID NO: 20537 - protein, 461 aa, Roseovarius nubinhibens ISM
MFNRAVALMDLPPGLEEKIRVCNATYTVRFGVRLRGQIHTFTGYRSVHSEHMEPVKGGIRYAMGVNQDEVEALAALMTYKCALVEAPFGGSKGGLRIDPREWDEDELERITRRFAYELIKRDLINPSQNVPAPDMGTGEREMAWIADQYKRMNTTDINGRACVTGKPINGGGIQGRTEATGRGVQYALQEFFRHPEDMKAAGLSGTLDGKKVIVQGLGNVGYHAAKFLSEEDGCIITGIIERDGALVSEDGLHVEEVRHWIAKHGGVKGYPDAEYVEDGSKVLENACDILVPAALEGVIHMGNAANIQAPLIIEAANGPVTAGADEILRKKGAVIIPDMYANAGGVTVSYFEWVKNLSHIRFGRMGRRQEEARHQLIVDELEQLSADRGLGWTLTPGFKQQYLRGAGELELVRSGLDDTMRAAYQSMREVWHGRQDVTDLRTAAYLVSIDKVAASYRAAGL

SEQ ID NO: 20538 - protein, 893 aa, Zea mays
MPPWWGKSSSKEVKKSAKENLIDTFQRLISSNEQKGSRKSRSSRRHGKDTAGDKGCWSTAQSRSTSPSKEVSRCQSFAADRPHAQPLPLPKSRAKVTRTSSDITNSKSTLEKHGKGQLLPLPPIQPKKRPEATEPVTEVATASVSSNCSIDSDDPGDSQLQSPVGNEAENATRITATSSSSVVRKECSSAITRKNTKEVAKPNSAILSNQILSTSPRGTFADGYQSNLQSPRQIALESAPNSLMSSPSRSPRNICPVQIPTSAFWAIKPHTDVTFLGSGQCSSPGSGQTSGHNSVGGDMLGPIFWQPSRGSPECSPIPSPRMTSPGPSSRVHSGSVSPLHPRAGGVTPESPTNRHAEGNKKQTHRLPLPPLSIANSSTFLPNSSNPTSPISRSPGRTENPPSPGSRWKKGKLIGRGTFGHVYVGFNSDRGEMCAMKEVTLFSDDPKSKESAKQLCQEISLLSRLQHPNIVRYYGSETVDDKLYIYLEYVSGGSIHKLLQEYGQFGEQAICSYTKQILLGLAYLHAKNTVHRDIKGANILVDPNGRVKLADFGMAKHINGQQCPFSFKGSPYWMAPEVIKNASGCNLAVDIWSLGCTVLEMATSKPPWSQYEGIAAMFKIGNSKELPPIPDHLSEEGKDFIRQCLQRDPSSRPTAVDLLQHPFVQNAPPLEKSSASHPLEQLTAISCRTNSKVVEHARNMSSLGLEGQSILQRRAAKFSLPNSDIHIRSNISCPVSPCGSPLLRSRSPQHQNGRMSPSPICSPRTTSGASTPLTGGSGAVPLNHVRQPAYRNEGFTVTSRGFDDHMPSRPVDPVHGRFIRVQQFSVGRQERVVSEVDILSSQYGKMRHANVWDPHDRPLPSERSSQQCFGNHAKLKPSLDLRSGPRHPGRNHGH

SEQ ID NO: 20539 - protein, 198 aa, Coprinopsis cinerea okayama7#130
MSRGGGSRGFSRGGGRGGGRPGGFQNAGPPDQVLEMGSFIHAVEGEMLCSSLMPDKVPYFNAPIYLQNKSLIGKVDEILGPINEVYFSIKMENGVIASSFKKGDKVYIGGDKLLPIERFLPKPKAPPGVKSKFSQAVEEQVDEVGVHREDGAVQGEEVGVGLVGVEAEPEVVDLVEDEEEDEEGLVEARGGRGGFRGS

SEQ ID NO: 20540 - protein, 273 aa, Candidatus Desulfococcus oleovorans Hxd3
MNLDNAIHEAAKVLAGASRAAVFSGAGVSAESGIPTFRDPGGVWDRLNPAEVGDTQGLLASLEKNPEKLVAMFMELLAVFDAAIPNPGHRALFDLERMGILQAVITQNIDNLHQEAGNTQVIEMHGNGFRFRCLKCRSRRSHERHALIGRVKERLSTLPDFSPASIFAAMPDCDLCGSGMRPDVVMFGETVMEVENAFAAARSCDVMLALGTSGVVTPAAQIPAEAKASGAKVIVINPNENGFARVCDIYISMKTGQALPRIVEQVKKIRSGS

SEQ ID NO: 20541 - protein, 355 aa, Zea mays
MTSSSNNGGRPDDGGEVVLDHEYQEEYVRNSRGMSLFACRWLPAVAGKRGRAPAPKALVFLCHGYAVECSVTMRGTGERLARAGYAVYGLDYEGHGRSDGLQGYVPDFDALVLDCDEYFTSVVAAAAQSQSKDAHQLPRFLLGESMGGAVALLLHRRRPEYWSGAVLVAPMCKIADDMRPHPLVVNILRAMTTIIPTWKIVPSNDVIDAAYRSQEKRDEIRSNPYCYKDKPRLKTAYELLKVSLDLEHNLLHQVSLPFLIVHGGADKVTDPSVSELLYQSAASQDKTLKFYPGMWHALTSGESPDNIQAVFQDIIAWLDHRSPDTEQEELVSSEVEQKAKHDDQRHQEQLQDGNK

SEQ ID NO: 20542 - protein, 327 aa, Candidatus Desulfococcus oleovorans Hxd3
MSEDLRGYIFSRVAGDMEAIETALADNLTPYFDKVREIAGHILFTGGKRVRPLLMVLCARLCRYDGSDDKRVSVMFEYLHTATLLHDDIVDGAAMRRGSPAAHVVWDPASAVLVGDFLLARSASIAVDTGRIALMKILADILEDMSQGEIHQLARKGNVNLSEAEYRTIILHKTAVLMEGACRSGAILAGASDAHARALADYGRNLGMAFQMIDDLLDYTADTQVLGKAVGADLREGKFTLPLIHALGRADAGDAETIKRIMGNPDVTDAAFETLKRLLETYDGIGYTRRCAEAHIQEARSALDMFEPSETRTLLEKLADYTILRRT

SEQ ID NO: 20543 - protein, 141 aa, Zea mays
MVRGKLEVLLVSAKGLDDSDFFNSMDPYVILTCRSHEQKSTVASGAGSEPEWNETFFFAISGDAPELRVKIMDSDALSADDLVGEACIPLEAVLQEGSLPPAVHRVVKDEEYRGEIKIALTFTPAEENEEEESYGGWNQST

SEQ ID NO: 20544 - protein, 438 aa, Silicibacter pomeroyi DSS-3
MTETCDRFALIGAGPMGLAMAKVMLEQGIAFDGFELHSDVGGLWDIDGPRSTMYESAHLISSKRMTEFTDFPMEEAVAEYPSHRELKRYFHAFAARYGLRDHYRFGAEVLRCEPLGEPGAGWRVIWRDAEGEHTETYAGVMIANGTLSEPNMPTFQGRFDGELIHSSAYRHPSQFDGKRVLIVGAGNSGCDIAVDAIHHGALCDLSMRRGYYFVPKYVFGKPADTLGGMIKLPMWLKRRVDGMILKWFVGDPQKYGFPKPDYQLYESHPVVNSLVLYHAGHGDLRIRPDIDRFDGRRVIFADGSSEEYDMILAATGYKLFYPFIDRDLLNWQGDAPHLYLNALHPERDDLFVLGMIEASGLGWQGRHEQAEMVARYITGLRRGGAAAAELKAAKSAGFERATGGMNYLKLARMAYYVDKATYRGAVTGWIDRLKRAQS

SEQ ID NO: 20545 - protein, 295 aa, Triticum aestivum
  misc_feature (192)..(192): Xaa can be any naturally occurring amino acid
  misc_feature (211)..(211): Xaa can be any naturally occurring amino acid
  misc_feature (222)..(222): Xaa can be any naturally occurring amino acid
  misc_feature (226)..(226): Xaa can be any naturally occurring amino acid
  misc_feature (233)..(233): Xaa can be any naturally occurring amino acid
  misc_feature (239)..(239): Xaa can be any naturally occurring amino acid
  misc_feature (247)..(247): Xaa can be any naturally occurring amino acid
  unsure (1)..(295): unsure at all Xaa locations
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHAFTEGVTKFLMPSVAGFLMQKELDYLVGAVANPKXPFAAIVGGSKAHLRLGVIXLCWAKVDILIXVGGXLTFYKAXGLTVGXSLVEEDNXNWHSLIETEIQGVNSSPRFLVAFNAKMSCTVMGGANHPNTVRTPGILN

SEQ ID NO: 20546 - protein, 535 aa, Silicibacter pomeroyi DSS-3
MNRPARAGNPGGRIQMSILKSRFEDVALSDKSVTQRVFEGIDPDMTILIDGPSGRSYSGAQFIRAVKSLAGGLSAHDMGAGTCVGLMMPNLPEYCIAFHGIAWAGGTITTINPTYTAPEVHHQLNDAGAQVLVTIPAFLDTARAAIEGTGVDRIVVVGDAPEGTLALSDLMGPPLEHQAPVDVAEHVVVLPYSSGTTGMPKGVMLTHRNLVVNIDQTLLPADLNPGEMTTAFLPFFHIYGLQVLMNIYLTAGGGLVTLPRFDLEQYLDCVIRYRTPRLWIVPPVALALAKHPVVANYDLSCVEQVFCAAAPLGRDVAEGLGERINARVNQGYGMTELSPVSHVSPHGEGKPGASGVAISNTECRIIDPETGTDLPLGEDGELWVRGPQVMKGYLNNEAATRATIVEGGWLRTGDIAHFDEDGFLYITDRLKELIKYKGFQVAPAEVEAALLTHPAIADAAVIGAPDEAAGEVPLAFVVAAAGQAAPSLAEVQAYLDTRLAHYKQVRQMQVIEQIPKSASGKILRRLLRDAQGAQA

SEQ ID NO: 20547 - protein, 295 aa, Zea mays
  misc_feature (250)..(250): Xaa can be any naturally occurring amino acid
  unsure (1)..(295): unsure at all Xaa locations
MAGSLHLPVVDLALPDLRAAAESIRQACVEHGFFYVTNHGVDRGLLEAVFAESKRFFDLPMEDKMALLRGANHRGYTPPYAEKLDASSQFVGDLKESFYIGPLDDGDMHNDVNQWPSEERLPSWKETMKLYFAAVLDTGTRILSLVALGLDLDADFFHKIGALKCPSTFLRLLHYPGEVHESDSGNYGASAHSDYGMITLLVTDGTPGLQICREKDRNPQLWEDVHHIDGALIINIGDLLERWTNCAFRXAFFLDPNPDTLVQCLESCCSEACPPRFPPIKSWDYIAGRLNSTYK

SEQ ID NO: 20548 - protein, 392 aa, Rhodospirillum rubrum ATCC 11170
MAQTEIKSYTLNFGPQHPAAHGVLRLVLELSGEVIERADPHIGLLHRGTEKLIEYKTYLQALPYFDRLDYACPMNQEHAYVLAVEKLLGITVPPRAQYLRTLFNEVTRLINHIMNTTSMALDIGAMTPLLYGFEEREHLLEFSERASGARMHAAWFRPGGVARDVPPDLLEDILKFCDSFPKYLDDVEHLLDENRIFKQRTVDIGKVTAQQALDWGFTGPVLRGCGVPWDLRKSQPYDAYAAMDFDIPTGANGDCYDRYLVRMAEQRQSIRIMRQCIEKMPDGPVKAVDHKVTPPSRGEMKSSMEALIHHFKLFTEGFKVPEGETYTAVEAATGEFGVYLVSDGTNRPYRCKIRSPGYVHLQGLDLMSRGHMLADVVANIGSIDVVFGEIDR

SEQ ID NO: 20549 - protein, 360 aa, Schizosaccharomyces pombe 972h-
MAPAEKAFVLRKKMDTAIEDRPGQTLTDDHQVKVAIKATGICGSDVHYWKEGGIGDFILKKPMILGHESAGVVVEVGKGVSSLKPGDPVAVEPGCVCRLCDYCRSGRYNLCPHMEFAATPPYDGTLRTYYITTEDFCTKLPKQISVEEGALFEPMSVAVHAMTRGNLKCGSRVLVMGCGTVGLLMMAVAKAYGAIDIVAVDASPSRVEFAQKYVGAKPFTPIAAKENESLPDYAQRYKQAIIEKYGEFDFAVDATGVGICIHTAVLALKRGGTFVQAGNGKPVIDFPINHIINYEINVLGSFRYAHGCYKQSLFLVSNGLVDVKPLITHRFAFKDALKAYETVASGEEGVLKVIIGGPDA

SEQ ID NO: 20550 - protein, 401 aa, Populus nigra
MATKKSVSSLKEADLKGKSVFVRVDLNVPLDDNFNITDDTRIRAAVPTIKYLMGHGARVILSSHLGRPKGVTPKYSLKPLVPRLSELLGVDVKMANDCIGVEVEKIVAEIPEGGVLLLENVRFYKEEEKNDPEFAKKLASLAEIYVNDAFGTAHRAHASTEGVAKYLKPAVAGFLMQKELDYLVGAVANPKKPFAAIVGGSKVSSKIGVIESLLEKVDLLFLGGGMIYTFYKAQGHSVGSSLVEEDKLDLATSLIEKAKVKGVKLLLPADVVVADKFAPDANSKVVPASEIPDGWMGLDIGPDSIKTFSEALDTTKTIIWNGPMGVFEFEKFAAGTEAIARKLAELSGKGVTTIIGGGDSVAAVEKAGLADKMSHISTGGGASLELLEGKPLPGVLALDDA

SEQ ID NO: 20551 - protein, 103 aa, Schizosaccharomyces pombe
MVKQVSDSSEFKSIVCQDKLVVVDFFATWCGPCKAIAPKFEQFSNTYSDATFIKVDVDQLSEIAAEAGVHAMPSFFLYKNGEKIEEIVGANPAKLEVRLNRSL

SEQ ID NO: 20552 - protein, 137 aa, Kineococcus radiotolerans SRS30216
MNESRPASRKETFVFAASDGVPPQVGPFAHATRLGDLVFLTGQMPTDPATGELVGGGIVEQAEQVRANLAAVLAGFDLTLDDALQVRVYLRHFDEHFEAFNERYRTWFAGPLPARTTIGVTGLAVGALVEVDVTAGR

SEQ ID NO: 20553 - protein, 401 aa, Populus nigra
MATKKSVSSLKETDLKGKRVFVRVDLNVPLDDNFNITDDTRIRAAVPTVKYLMDHGARVILCSHLGRPKGVTPKYSLKPLVPRLSELLGVEVKIANDCIGEEVEKLVAEIPGGGVVLLENVRFHKEEEKNDPEFAKKLASLAEVYVNDAFGTAHRAHASTEGVAKYLKPAVAGFLMQKELDYLVGAVANPKKPFAAIVGGSKVSSKIGVIESLLEKVDFLFLGGGMIFTFYKAQGYSVGSSLVEEDKLDLATSLIEKARVKGVKLLLPTDVVVADKFASDANSKVVPASEIADGWMGLDIGPDSIKTFSEALDTTKTIIWNGPMGVFEFEKFAAGTEAIAWKLAELSGKGVTTIIGGGDSVAAVEKVGLADKMSHISTGGGASLELLEGKPLPGVLALDDA

SEQ ID NO: 20554 - protein, 377 aa, Triticum aestivum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKGEYDESGPSIVHRKCF

SEQ ID NO: 20555 - protein, 162 aa, Rhodospirillum rubrum ATCC 11170
MTSIVRTLRSLTLWELVSGMALTFRYMLKPKVTINYPFEKGYLSPRFRGEHALRRYANGEERCIACKLCEAICPAQAITIEAEPRTDGSRRTTRYDIDMTKCIYCGFCEEACPVDAIVEGPNFEFAAETREELLYNKAKLLANGDRWEPELALRLRKDAAYR

SEQ ID NO: 20556 - protein, 383 aa, Synechococcus sp. RS9917
MALKPSLTLAISARAQALKEAGRDICSLSAGEPDFDTPEFIVEATLKALRDGITRYGPAAGDPQLRDAIAGKLSNENRVPTDAAQVLVTNGGKQAIYNLFQVLLNPGDQVLIPAPYWLSYPEMARLAGAEPVVVPSSAATGFQLDLEALEAVLTPRSRLLVLNTPSNPTGRVMQRTELEVLAAWLRRHPDLLVMCDEIYEFLLAEDESHHSLAALAPDLAERIFIVNGFAKGWAMTGWRLGYLAGRVEVIKAAAALQSQSTSNVCSFAQRGALAALEGSRSCVSAMAASYTERRQQMIAGLQAIDGLTLVPPRGAFYAFPQLPDDTIESVEFCRLALEEEGLALVPGEPFGDRRCVRLSCAVARETIADGLERLQRLLDRLRS

SEQ ID NO: 20557 - protein, 891 aa, Candida albicans SC5314
MQMNATSLYKRTEVIGRGKFGVVYKAQNKQTKQIVAIKVLNLDTEEDEVIDVQQEIQFLSELKNVPNITHYYGCILNDTKLWIIMDYCAGGSLRTLLKAGVLEERYVAVIVRELLMTLSAVHKLGVIHRDLKAANVLISKEGNVQLCDFGVAAKITANSTKRTTMAGTPYWMAPEVIRTGDTYNSKADIWSLGITIYEIATGNPPYCDKDASWAMQLISKSTPPRLEGREFSQALKECIALCLDENPEERPSADDLMKCKLVKIYKNHPTSILKEVISRYLLWRDRNSSRDSVFINLENEQEDSVDEIVNKNLDGGYHNQQQQHQQQQQQNDHQDHDGHNNQIQVKWDFDSLSSREYIMENDIDLDKVNQQYNNNFDTQQGNTYSTLPTLKAPTTKNNTLAATNQNSMTASKNNSKSTTEVPKSLQMLFEDNSEEQEDLAPPKSNVNIMERMESPTIEIPDMDSLSQLPSASATNTTNHPQLNKPPALYHSQSASGNLESRFSSLNTSPKDNGGSTGGNNGINRPRKKTISNTGGTANAQFQQTSSAVPHTPPYTTPASVRTPSPKPPSSVNLLNATSMSKTGSPSKMKALQSSSNPLLQPINMKSENMNAGITGGTGSHPPMQAPPQLITQQSLPVLPTSSSTSASVSTSTTTTTTATSTTSGGMAGNMKSQRNKPGFIQMPTPSNTLINNMSSLTNDHQDGGNNGGGGGDNNNVNQFGINPAQAASMPVSMTPVTEKDHSQLFPNINNDESLEKTNNGSGNSRSHQNSLSSQKKSLASSSSHNLSSLGFSNGNNSAPTTAAASTAPPPPPTMFANRGSSNSVSQSQANFSLNGGGATNNGNPTFSVFPTIPNINGDIFSDTVSKQKLVNELDVMITLFNQGLEVLEEIL

SEQ ID NO: 20558 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAAFKADHEFLLRGGVFSKDWIDSYIAFKEEDVRRIRMAPHPLEF

SEQ ID NO: 20559 - protein, 323 aa, Cryptococcus neoformans var. neoformans JEC21
MSHSPHPLATLEQIVSTPSAADGIPSDVEDDLRVAGCMLIQEAGVMLKLPQSTMATAQVLLHRFYYVSSMCSFGVNDISISALFLASKLCESPVRLRDLINTYLYLLARTQHLLNLPADQPFHPGLLSQSDESEKDKLWEGFKFSVPGFHDEIFWDWKDVITASEMQVLKRLGFNMQVDLPYNHMINYLKILDLVFEDDVTQMCWSILNDMLLTPLYAIHPPHTIACISILLTTRLRRIPLPPKWYLLFDVSYDEIWSGCGVVMRLWIDWGLDRPKGVIQRNKRTVNEEEEGRKIKESRWRRAWVLAQSRKAVRRWVEGLEKA

SEQ ID NO: 20560 - protein, 320 aa, Oryza sativa (japonica cultivar-group)
MSGRRDDSAKMAKLKELLHRSENRICADCSAPDPKWASANIGVFICLKCSGVHRSLGTHISKVLSVTLDQWSDNEIDNVIEVGGNSHANAIYETFLPQNHSKPHPDSTQEEREKFIRSKYELQEFLEPSLRIVSHQSSDSGKHAGSASHSVSSKSEVGMIEFIGILNVKVKGGTNLAIRDMSSSDPYVVLTLGQQKAQTSVIKANLNPVWNEELKLSVPQQYGPLKLQVFDHDMLSKDDLMGEAEIDLQPMINAAAAFGDPGLLGDRQIGRWLKSGDNALVRDSAVVVAGGEVRQELALKLQFTESGEVELEMQWFPLNM

SEQ ID NO: 20561 - protein, 338 aa, Anisodus tanguticus
MEVISNHNNGSTTKIILKNGSICNGNVNGNSHSHEKIENKLVECTNSIKPGWFSEFSALWPGEAFSLKIEKLLFQGKSDYQDVMLFESATYGKVLTLDGAIQHTENGGFPYTEMIVHLPLGSIPSPKKVLIIGGGIGFTLFEVSRYPTIETIDIVEIDDVVVDVSRKFFPYLAAGFDDPRVTLIIGDGAAFVKAAQPGYYDAIIVDSSDPIGPAKDLFERPFFEALAKALRPGGVVCTQAESIWLHMHLIKQIIANCRQVFKGSVNYAWTTVPTYPTGVIGYMLCSTEGPEVNFKNPVNSIDKDTSHVKSKGPLKFYNSDIHKAAFILPSFARDLVEF

SEQ ID NO: 20562 - protein, 322 aa, Oceanicola granulosus HTCC2516
MADRDALLAAARRVVATEAEALSILAESLGPGLAEALELVLAARGRVVVSGMGKSGHIARKVAATLASTGTPAQFVHPAEASHGDLGMLTRGDVVLVLSNSGETTELADLIAYTRRFGIPLIGVAARAASTLMRQADVRLVLPEAREACGTGVVPTTSTTMMLALGDAIAVALMEHRRFTPEMFRDFHPGGRLGARLSKVSDLMHSGDALPLAGQATPMSDALLTISQKGFGVLGVTGANGHLAGIVTDGDLRRHMDGLLERSAGDVMTPEPRTIGPGALAEEAVRVMNAQQITCLFVVDPPGSGRVVGLIHIHDCLRAGIV

SEQ ID NO: 20563 - protein, 481 aa, Populus nigra
MASATAPTTLSLLKTAAASTSTSARASLLPVSTSGLRTTSLRGLGFSAADPLFSSHVVSKIRSFKSNGRAPRAVVSMAKKSVGDLTAADLKGKKVFVRADLNVPLDENQKITDDTRIRAAVPTIKYLISKGAKVILSSHLGRPKGVTPKFSLAPLVPRLSELLGIQVVKADDCIGPEVEKLVASLPEGGVLLLENVRFYKEEEKNEPEFAKKLASMADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLAVGSSLVEEDKLDLATTLLEKAKAKGVSLLLPSDVVIADKFAPDANSKTVPASAIPDGWMGLDIGPESVKTFSEALGTTQTVIWNGPMGVFEFEKFANGTEAIAKKLAELSGKGVTTIIGGGDSVAAVEKVGVADVMSHISTGGGASLELLEGKELPGVLALDEVERVAV

SEQ ID NO: 20564 - protein, 210 aa, Acidobacteria bacterium Ellin345
MAASETPKHDDVNVPQDRVQTALSRRDWLRLTIGASAGLALGSLVDVKAVRAANESLKLSNVREFTTSCNFCSCGCGMVATVRDNKLITLEGDYDHVVNEGSLCVKGMSMFPTHASPQRNQVPRYRAPGSDHWEDITWEDAVERISQKIRKTRDTTWIANEKAGDTEVPVNRTDAIAFLGGAQNTNEECYLFQKFARLLGTAYVEHQARL

SEQ ID NO: 20565 - protein, 564 aa, Saccharomyces cerevisiae
MQSSTESDRDIQDGPDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWTLIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGIPSEESKTEKKDWKKFLKFSKGSD

SEQ ID NO: 20566 - protein, 816 aa, Acidobacteria bacterium Ellin345
MTNHWADMQHCKAILVEGSNAAENHVMAMKWIRKAQENGAIIIHVDPRFTRTSAGADIFARIRPGADAAFLNAMINHILENKLYDQDYVETHTNALMIGNADFDFKDGLFSGYDEEGHKYKTDTWGYQLDGSGKPRHATSLDDPHCVFSTLRKFFARYTLEVGERMSGIPAAQIKLIAETMAKHRPGTILYALGMTQHTTAVQGIRAFTIFQLLLGNIGKPGGGVNALRGEPNVQGACDMAVLNNYMPGYLNYPVHTEPTLAAWTVNNGSLRRKYLVNTLKAFYGDAATAENEFCYAWLPKRNSAKDYSAYGIFESALAGNMKLLWIAGQNPAVSSPNLKLVFEALGNLETLVVQELWETETAAFWKRPGVDPKSVKTEVFLLPAAFFMEKQGTITNSGAMVQWRYKAVPPPGQAKPDGEIVDIVYRRVRDLLKDSTDPKDQIVKRAFWTYTTPEDVLREINGRALHDIPGTDLKAGTLASRIADLKADGSTSSGCWIYAGVFSKGENLSKRRDHRTDPGKLGLYPNFGWTWPNNMRVLYNRASCDRHGKPYPGSKPIVWWDEEAKRWTGYDVPDVPVITDGPNTPNGQRAFHMNAEGVARLFAAVYKDPEPASDDLWRDASYVPKDGPLPEMYEPVESPVENPMHPKVRNNPMLKYPRVGSIHQPIGTAKDFPYVLMTSTVAEHWCGGSTTRNNPWLNELMPEPVCEIPEVLGSKLSVKSGDWVKVSSARGEVEVKAVVTPRMQPLQIAGQQVIIVWMPYNWGFQGLSTGPSVNHLTIDAVDPGAGTQETKACLVNVVKVRDASARRSDPRGRRA

SEQ ID NO: 20567 - protein, 542 aa, Oryza sativa (japonica cultivar-group)
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLEQFSAMNKLKKLALRVIAERLSEEEIAGLREMFKAVDTKNRGVITFGELREGLRRFGAEFKDTEIGDIMEAAHNDNNVTIHYEEFIAATLPLNKMEREEHLLAAFTYFDKDGSGYITVDKLRRACGEHNMEDSLLEEIISQVDQNNDGQIDYAEFVAMMPGSNVGLRWQTMESSLNVALRDAPQVH

SEQ ID NO: 20568 - protein, 451 aa, Neisseria gonorrhoeae
RFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 20569 - protein, 120 aa, Haemophilus influenzae
MIKCLSRLFIGNIMETLDKIKKQISENPILIYMKGSPKLPSCGFPARASEALMHCKVPFGYVDILQHPDIRAELPTYANWPTFPQLWVEGELIGGCDIILEMYQAGELQTLLAEVAAKHA

SEQ ID NO: 20570 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKVDHEFLLRGGVFSKDWIDSYIAFKEEDVRRIRMAPHPLEF

SEQ ID NO: 20571 - protein, 477 aa, Zea mays
MGGGAVNDHFPGASDPLLPTKRDGDGDEDDAGASAFHEFDGASFAGAVFNLSTTIVGAGIMALPATMKVLGLVPGLVMIVLAALLTDASIELLVRFSRAAGARSYSAAMADAFGWWGRRLLQVCVVINNVGVMIVYMIIIGDVLSGSTSGGEHHYGVLEGWFGIHWWNGRLFVLLVTTLCVFTPLACLKRIDSLSYTSTISVALAVVFVIITAGIAVIKLIGGQIPMPKLFPTVSDLASVWELFTAVPVLVTAYVCHYNVHPIHNELKDSTQIKPIVHTSLTLCSTIYITTSFFGYLLFGESTLSDVLSNFDSNLGIPYSSVLNDAVRVSYAVHLMLVFPMIFHALRLNLDGLLFASARPLSSDNRRFGIITASLLLVIFGSAIFIPSIWDAFQFTGATAAVCIAFIFPAAITLRDSQGIAKKWDKILAIFMIVLAVVSNVVAVYSDAYKIFNKESAPSNAWIGESTENRSSWWLVR

SEQ ID NO: 20572 - protein, 381 aa, Oryza sativa (japonica cultivar-group)
MAAASSPAAAITCRAAVAWAPGQALVMEEVEVAPPEAMEIRVKVVSTSICRSDVTQWQSTAQTDLFPRIFGHEASGVVESVGEGVTEFEVGDHVLTVFIGECMSCKHCVSGKSNMCQKLGLERRGVMHSDQKTRFSLRGKPVYHYCAVSSFSEYTVVHSGCAVKVGPTVPMDRICLLSCGVSAGLGAAWKVADISKGSSVVIFGLGTVGLSVAQGAKLRGASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDYINKALELMLENKCLRCVIHMPQ

SEQ ID NO: 20573 - protein, 194 aa, Triticum aestivum
  misc_feature (25)..(25): Xaa can be any naturally occurring amino acid
  misc_feature (45)..(45): Xaa can be any naturally occurring amino acid
  misc_feature (71)..(71): Xaa can be any naturally occurring amino acid
  misc_feature (75)..(75): Xaa can be any naturally occurring amino acid
  misc_feature (132)..(132): Xaa can be any naturally occurring amino acid
  misc_feature (160)..(160): Xaa can be any naturally occurring amino acid
  unsure (1)..(194): unsure at all Xaa locations
HVPSPQQVSLDLRSEILHALQKDYXLAYRYVFHAFEAFFLCDHSXPIFSLISCSVCNRTLYHADDAHETIXDDAXRPYTGPDGDATTAVMDAYSTRSLQYFEIALLNYYDLLCEDPIVHSCLSSLYHTLMQXHALHVIRGYSTLETEHVAQMIAVPAYHXVQDIVSPESLDKNYAGLLELYAVCLFSGAAMIRR

SEQ ID NO: 20574 - protein, 381 aa, Mycobacterium sp. JLS
MAHSSHADVIVIGLGGMGSAAAYHLASRGQRVLGLEKFTPAHDKGSSHGGSRIIRQSYFEDPAYVPLLLRAYDLWDRLATDSAREVYRMTGGLFIGPPDCLTVAGSLRASRQWGLDHEVLDADEIRRRYPNFTPREGDIALYEAKAGFARPEMTVQAHLDLAEHAGATLRFGEEVTGWTATADGVRVTTATGTYSAGQLVICPGAWAPQLLAEFGIPITVERQVLYWLDPVGGNEPFVEHPIFIAENERAEQIYGFPAIDGPHGGVKVAFFRKGVECTPDTIDRVVHERETREMRDEAARLLPALDGPCVHSATCMYSNTPDQHFVIARHPDSFNVTVACGFSGHGFKFVPVVGEILADLATTGATDHPIGLFDPRRLVHA

SEQ ID NO: 20575 - protein, 390 aa, Burkholderia sp. 383
MNAPSDMPTTPVFPSRLPNVGTTIFTVMSALAAEKGAVNLGQGFPDFDCDPRIVDAVATAMRNGHNQYPPMAGVAPLRDAIADKIAQVYGRRYDPATEITVTAGATQALLTAIMCTVHPGDEVIVVEPTYDSYLPSIELAGGKPVFVTLEAPDYAIPFDRLAAAITPKTRMILINTPHNPTGTVWREADMRKLEEIVRGTNVLILSDEVYEHMVYDGARHESVARYPELAARSFIVSSFGKTYHVTGWKVGYVAAPAALTAEFRKVHQFNVFTVNTPMQIGLADYLRDPAPYLTLADFYQKKRDFFRAGLERTRFKLLPCTGTYFQCVDYSAISDQPEAEFSKWLTSEIGVAAIPVSAFYHEPHESGVVRFCFAKQESTLASALERLARL

SEQ ID NO: 20576 - protein, 328 aa, Magnaporthe grisea 70-15
MDRSLDEILAERQTKNGSRGSRGPRNGGGGGGGGGGNNRRRERERQDYPRDGVRKADNAMLFSEWVHDRYDDNDSRRGGRYSRRRDDDLDKEQGSSRGTKIRVENIHYELTEEDLQGLFSRIGPIISLELLYDRSGRSEGVAYVTYESHKDATLAVKDFDGANAAGQPIRLSIIPAGVGSRRNPFDNAVKPGRPLSERITMPSGRNRSLSPEEDAARRGIDRYIPSGSRSGSPYTSGNRRDGRRPGARRERGGGGSGGGRRRGEGDEGGGQRPGRDCRTKKTQEELDAEMDDYFGGGNSNNATTAPATASTTAAPANGTVDDDIDMIA

SEQ ID NO: 20577 - protein, 604 aa, Asparagus officinalis
MLKKITGEQTLKKPEVKRSAVELIKEKSNFLRYPLNEELVTEAPNINESAIQLIKFHGSYQQYNREERRTKSYSFMLRTKNPCGKVPNKLYLAMDDLADKFGIGTLRLTTRQTFQLHGVLKKNLKTVMSTIIQNMGSTLGACGDLNRNVLAPAAPYTSKEYVFAQETAENIASLLTPQSGAYYDLWVDGEKVMSAEPPEVVKARNDNSHGTNFPDSAEPIYGTQFLPRKFKIAVTVPTDNSVDILTNDIGVVVVSDSDGEPQGFNIYVGGGMGRTHRVNATFPRLGEPLGYVPKEDILYAIKAIVCTQRDNGRRDDRRYSRMKYLINEWGIDKFRSVVEQYYGKKFEAFRKLPEWEFRSYLGWHKQDNETLFCGVHVDNGRIGGQKKKTLREIIENYNLSVRITPNQNLILCDIHHSWRDSITRALDEAGLLQPNYVDPLNLTAMACPAFPLCPLAITEAERGIPDILKRVRAVFDKIGIKDNESVVVRVTGCPNGCARPYMAELGFVGDGPNSYQIWLGGTPNQTTLAECFMNKVKIQTLEKVLEPLFYSWKMNRQQGESFGQFTIRIGFSKLQEMVEKWDGHVETPSQGIFVQVAFPTFYVR

SEQ ID NO: 20578 - protein, 567 aa, Saccharomyces cerevisiae
MSGVNNTSANELSTTMSNSNSAVGAPSVKTEHGDSKNSLNLDANEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKHIRGTLVQLYQLMGTMGIFLGYCTNYGTKNYHNATQWRVGLGLCFAWATFMVSGMMFVPESPRYLIEVGKDEEAKRSLSKSNKVSVDDPALLVEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDNRPIYKRFFSS

SEQ ID NO: 20579 - protein, 1231 aa, Magnaporthe grisea 70-15
MEDRRQSIRQSGIPRSSRLPTLRSSQSISSLRPPPSTEQTNRSNGTIHNPKLRSAPSHDRLGSLGNTTSVSAGNRKPETPSRAFRLQSKPLPPPPRSFVGPRSSSISRVPASSTSPVASEASQSSAPTATPSPPAEQPLFKRRTTLTRRPSDAAESFITPSKGRSSLDPWASSVPMDLPSMPTNFTIEEETSTNQTIKAKTPRSRPSLSERTIETLSQIPSSPANRGRRPSAFFEPGSATRSGSRPASRSSLSSRPGSSYRNEGFNRPTSRSKSQTRPGSSHRIEDAGPASFRVSTSHINNYKTQLAPINGTPPTQAKPRVVAKTTRVPAARVAGQGNAMRPPTHGKIPAPASKTLPRASISKLPEPSRTPSPEKQQVQSNENKPMAKTMPLRPPKQRPSLNGLFRKPPALAPDHQKVGATPSKVSRKTSLISHRSSTTSGDDTVQSGPSPTSTATTVDTNEPAPAATFRKSSAALREQIAKAKAAKKATTKLEVDPTKVPTVGRHPIRSPLIPTDTSFDFGLSDNPFNHQEADSGSKNKVLEGLLATARTSGRLNIAALGLREIPAQVLKMYDSEAMGINDGSWAETVDLTRFVAADNELEMIGDEVFPDKDAKAFVDDEDGQGMIFGGLETLDLHGNMLISLPMGLRRLQYLTSLNLSSNRITNGSFEVISQITSLRDLKLGGNLFYGPLDNSFTNLVNLETVDLHDNNISALPAGMEKMSKLRILNLGENNFESLPLTTLVQLPLTELVVRKNKLSGVFIDDADALFQTLQILDVSSNQLTHILPPGSSSTLAMPSLHQMCVSMNRLQELPGLSMCVNLLTLNADENSITDVPNGLTGLNKLRHVDFSSNDLRVIPPDISRMDNLNMLRLSGNPLRDKKFCSITTEELKDILAARLDPEPILDEPQATFSNLLASAAVPSPKPPATRSRMNSVPRHIEDADEVRSEMSDKFATPPTSAPQSPAARSRSHTLSSEQWTVRPGGVLDRSNTQSSALHPVSCSRVANEHSVREVQLHHNLFSIIPESLTFFSQTLVSLSLAHNQLMGESYMGDMAASGGGLKLELLALRELNLSSNHITSLAPLMSNLISPGLQKLDVSTNRIAALPSGTGLRDVFPELSVLLIANNHLADLEPEAIKGMRIVDASNNDIAHLNPRIGLLGGIENGTLERLDVMGNRFRVPRFNVLERGTEATLRFLRGRVPVAEMAAWREARGVAVSSEDCDGFDDSIIE

SEQ ID NO: 20580 - protein, 375 aa, Methanocaldococcus jannaschii DSM 2661
MISSRCKNIKPSAIREIFNLATSDCINLGIGEPDFDTPKHIIEAAKRALDEGKTHYSPNNGIPELREEISNKLKDDYNLDVDKDNIIVTCGASEALMLSIMTLIDRGDEVLIPNPSFVSYFSLTEFAEGKIKNIDLDENFNIDLEKVKESITKKTKLIIFNSPSNPTGKVYDKETIKGLAEIAEDYNLIIVSDEVYDKIIYDKKHYSPMQFTDRCILINGFSKTYAMTGWRIGYLAVSDELNKELDLINNMIKIHQYSFACATTFAQYGALAALRGSQKCVEDMVREFKMRRDLIYNGLKDIFKVNKPDGAFYIFPDVSEYGDGVEVAKKLIENKVLCVPGVAFGENGANYIRFSYATKYEDIEKALGIIKEIFE

SEQ ID NO: 20581 - protein, 762 aa, Oryza sativa
MAAAIAVVYLSLLLLLLHGAAPAVLGYTRGDFPEDFVFGSATSSYQYEGGFDEDGRSPSNWDIFTHQGKMPGRSTADVAADGYHKYKDDLKLMVDTNLEAYRLSISWSRIIPNGRGDVNPKGLQYYNDIIDGLVKNGIQVHIMLYQLDLPQVLEDEYDGWLSPRILEDFKAYADVCFKEFGDRVAHWITIDEPNVASIGSYDSGQLAPGRCSDPFGIRKCTVGNSSVEPYIAVHNMLLAHASVTKLYREKYQSCGALSRVLRPLVFGDYPQVMKNIVGSRLPSFTKAQSEDVKGSLDFIGMNHYYSLYVNDRPLGKGTRDFVADISIYYRGSKTDPPPGYGSSNDTVHDNDRVDYLKSYIGSILTALRNGANVKGYFVWSFVDVFEYLTGYGQSYGLYRVDFADESRPRQARLSARWYSGFLKNREMDVDQSKFKKNQTEFLTKFDQIFSGIWAGRPASACNLHTTTYTLMHPQETNVDESIYALHRSPYPPRGFHLPPTPPNKHYSLRFTMRAIVEELAGFGVRVHTCSRHDADLQDCLRRWNAADGGGLGGGAAAPVTASVCDVSVRGDREALVAAARAALGGRLDILVNNVGQTLFGAAAACAAEDYARIMATNLESCFHLAQLAHPLLLGAGGAAASVVNISSVAGFIAYPALSVYSATKGAMNQLTRSLAAEWARDGIRVNCVAPGGVRTDIAGSSGVALEPGAARAMEEREAARVVMGRIGEPEEVASLVAFLCMPAAPYITGQVICVDGGRTITA

SEQ ID NO: 20582 - protein, 459 aa, Mannheimia succiniciproducens MBEL55E
MLSFLNEVRKPTLDLPVEERRKMWFKPFMQSYLVVFFGYMAMYLVRKNFNIAQNDMIETYGLTKTQLGMIGLGFSITYGLGKTIVSYYADGKNTKQFVPFMLILSALCMLGFSASMGGSSIALFLMVAFYALSGFFQSTGGSSSYSTITKWTPRKKRGTFLGFWNLSHNVGGAAAAGVALFGAHVFFNGHVIGMFIFPSIIALIIGFIGLRYGSDSPEAYGLGKAEELFGEEISEEDKDAEQNQLTKKQIFVQYVLKNKVIWLLCFANIFLYIVRIGIDQWSPVYAYQELGFSKDAAISGFALFEVGALVGTFLWGYLSDLANGRRGLLACVALVLIVFTLEFYQFANNETMYLVALFALGFLVFGPQLLIGVAAVGFVPKKAIAVADGVKGTFAYLIGDSFAKLGLGMIADGTPIFGLTGWDGTFAALNSSALICIGLLAFVAIAEEKKIRRLKKAEA

SEQ ID NO: 20583 - protein, 398 aa, Rhodococcus sp. RHA1
MSIVSEFTTPQKVELTDEEIFAGHLGGKLSVELTARLDTQRDLSIAYTPGVAQVSRAIHVDETLADRYTWTSRLVVVVSDGSAVLGLGDIGPRASLPVMEGKSALFKNFAGLNSIPLVLDTKDPDEIVETLIRLRPSFGAVNLEDISAPRCFEIEKRVIEALDCPVMHDDQHGTAIVVLAALKGAVTVQDRDIHQLRVVISGAGAAGVACANILLAAGIADVTVLDSKGIVSKDRQDLNEVKVDLAARTNPAGRRGGIVEALDGADVFLGVSAGTVPEELIATMAEGSIVFALSNPDPEIHPDIARKHAAIVATGRSDFPNQINNVLAFPGVFRGALDAGARRITEGMKLAAAEAILSVVGDELAVDKIVPSPLDPRVAPAVAEAVAAAARAEGVTDR

SEQ ID NO: 20584 - protein, 380 aa, Triticum aestivum
  misc_feature (41)..(41): Xaa can be any naturally occurring amino acid
  misc_feature (185)..(185): Xaa can be any naturally occurring amino acid
  misc_feature (208)..(208): Xaa can be any naturally occurring amino acid
  unsure (1)..(380): unsure at all Xaa locations
MADAEDIQPLVCDNGTGMVKAGFAGDDAPRAVFPSIRGSPXRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAXGRDLTDYLMKILTERGYSFTTTXAEREIVRDVKEKLSYIALDYDQEMETSKTSSSVEKSYELPDGQVITIGSERFRCPEVLFQPSFIGMEAAGIHETTYNSIMKCDVDIRKDLYGNIVLSGGTTMFTGIADRMSKEITALAPSSMKIKVVAPPERKYSVWIGGSILASLSTFQQMWIAKAEYDESGPSIVHRKCF

SEQ ID NO: 20585 - protein, 250 aa, Treponema denticola ATCC 35405
MKKFYIAANWKMNMNRAEAKQLATEMKAGLKDGKNKYMIAPSFTLLQDVASVLKGSNILLGAQNMGLEEKGAHTGEVSVLQLLDVGVQAVILGHSERRHIYKETDDLINKKVKLALKHGLEVILCVGELLEEREAGHAEAVCERQIKKGLAEVSAKDLDKVTIAYEPVWAIGTGKNASPEDADAIHSSIRKTLAALYGEKAAKNMIIQYGGSMKPENAAGLLKKHNIDGGLIGGAGLKTETFLPIALFSE

SEQ ID NO: 20586 - protein, 709 aa, Candidatus Desulfococcus oleovorans Hxd3
MTDSTPPRKKRARPRRKERPPVTPSLRKKTAAKSKKPRRPALKPGSDPRLKKVFAAIGVPEQAPFSPDPFQLEALKAVRTSDCIVTAPTGAGKTWIAEQVIAAMRKEGKKTWYASPLKALSNSIYELFSGMFGPENTGILTGDRKENPNAPIIVGTTEILRNQLYDSMYSGDDLDTDFVILDEAHFLGDEDRGVVWEETMIYLPRRIPILMLSATIGNPDQIAAWLSTIRQRPCRVVKETNRPVQLYPLFLHPSGTLFPLLRESSGTGPRGLYKRMNDFIKARVQLAPAHRLPPVNEILNVLRKYNLLPAIFFMKSRADCDKALDLCDDQNRAVDPERWRWLEERIDRMVAATPYLAGHKQLLLIRDRAVAAHHSGHLPVWKKAVETFMNEGLLDAVFATSTVAAGVNFPARSVVILNSDRFNGKDFLPLSSIEFHQMTGRAGRRGKDNIGFAVMVPGKFMDLKHVAQVADAPASDIYSQIKINFSMVLNLLLSHTPDQVKTLLNQSFALFQRTQRGMAADNVLWDDFIRHLDFLKDTGFADEAGRLTDDGIWASNLRVDHPLMIAEGFRLSLFPEDDPALLAAVVAAFVNERQVVDSPAVEHAAPKSLRRVFNSLKHAMTPFTRHMKKRGFEPTDLFLAPAVTMHQWATDMDWEDVVFRTGSEEGDLANLVFRAADNLRHIATLTDIFPRAAQSAREGVDLIVREPLV

SEQ ID NO: 20587 - protein, 329 aa, Candida albicans SC5314
MGTMSEDSELIEQVIEQPDSLIISPPSDSSSSSYNHIQPFVYLESTATTQTNHNVLLILNQKITIDLISLWKKCEIIVCADGGANSLYEYFNDNNHHHHHENLQRSDYIPDYIVGDFDSISPDVKTYYESHGSKIIRQSSQYYNDFTKSIHCIQLHYQLNHTKENWFESIDEVDGLAKLWNGLNNSSDVVVDIDITIYVLNAIGGRFDQTVQSINQLYIMNEDYPKVTVFFITTNDIIFLLKKGVNYISYKNRLMFHKDNGSSPTPTCGLLPLSNKTPIILNSYGLKYDMRNWKTEMLGQVSSSNRISGETGFIVECSDDIVMNIEIDV

SEQ ID NO: 20588 - protein, 384 aa, Oceanicola granulosus HTCC2516
MSKRDYYEVLGVSKGASADEIKKAFRRKAKELHPDSNADNPNAEAQFKEANEAYDCLKDPEKKAAYDRFGHAAFEGMGAGGGGRRPGGAGQQDFASAFSDVFDDLFGDFMGGRPGAGGGRQRATRGSDLRYNLRVTLEEAYNGLQKTITVPTAVQCGTCHGTGAEGGVEPQTCPTCSGMGKVRAQQGFFTVERTCPTCNGAGQTVKNPCHTCHGAGRVEKERSLSVNIPAGVETGTRIRLAGEGEAGLRGGPAGDLYIFIEVREHELFQRDGSHLFCRVPVSLAKAALGGDIEVPSIDGGRSRVKIPEGSQTGRQMRLRGKGMPALRGGGHGDMFIELAVETPVNLTGRQKELLREFERLSEENNPQSSSFFSAVKSFWDGMKG

SEQ ID NO: 20589 - protein, 925 aa, Silicibacter pomeroyi DSS-3
MADGAHVEMVSFTLNGEEVTVPEGLTIWEAAHGRGLVIPHLCHKPDPGYRPDGNCRACMVEVAGERTLVASCIRPVAEGMVVTTDSARAEGARKMVVELLLADQPEVAHDASSHFHAMAGLNGVSESRFPAKTPDSVPLLDASHVAMRVNLDACINCNLCVRACREVQVNDVIGMAGRGAGAQVVFDQNDPMGASTCVACGECVQACPTGALMPATVLDAEQAGDSKDYDREVTSVCPFCGVGCQLSFKVKDNKIKYVTGVDGPANESRLCVKGRFGFDYIDHPHRLTKPLIRRADAPKGLNVDPGNPLSHFREASWEEALDFAARGLADLRAQKGSYVAGFGSAKCSNEEAYLFQKLIRQGFGHNNVDHCTRLCHASSVSALLENVGSGAVTATFNEIENADVAIVIGCNPIENHPVAATYFKQFTKRGGKLIVCDPRGVGMGRFATHRLQFKPGADVSMLNAMMHVIVEEGLYDQAYIDQFTENWEEMKAHLADYSPEKMEPICGIAAGELRDAARTFAAGKAGMIFWGMGVSQHIHGTDNSRCLISLALMTGNVGKPGAGLHPLRGQNNVQGASDAGLIPMFLPDYQSVTDDGVRSAFTSVWNSGDFSNQKGLTVVEIMHAIHDGDIRGMYILGENPAMSDPDVDHARAALAMLEHLVVQDIFLTETANYADVILPASAWAEKTGTVTNTNRQVQMGRPAVAPPGQAKEDWWIEVELARRLGLDWNYSHPSEVFAEMKRNMKSLDNITWARLEGEAVTYPSLSPEDPGQAIVFGDGFPRANKRARFTPAKIVEPDERPDADYPFVLITGRQLEHWHTGSMTRRASVLDAVEPEANCSMHPATLRAMGIEPGDMIRLTTRRGSVQVMVRADRAIAQDNVFLPFAYVEAAANILTNAALDPYGKIPEFKYAAVKVEKAEALAAE

SEQ ID NO: 20590 - protein, 162 aa, Burkholderia sp. 383
MSAIQHFFKTFFLTELLQGLALTGRYTFKRKVTVQFPEEKTPISPRFRGLHALRRYENGEERCIACKLCEAVCPAMAITIESETRADNTRRTTRYDIDLTKCIFCGFCEESCPVDSIVETQILEYHGEKRGDLYFTKEMLLAVGDRYEKDIAAAKAADAPYR

SEQ ID NO: 20591 - protein, 422 aa, Robiginitalea biformata HTCC2501
MTFEQLELAEPILRALKKENYSRPTDIQAQAIPHVLNRRDVMGSAQTGTGKTAAFAIPILQHLERDRRYGGKRGVVNALIVTPTRELAIQIGESLTAYGHYTGIRNTVIFGGVKQGKQVEALRRGVDILVATPGRLLDLMDQGIISLSKVEYFVLDEADRMLDMGFIHDIRKIIARLPAERQSLFFSATMPDDIVSLSRKILSDPVKVAVSPVSSTAETIRQYLYYTNKSDKNDLLLHILKDPDMDQVLLFARTKHGADRIVKNLGKKKISAAAIHGNKSQNQRQKALGQFKDGKVRVLVATDIAARGIDIDQLRYVVNFDIPNVAETYVHRIGRSGRAGEEGVSISLCEPEENAYIRDIEKLIDLKIERVEDHPFPQTERPMTAAEKQEFEKEKQRRKQEYFASRKRGGGGQGRQNRGRRR

SEQ ID NO: 20592 - protein, 1070 aa, Listeria monocytogenes str. 4b H7858
MPKRDDIKTILVIGSGPIVIGQAAEFDYAGTQACLSLKEEGYRVVLVNSNPATIMTDAEMADKVYIEPITLDFVSRIIRKERPDAILPTLGGQTGLNMAMELSAAGILDECNVEVLGTDLTAIKKAEDREAFRDLMNELGEPVPESDIIHNLDEAYTFVERIGYPVIVRPAYTLGGSGGGICHNEQELIETVTSGLKLSPVTQCLLEKSIAGFKEVEYEVMRDANNNAMVVCNMENIDPVGIHTGDSIVVAPSQTLSDREYQLLRDVSLKIIRALEIEGGCNVQLALDPDSYNYYVIEVNPRVSRSSALASKATGYPIAKLAAKIAVGLTLDEVRNPVTGTTFAHFEPTLDYVVAKIPRFAFDKFEQADRRLGTQMKATGEVMAIGRSWEEALLKAVRSLEIGADHLLLEEAENADEATLERKICFPEDDRLFFLAAALRRGQTIEQLHAKTKIDLFFLYKLSKTIELENRIKENPQNQEILAEAKRAGFSDAFLATCWNVDEQAIYDLRKAQNLFPVYKMVDTCAAEFESTTPYFYSTYEEENESTRSAKESVIVLGSGPIRIGQGVEFDYATVHSVWAIQQAGYEAIIINNNPETVSTDFSISDKLYFEPLTLEDVMHVIEIEQPLGVVVQFGGQTAINLADGLAKRGVKILGTSLEDTDRAENRDAFEKALEILQIPQPAGKTATSVEEAINVATDIGYPVLVRPSYVLGGRAMEIVESEEALKHYMTNAVKVNPKHPVLVDRYVSGQEVEVDAISDGENVLIPGIMEHIERAGVHSGDSIAVYPAQRLSSQVKNTIVDYTTRLATGLNIIGMLNIQYVVDGEEVFVIEVNPRSSRTAPFLSKITEIPMANVATRVILGENLIDLGYTPGLAPEKQEIFVKVPVFSFAKLRSVDTSLGPEMKSTGEVMGKDVTLEKALYKGFVASGTTMHDYGTVLLTVADRDKEEAVELAKRFNRIGFTIMATKGTASTLEEADIPVSQVKKIGENQETLIDYIRNGQVTLVVNTLTTGKRPERDGFQIRRESVENGIPVCTSLDTAEAILRVLESRSFELESMNTSEVKQPKARV

SEQ ID NO: 20593 - protein, 609 aa, Phaseolus vulgaris
MESSVNGVDSLSEVQNSVSGVHHHDPLPSGTPQPSRPPLRASRNYDGGHQTKAIHHHNSHVINQKHSHQEGKTLKQEGLPTKLSSKQPPLDDSKGCEPNGVLESEKKRVVDNHGKNYSQPDATFCASPQNSFYSATVYSEAKESFTNTEVSECASVDKSCESEVANSSDFNESRKTSICRASTGSDASDESSTSSLSSVLYKPHKANDIRWEAIQAVRTRDGMLEMRHFRLLKKLGCGDIGSVYLAELSGTRTSFAMKVMNKTELANRKKLLRAQTEREILQSLDHPFLPTLYTHFETEIFSCLVMEFCPGGDLHALRQRQPGKYFSEHAVRFYVAEVLLSLEYLHMLGIIYRDLKPENVLVREDGHIMLSDFDLSLRCSVSPTLVKSSNNLQTKSSGYCVQPSCIEPTCVMQPDCIKPSCFTPRFLSGKSKKDKKSKPKNDMHNQVTPLPELIAEPTNARSMSFVGTHEYLAPEIIKGEGHGSAVDWWTFGIFLYELLFGRTPFKGSANRATLFNVIGQPLRFPESPTVSFAARDLIRGLLVKEPQHRLAYRRGATEIKQHPFFQNVNWALIRCATPPEVPRQVINLPQTEKDLGVKPSGNYLDIDFF

SEQ ID NO: 20594 - protein, 294 aa, Aeropyrum pernix K1
MARGREAVTLLLVGWGYAPGMQTLEALDAVRRADVVYVESYTMPGSSWLYKSVVEAAGEARVVEASRRDLEERSREIVSRALDAVVAVVTAGDPMVATTHSSLAAEALEAGVAVRYIPGVSGVQAARGATMLSFYRFGGTVTLPGPWRGVTPISVARRIYLNLCAGLHTTALLDVDERGVQLSPGQGVSLLLEADREYAREAGAPALLARLPSVLVEAGAGGGHRVLYWSSLERLSTADVEGGVYSIVIPARLSGVEEWLLAAASGQRRPLEYDRSVYETVEENCKKGVYMEPV

SEQ ID NO: 20595 - protein, 492 aa, Zea mays
  misc_feature (201)..(201): Xaa can be any naturally occurring amino acid
  misc_feature (212)..(212): Xaa can be any naturally occurring amino acid
  misc_feature (252)..(252): Xaa can be any naturally occurring amino acid
  misc_feature (272)..(272): Xaa can be any naturally occurring amino acid
  misc_feature (293)..(293): Xaa can be any naturally occurring amino acid
  misc_feature (305)..(305): Xaa can be any naturally occurring amino acid
  misc_feature (323)..(323): Xaa can be any naturally occurring amino acid
  misc_feature (350)..(350): Xaa can be any naturally occurring amino acid
  misc_feature (386)..(386): Xaa can be any naturally occurring amino acid
  misc_feature (414)..(414): Xaa can be any naturally occurring amino acid
  misc_feature (431)..(431): Xaa can be any naturally occurring amino acid
  unsure (1)..(492): unsure at all Xaa locations
MGQKINPLGFRLGTTQNHHSFWFAQPKNYSEGLQEDKKIRNCIKNYIQKNRKKGSNRKMESDSSSEVITHIEIQKEIDTIHVIIHIGFPNLLKKKGAIEELEKDAAAAQSASAFPSPPAPVSLSLSLSLSRSRVHLAAASKRDQMAPLGDGGAAAAAASNNLVVSFGEMLIDFVPDVAGLSLAESGGFVKAPGGAPANVAXCAIAKLGGSSXAFVGKFGDDEFGHMLVNILKQNNVNSEGCLFDKHARTALXAFVTLKHDGEREFMFYRNPXSADMLLTEAELDLGLVAARQXVFHYGSISLISXEPCRSAHMAAMRAAKAAXGVLCSYDPNVRPPALARRPTPAREGIXLSIWKEADFIKVSDDEVAFLTRGDANDEKNVLSLWXFDGLKLLVVTDGDKGCRYFTKDFKGSVXPGFKVDTVDTTGAGDAXFVGSLLVNVAKDDSIFHNEEKLPRGPSSSPTACGAICTTKKGAIPALPTVATAQDLIAKAN

SEQ ID NO: 20596 - protein, 370 aa, Bacillus halodurans C-125
MSKRDYYEVLGVDRNASADEVKKAYRKLARKYHPDVNKAPDAEDKFKEVKEAFDTLSDPQKKAHYDQFGHTDPNQGFGGGGAGDFGGFSDIFDMFFGGGGGRRNPNAPRQGADLQYTMTLEFKEAVFGKETTIEIPREETCHTCSGSGAKPGTKPESCPHCGGSGQLNIEQNTPFGRVVNRRVCHHCEGTGKYIKHKCATCGGKGKVRKRKKINVKVPAGIDHGQQIRLSGQGEAGVNGGPAGDLYIVFNVKPHEFFERDGDDIYCEMPLTFVQVALGDEIEVPTLNGKVKLKIPAGTQTGTSFRLRGKGVPNVHGRGQGDQHVQVRVITPKQLSEKEKELLREFAQMSGGRPDEQDDSFFAKVKRAFKG

SEQ ID NO: 20597 - protein, 100 aa, Arabidopsis thaliana
  misc_feature (62)..(62): Xaa can be any naturally occurring amino acid
  unsure (1)..(100): unsure at all Xaa locations
EKQHEEGKDQSMFSTTDVVTYPAQATMVTPFTGSKRYGYLPVTRKVNNHITCITSNIGRVKXIESWTPIKKNKVETLYNLPDLNDGELAKEECFVTGNKW

SEQ ID NO: 20598 - protein, 424 aa, Mannheimia succiniciproducens MBEL55E
MNTTFSPEINRTYRYWRIHLMIAMYIGYAGFYLTRKSFNFAVPEMINNLGIDKNDIGMMATLFYITYGVSKFFSGIFSDKSNPRHFMAVGLIMTGVANIFFGLSSSVLIFTAVWIINAWFQGWGWPACSKLLTTWYSRNERGRWWSIWNTAHNAGGALIPLLIGYVTIHYSWRYGFAIAGIVAISIGLFLFWRLRNTPESLGLPSIGHWRNDELELAQEAEAPNLSWRETLNRYVFLNKYIWLLALSYTLVYIVRTAINDWGNIYLTEKYHYDLVSANSALAVFEIGGFFGSLVAGWGSDRLFSSNRGPMALIFAIGIFFSITALWLLPTENYILQTALFFVVGFFVFGPQMLIGMAAAECSHKKTPGSATGFVGLFAYLGAAIAGYPLALIMQHFHWTGFFVFIACSASGIALLLLPFLKAQN

SEQ ID NO: 20599 - protein, 418 aa, Mycobacterium leprae TN
MSPDKREFDIVLYGATGFSGKLTAEHLALSESTARIALAGRSSERLRNVRALLGPNAQDWPLIVADASQPSTLEAMAGRAQVVLTTVGPYTRYGLPLVAACARTGTDYADLTGELMFCRNSIDLHHKQAAATGARIILACGFDSVPSDLNVYQLYRRVIEDRTGELCDTDLVLRSFSQRWVSGGSVAAYSEAMLTTSNDPEALRLVTDPYTLTTDRDAEPDLGPQPDFPRHRGSDLAPELAGFWTGGFVQAQFNTRIVRRSNALQNWSYGRQFRYSETMSLGKSWAAPVASAAVTSVVAGAVGLGNKYFNRLPRRVVERVTPKSGTGPSRKTQARGHYTFETYTTTTTGARYMATFAHNVDAYKSTAGLLAASGLTLALDRDRLSELRGVLTPAAAMGEALLTRLPSAGVVIGTTRLS

SEQ ID NO: 20600 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFKPPGCEESGKA

SEQ ID NO: 20601 - protein, 398 aa, Arabidopsis thaliana
  misc_feature (230)..(230): Xaa can be any naturally occurring amino acid
  misc_feature (362)..(362): Xaa can be any naturally occurring amino acid
  unsure (1)..(398): unsure at all Xaa locations
MNLLLYIKRFISNFKPTTETINTHQKIFLLFYPTPFKTNQRNYHMDPYPYSHGSGFVNLLTSQQEVHTLETNPCDDVPIFSTQCTDSPSLEEHVPKVKRERMKWSAKEDMVLVSSWLNTSKDAVIGNEQKANTFWSRIAAYYDASPQLNGLRKRMQGNIKQRWAKINDGVCKFVGSYEAASREKSSGQNDNDVISLAHEIFNNDYGYKFPLEHAWRVLRHDQKYELALRXSSQASVMSKRRKCDKAAQPSTSQPPSHGVEEAMSRPIGVKAAKAKAKKTVTKTTTVEDKGNAMLEIQSIWEIKQKDWELRQKDREQEKEDFEKKDRLSKTTLLESLIAKKEPLTDNEVTLKNKLIDFLLEHXLSLYVVFLLHFSLCLSVAFQLMLCLSVVSNFISTCM

SEQ ID NO: 20602 - protein, 359 aa, Zea mays
  misc_feature (47)..(47): Xaa can be any naturally occurring amino acid
  misc_feature (88)..(88): Xaa can be any naturally occurring amino acid
  unsure (1)..(359): unsure at all Xaa locations
MMSKEAVVNAFLGCFMHVGLALVLAVYLPVAFVCRLLHRLLVRPLRXGEDLRGKVILVTGASSGIGEHLVYEYARHGACVALVARTEXRLRAVAKAARDLGAPDVLVVPADVTKVDDAKRAVEETVAHFGKLNHLVANAGIWSSCFFEEITNITAFHNVIDLNFWGAVYPTYFALPYLKASRGNIVVTASVAGRVPTARMSFYNASKGAVIRFYETLRAELGSHVHVTILTPGYVVSNLTKGKGLQKDGHVGIDEEARDINVGPMPVGKTESLAEVVVASVRRRDYYVTWPGWYWPFHMVMCAAPELVDWFSRTFYVSKSGDQDGGGGALSKKILEAVGGKKFLYPQTIRSQTAMAANN

SEQ ID NO: 20603 - protein, 884 aa, Arabidopsis thaliana
MESHRVFVATFMLILHLVQAQDQPGFINVDCGLLPRDSPYNALGTGLVYTSDVGLVSSGKTGKIAKEFEENNSTPNLTLRYFPDGARNCYNLNVSRDTNYMIKATFVYGNYDGHKDEPNFDLYLGPNLWATVSRSETVEEIIHVTKSDSLQVCLAKTGDFIPFINILELRPLKKNVYVTESGSLKLLFRKYFSDSGQTIRYPDDIYDRVWHASFLENNWAQVSTTLGVNVTDNYDLSQDVMATGATPLNDSETLNITWNVEPPTTKVYSYMHFAELETLRANDTREFNVMLNGNDLFGPYSPIPLKTETETNLKPEECEDGACILQLVKTSKSTLPPLLNAIEAFTVIDFLQVETDEDDAAAIKNVQNAYGLINRSSWQGDPCVPKQYSWDGLKCSYSDSTPPIINFLDLSASGLTGIIAPAIQNLTHLEILALSNNNLTGEVPEFLADLKSIMVIDLRGNNLSGPVPASLLQKKGLMLHLDDNPHILCTTGSCMHKGEGEKKSIIVPVVASIVSLAVIIGALILFLVFRKKKASKVEGTLPSYMQASDGRSPRSSEPAIVTKNKRFTYSQVVIMTNNFQRILGKGGFGIVYHGFVNGVEQVAVKILSHSSSQGYKQFKAEVELLLRVHHKNLVGLVGYCDEGENMALIYEYMANGDLKEHMSGTRNRFILNWETRLKIVIDSAQGLEYLHNGCKPLMVHRDVKTTNILLNEHFEAKLADFGLSRSFPIGGETHVSTVVAGTPGYLDPEYYKTNRLTEKSDVYSFGIVLLEMITNRPVIDQSREKPYISEWVGIMLTKGDIISIMDPSLNGDYDSGSVWKAVELAMSCLNPSSTRRPTMSQVLIALNECLVSENSRGGASRDMDSKSSLEVSLTFDTDVSPMAR

SEQ ID NO: 20604 - protein, 417 aa, Burkholderia sp. 383
MAEIKNYTLNFGPQHPAAHGVLRLVLELDGEVIQRADPHIGLLHRATEKLAESKTFIQSVPYMDRLDYVSMMVNEHGYVLAIEKLLGIEVPERAQYIRVLFDEITRVLNHLMWIGAHALDVGAMAVFLYAFREREDLMDVYEAVSGARMHAAYYRPGGVYRDLPDAMPQYKASKIRNEKALAKMNEARSGSVLDFIDDFFARFPKCVDEYETLLTDNRIWKQRLVGIGVVSPERALQMGLTGPMLRGSGIAWDLRKKQPYEVYDRMDFDVPVGVNGDCYDRYLVRVEEMRQSIRIAKQCIEWLRKNPGPVMTDNHKVAPPSRVGMKTNMEDLIHHFKLFTEGFHVPEGEAYAAVEHPKGEFGIYLVSDGANKPYRLKIRAPGFAHLASLDEMARGHMIADAVTIIGTQDIVFGEIDR

SEQ ID NO: 20605 - protein, 127 aa, Zea mays
  misc_feature (32)..(32): Xaa can be any naturally occurring amino acid
  unsure (1)..(127): unsure at all Xaa locations
KPGEFIQPSGGTSKHPGPAMASHEHHHYHSHXDHHHQSHGDCGGHADGGSWAGEDGRVRHSHDGTAPNFHEHIHIRRRLHQACAGTWTKATSMSEPLQSALARPRRLRENCPKASTGPTSTRQVYQC

SEQ ID NO: 20606 - protein, 517 aa, Oryza sativa (japonica cultivar-group)
MAFLFPSLLLPWLPWLLGSLLSVYLLDLLAHSRRRLPPGPRPLPFIGSLHLLGDQPHRSLAALAMAYGPLMSLRLGAVTTVVASSPAVAREILHRHDAAFASRSSPDSTGDHARSSVAWLPSSAPRWRALRRIMATELFAPHRLDAAAPRPLRREKVRELVAHVARLAAGEGGKPAVVDVGRVAFATSLNLLSRTIFSRDLTSLDDHGGSKGFQEAVARIMEAGGRPNVSDFFPVLAAADLQGWRRRLARLFARLHRVFDAEVDARLREHDAGEARKGDFLDVLLGIAARRDDAAELDRDTLRSLFTDLFCAGSDTSSSTVEWAMAELMQNPKSMSRVCDELSQVIGLGRNIKESEIGQLPYLQAVVKETFRLHPPAPLLLPRQAEMTMKIAGYTIPKGTRIFVNVWAMGRDKDIWPEPEKFIPERFLGSKIDFKGVHFELIPFGAGRRICPGMPLANRMVHLILGSLLNQFKWNLPVKVERNGIDMSEKFGLTLAKATPLCALVTPISVKPADHQE

SEQ ID NO: 20607 - protein, 251 aa, Burkholderia sp. 383
MSKQRTKRVIGNWKMHGRLAGNQALLNEVVQGAGAVAAETSIGVCVPFPYLAQVQAQLDGGRVAWGAQDVSAHEQGAFTGEVAAAMVAEFGARYAIVGHSERRAYHGERNETVAAKTQRALAAGLTPVVCVGETLDERESGATEQVVGAQLDAVLAVLTADEATRIVVAYEPVWAIGTGKSATSAQAQDVHAFLRARLAAKGAADVSVLYGGSVKPDNAEELFAQPDIDGGLIGGASLKAEDFLAICRAAR

SEQ ID NO: 20608 - protein, 583 aa, Arabidopsis thaliana
MASQLDLIGGDYIAGISINPPTNSRVTSVYSEVQASRIDHTLPLPSVFKTPFKIIDGPPSSSAGHPEEIEKLFPNLFGQPSALLVPNQSNEVSSDQKLKIGVVLSGGQAPGGHNVICGIFGFKNLICDCIFVVGLIDYLQEYARGSSLFGFRGGPAGIMKGKYIELTSEFVYPYRNQGGFDMICSGRDKIETPEQFKQAEETVTKMDLDGLVVIGGDDSNTNACLLAEHFRAKNMKTLVIGCPKTIDGDLKSKEVPTSFGFDTACKVKMIGNVMIDARSTGKYYHFVRLMGRAASHITLECALQTHPNITIIGEEVFEKKLTLKNVTDNIVDVIYKRAENGYNYGVILVPEGLIDFIPEVQQLISELNEVLAEGNVDEEGQWKKNLKKETLEIFEFLPQTIQEQLMLERDPHGNVQVAKIETEKMLIQMVETELEKKKTEGTYEREFMGKSHFFGYEGRCGLPTNFDATYCYALGYGAGSLLQSGKTGLISSVGNLAAPVEEWTVGGTALTSLMDVERRHGKFKPVIKKAMVELEGAPFKKFASQREEWALKNRYISPGPIQFKGPGSDARNHTLMLELGAQA

SEQ ID NO: 20609 - protein, 478 aa, Saccharophagus degradans 2-40
MKTEFDEDWLEWINTNVNNGQDKNGIFKILLDEGYAFEAIERVMNFRPTVPVDQLINPFKRAASPQQTVNNQNLQTAANHGAPTDPRKIFIPNALKLNSDKLEMYALGEFLTTEECERIIANIRSKLRPSELSSQESDKTYRTSRTCDLGTIDDPFIHYVDSRICKLVGIDPSYSEVIQGQLYEVGQEFKAHTDYFEIKEMPEHGAVMGQRTYTVMIYLNDVEEGGETDFPAADGAIKPRAGLALIWNSLQSNGAPNPHSMHQAYPVLKGHKAVITKWFRSQSRLPNAPPMYSKEANEYIPNYTASGLHKSTLNPALFQKLTQFYTDNKQQLTEEHVPGDFIENASKTCKKSSSLIDLSDELRQAVHDELKPKMEAWCNQPLAPTYVYGIREYHRGAKLKMHRDRLETHIISAIINIAQDVDEDWPLVIEDNAYRVHHILLKPGEMVFYEGGRLLHGRPIPFNGDSFANIFCHFKPES

SEQ ID NO: 20610 - protein, 473 aa, Mycobacterium avium subsp. paratuberculosis K-10
MRHYYSVDAIRAAEAPLLASLPDGALMRRAAFGLATEIAAELTARTGGVAGRRVCAVVGSGDNGGDALWAATFLRRRGAAADAILLNPERAHRKGLAAFGKAGGRIVESVSPTTDLVIDGVVGISGSGALRPAAAEVFAAVDDAGIPVVAVDIPSGIDAATGATSGPAVHAVLTVTFGGLKPVHALGDCGRVKLIDIGLDLPQTDVLGFEAADVAARWPVPGPHDDKYTQGVTGVMAGSATYPGAAVLCTGAAVAATSGMVRYAGSAHREVLAHWPEVIASPTPASAGRVQSWVVGPGLGTDDAGAAALWFALETDLPVIVDADGLTMLAAHPELVANRAAPTVLTPHAGEFARLAGSPPGDDRVGATRKLADTLGVTVLLKGNVTVIADPGGPVYLNPAGQSWAATAGSGDVLSGMIGALLASGLPAGEAAAAAAFVHARAAALSAADPGPGEAPTSSSRMVPHIRAALAAL

SEQ ID NO: 20611 - protein, 463 aa, Mycobacterium avium subsp. paratuberculosis K-10
MPQHPSLPAHAIAPAYTGRLFTAPVPALRMPDESMDPDAAYRFIHDELMLDGSSRLNLATFVTTWMDPEAGRLMAETFDKNMIDKDEYPATAAIEQRCVCMVADLFHAEGLNDADPYSACGVSTIGSSEAVMLGGLAMKWRWRAKTKDWKKRTPNLVMGSNVQVVWEKFCRYFDVEPRYLPMEEGRYVITPEQVVDAVDEDTIGVVAILGTTYTGELEPVADICGALDKLALKPASAGGVDVPVHVDAASGGFVVPFLHPELKWDFRLPRVVSINVSGHKYGLTYPGVGFVVWRSKEYLPDELVFRVNYLGGDMPTFTLNFSRPGNQVVGQYYNFLRLGREGYTKVMQTLSGTARWLGEQLRVSEHCELISDGSAIPVVAFRLAKNRGYTEFDVSHELRTYGWQVPAYTMPDNATDVSVLRIVVREGLSADLARALHDDAVSALTSLDKVKPGGHYDAQHFAH

SEQ ID NO: 20612 - protein, 251 aa, Saccharophagus degradans 2-40
MGVKSKIVIGNWKMNGSAELVESFTRTMLDNQAAYAGIRVVLCPPFTLLQAMADALEGGPILLGAQNVSEFEQGAHTGEISAPMLASMGTKMVIIGHSERRASRGENDRIIAAKVKQALSVGMLPVLCVGETAEEKARGDSGAVVWQQLSVVLHAIGSELFGQLIVAYEPIWAIGSGSTASTDDILTITTAIHAKLAQLGIQLPLLYGGSVNAGNAAQISSLPTISGLLVGGASLQAGQFLLLCSNTAKGA

SEQ ID NO: 20613 - protein, 313 aa, Neisseria lactamica
MTKHIAILRGDGIGPEIVAETVRVLDKLIEQGLDAGYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEREGYNTMKYSESEIRRIAHVAFQSAQKRSKKVCSVGKANVLETTELWREIFEEIGKEYPDVELSHMYVDNAAMQLVRAPKQFDVIATGNIFGDILSDEASMLTGSLGMLPSASLDENGKGLYEPSHGSAPDIAGQNKANPLATILSLAMLLRYSLNDEA

SEQ ID NO: 20614 - protein, 341 aa, Neisseria gonorrhoeae
MGIKVAINGYGRIGRQVLRSIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 20615 - protein, 121 aa, Saccharomyces cerevisiae; identical to SEQ ID NO: 1100

SEQ ID NO: 20616 - protein, 582 aa, Lotus japonicus
MSSSFSIRFLAPPFPSTSRPKSCLSAATPAVAPTDAAVSRLEPRVEERNGYWVLKEEHRGGINPQEKVKLEKEPMALFMEGGIDELAKVSIEELDSSKLTKDDVDVRLKWLGLFHRRKHQYGRFMMRLKLPNGVTTSAQTRYLASVIRKYGKDGCADVTTRQNWQIRGVVLPDVPEILKGLAEVGLTSLQSGMDNVRNPVGNPLAGIDPDEIVDTRPYTNLLSHFITANSRGNPTVSNLPRKWNVCVVGSHDLFEHPHINDLAYMPANKDGRFGFNLLVGGFFSPKRCAEAIPLDAWVSAEDVIPVCKAILEMYRDLGTRGNRQKTRMMWLIDELGIEVFRSEVEKRMPLGQQLERASQEDLVQKQWERRDYFGANPQKQEGLSYVGIHIPVGRIQADEMDELARLADEYGTGELRLTVEQNIIIPNVENSKLSALLNEPLLKEKFSPEPSLLMKTLVACTGSQFCGQAIIETKARALKVTEEVERLVAVTRPVRMHWTGCPNTCGQVQVADIGFMGCMARDENGKPGEGVDIFLGGRIGSDSHLAEVYKKAVPCKDLVPIVADILVKHFGAVQRNREEGDD

SEQ ID NO: 20617 - protein, 341 aa, Neisseria gonorrhoeae
MGIKVAINGYGRIGRQVLRSIYDYQIQDQLQIVAVNASGSLETNAHLTKFDTVHGRFEADVSHDGGNLIVNGDKIPFFSTRNPTELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 20618 - protein, 538 aa, Arabidopsis thaliana
MAARRVSSLLSRSFSASSPLLFRSQGRNCYNGGILRRFGTSSAAAEEIINPSVQVSHTQLLINGNFVDSASGKTFPTLDPRTGEVIAHVAEGDAEDINRAVKAARTAFDEGPWPKMSAYERSRVLLRFADLVEKHSEELASLETWDNGKPYQQSLTAEIPMFARLFRYYAGWADKIHGLTIPADGNYQVHTLHEPIGVAGQIIPWNFPLLMFAWKVGPALACGNTIVLKTAEQTPLTAFYAGKLFLEAGLPPGVLNIVSGFGATAGAALASHMDVDKLAFTGSTDTGKVILGLAANSNLKPVTLELGGKSPFIVFEDADIDKAVELAHFALFFNQGQCCCAGSRTFVHEKVYDEFVEKSKARALKRVVGDPFRKGIEQGPQIDLKQFEKVMKYIKSGIESNATLECGGDQIGDKGYFIQPTVFSNVKDDMLIAQDEIFGPVQSILKFSDVDEVIKRANETKYGLAAGVFTKNLDTANRVSRALKAGTVWVNCFDVFDAAIPFGGYKMSGNGREKGIYSLNNYLQIKAVVTALNKPAWI

SEQ ID NO: 20619 - protein, 556 aa, Aspergillus nidulans FGSC A4
MSLAQNHYIIQLPQTPLLHRAPEPRSIAQKWITEFEVLLRTNDFSKLPQLFHEDSWWRDLLCLTWDFHTIQNLSGITAFLTENQPRARLFGFRLQHEGKFQPGLEHPAPGLTWISTIFFFETGTGRGSGVFRLTQDKEGVWKAYAIYTSLQELKGMEEPLGFRRVYGTTETMPGGLARGTWIERRTRQILFDEEEPTALIVGAGQAGLNVGARLQSLGVSCLIVDRHERIGDNWRKRYRTLVTHDPVEFTHMAYLPFPKNWPEFTPKDKLGDWFEAYASIMELNVWTKTSVTGATYDEAKKEWAVTITRGDGSERVLRPRHLVWCTGHSGEPLVPTFPDQEKFKGTIYHATKHQDASTSLANNPSPPTEECDLIAESLPYPVRFALDVHFTKRAFEAEKDLMMGLQKAGFELDHGIDGAGISRAYMTRGGGYYIDVGCSQLIADGKVKVRRSPDGIAGFTERGLVLKDGGVLESDIVVLATGYDNMRTTVRKTLGDKIADRLRDVWDLDEEGELNSMWRPSGQPGFWYMGGNLALCRIYSKFLALQIKAVEAGLVD

SEQ ID NO: 20620 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 20621 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGILGYNTLPLVSMDFNHTTEASHFDATLTKVVDGNMVKVFAWYDNEWGFSCQMLNTARRMFGLEVRP

SEQ ID NO: 20622 - protein, 274 aa, Methanocaldococcus jannaschii DSM 2661
MMIVYKGEKMQFIRVNTLKINPEVLKKRLENKGVVLEKTFLDYAFEVKKSPFSIGSTPEYLFGYYMPQSISSMIPPIVLNPREDDFILDMCAAPGGKTTHLAQLMKNKGTIVAVEISKTRTKALKSNINRMGVLNTIIINADMRKYKDYLLKNEIFFDKILLDAPCSGNIIKDKNRNVSEEDIKYCSLRQKELIDIGIDLLKKDGELVYSTCSMEVEENEEVIKYILQKRNDVELIIIKANEFKGINIKEGYIKGTLRVFPPNEPFFIAKLRKI

SEQ ID NO: 20623 - protein, 554 aa, Mycobacterium leprae TN
MTSMQAIPDITATPAWDALRRHHDEIGATHLRQFFADNPNRGRELVITVGDLYIDYSKHRITHDTVQLLVDLARAANLEQRRDQMLAGVHVNTSENRSVLHTALRLPRDTELIVDGQNVVQDVHAVLDVMGDFTDRLRSGEWTGATGKRINTVVNIGIGGSDLGPVMVYQALRHYADAGISARFVSNIDPADLTAKLSDLEPGTTLFIVASKTFSTLETLTNATAARRWLTDALGEAAVSKHFVAVSTNKRLVKDFGINTANMFGFWEWVGGRYSVDSAIGLSLMAVVGRESFADFLSGFHIVDQHFQNAPLESNAPVLLGLIGLWYSDFLGAQSRAVLPYSNDLARFAAYLQQLTMESNGKSTRADGTPVTTNTGEIYWGETGTNGQHAFYQLLHQGTRLVPADFIGFSQPIDDLPTVDGIGSMHDLLMSNFFAQTQVLAFGKTAEEIAAEGTPAEVVPHKVMPGNRPTTSILANRLTPSVLGQLIALYEHQVFTEGVIWGIDSFDQWGVELGKKQAEALLPVITGNASPAQQLDSSTDTLVRRYRTERGRTS

SEQ ID NO: 20624 - protein, 347 aa, Sinorhizobium meliloti 1021
MKSYSIALIPGDGIGQDVTDAAWQVLSTVARHSGFTLTGTSFPWSCAFYKETGAMMPADGIEALRPFDAILLGSVGWPAEVPDSISLHGLLLPIRKAFVQYANIRPHRLLSGVEGPLKASDFDILCVRENTEGEYSGAGGRVHQGTADEVAVETSIFTRAGVERILRFAFEQARQRRGKLASVTKSNAQKHSMVFWDEVTRQLADEYPDVEVTSYHIDAMAARVVMAPESLDVVVASNLFGDILTDLGAAIQGGLGFAASANINPDRSAPSMFEPVHGSAPDIAHLGIANPIAAIWSGAMMLEHLGEREAAGMIMAALERTTIRGIGTVPGKDRTRSITAAVLAALD

SEQ ID NO: 20625 - protein, 341 aa, Neisseria gonorrhoeae
MGIKVAINGYGRIGRQVLRAIYDYQIQDQLQIVAVNASGSLETNAHLTKFDTIHGRFEADVSHDGGNLIVNGDKIPFFSTRNPAELPWKELGVDLVMECTGSFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 20626 - protein, 391 aa, Triticum aestivum
MAVAPSPQATAAAAALSRHRSAAVPPVPRSVRVATAARRPGWTRARAGLVARAVVAAKGELASSDTGGHEVLMFEALREAMIEEMTLDPTVCMIGEDVGDYGGSYKVSKGLSEMFGDLRVLDTPIAENSFTGMGIGAAMQGLRPVVEGMNMGFLLLAYNQISNNCGMLPYTSGGQFKIPIVIRGPGGVGRQLGAEHSQRLESYFQSIPGIQMVACSTPYNAKGLLKAAIRSDNPVVLFEHVLLYNLKEKIPDEEYICCLEEAEMVRPGSQLTILTYSRMRYHVMQAVKTLVNKGYDPEVIDIRSLKPFDLHTIGNSIKKTHRVLIVEECMRTGGIGASLRSAIIDNFWDELDARPVCLSSQDVPTPYAATLEDATVVQPAQIVAAVEEICQ

SEQ ID NO: 20627 - protein, 572 aa, Cryptococcus neoformans var. neoformans JEC21
MSIPYETEKDKSISGGSQGAMTPINGKSGNEVLVTPALGEKGGFEGSGGNPGEGTVHRTLKQRHMAMIALGGAIGTGLFVGSGSALATGGPVGFWLGYVFMGLMVYSMMVALGEMASLYPVAGAFTHYAARFVDPALGFATGINYWYSYAITIPTEIVAATIVISYWDATTNAAVYITVCFVSIIAINFLGARAYGEAEFWFSSIKIVTIVGLIILGIVLMCGGGPNHDAIGFRYWRDPGPFAQVTIENGAGVIPGRWGQFLAFWNVFVQAAFSFIGTEIIATTLGEAENPRKTVPRAIKQVFFRILFFYVMGTFVISVLVPYTEPDLLNGSGTAAASPFVIAINNAGIKALPSIVNAVLLIAAWSAGNSDLYAASRTLYALALERQLPRVFRRCTKRGLPIWCVTVTALFGAFAYLNTGGEAAEEAFNWLYNLSAITGILTWWAILLSYLRFYYGLKKQGISRDDFPYRAPLQPYLSWLGFIFFTLVTIFSGFTVFLKGNWDTSSFFATYITIPIFVGCWIGWKVVKKTKIVPLEHMDFTTGRRELDELEALDAERFKAETKYQKIISILF

SEQ ID NO: 20628 - protein, 197 aa, Oryza sativa (indica cultivar-group)
MDSEHWISRLAAAKRFYAAQLGHADRAGMEEVDMDEEVRPEFACPYCYEDHDVVSLCAHLEEEHPFEPHAAPCPICSDKIAKDMLNHITVQHGYLFKVLLGGGGHRSNNSSNTTNISADPLLSSFGLSFPTSDTEETSKPPISIPDDASVVKETPAQPWDSSIDSSLTREEREQKRKQASVRATFVQDLLLTTLFGD

SEQ ID NO: 20629 - protein, 166 aa, Apium graveolens var. dulce
GRGIKDEPWWPKMQTRNELIESCTTIIWLASALHAAVNFGQYPYGGYLPNRPAMSRRFIPVPGTPDYEELESNPEKAFLKTITSQLLSVLGISLVEILSRHSADEVFLGQRDYPEWTTDEEPQKAFERFGSKLKEIESKFEEMNTNGKWRNRVGPVNMPYTLLFPI

SEQ ID NO: 20630 - protein, 129 aa, Zea mays
PTERSTPIHPHPIGRPCGRRPRSEKIVRKAKVEFDEQPPDNFDPKNPYADPVAMLEYREHLVREKWIQIETAKIIRERLRWCYRIEGINHHQKCRHLVDQYLEATRGVGWGKDARPPELHEPKKIIEAE

SEQ ID NO: 20631 - protein, 107 aa, Apium graveolens var. dulce
FDFVLFMGAVTRPPNLSIITEYLPRGSLYRLIHRPHSQIDEKRRIKMALDVAKGMHCLHASRPTIVHRDLKSPNLLVDKNWNVKVGDFGLSRLKHNTFLSSKSTAGT

SEQ ID NO: 20632 - protein, 170 aa, Bacillus anthracis str. Ames
MDFKQHIAIVPDYPKEGIVFKDITPLMNDGKAYKAATDAIVEYAKERDIDLVVGPEARGFIIGCPVSYALEVGFAPVRKLGKLPREVITVDYGKEYGKDVLTIHKDAIKPGQRVLITDDLLATGGTIEATIKLVEELGGVVAGIAFLVELTYLDGRKMLDGYDVLVLEKY

SEQ ID NO: 20633 - protein, 492 aa, Pinus pinaster
MMSASFKCPVSLSGVENICNGDKAIPGINSRTLFTGSSFLQRHHSANKIFFRTCGKKGSCCLFNIRAMAETDSGNGVPQLDISLSPRVAALKPSKTMAITDLATALKQAGVPVIGLAAGEPDFNTPDAVAEAGIKAIQDGYTRYTPNAGTMEIRTAICHKLKEENGLSYTPDQILVSNGAKQCIMAAAVLAVCSPGDEVIIPAPFWVSYTEMARLADATPVIIPTLLSDDFLLNPEVFSSKLNENSRLLILCSPSNPTGSVYPRELLEEIAKIVAKHPKLLVLSDEIYEHIMYPPAKHTSFASLPGMWERTLTVNGFSKAFAMTGWRLGYLAGPKHFVTACGRIQSQSTSGASSISQKAGVAALALGYAGSEAVSTMVKAYRERRDFLVQRLQAMEGVKLPVPQGAFYLFPDFSSYYGTEVEDFGVINGSEALCRFFLEKAQVALVPGDAFGNDDCIRISYAASLDTLRTAINNIEKSLLLLRPAAAASKAS

SEQ ID NO: 20634 - protein, 321 aa, Salmonella enterica subsp. enterica serovar Typhi str. CT18
MSDALLNAGRQTLMLELQEASRLPERLGDDFVRAANIIIHCEGKVIVSGIGKSGHIGKKIAATLASTGTPAFFVHPAEALHGDLGMIESRDVMLFISYSGGAKELDLIIPRLEDKSVALLAMTGKPHSPLGRAAKAVLDISVEREACPMHLAPTSSTVNTLMMGDALAMAVMQARGFNEEDFARSHPAGALGARLLNNVHHLMRQGDAIPQVMLATSVMDAMLELSRTGLGLVAVCDEQHVVKGVFTDGDLRRWLVGGGALTTPVSEAMTPNGITLQAQSRAIDAKELLMKRKITAAPVVDENGKLTGAINLQDFYQAGII

SEQ ID NO: 20635 - protein, 213 aa, Burkholderia sp. 383
MNRPKSMLVANIAWARETREYTPGFFDALARGQNPRVLWIGCADSRVPAETITHCAPGELFVHRNIANLFHPDDDNSASVLEYAVRVLQVDHVIVCGHYGCGGVRASLLPPPSDLPHVARRIAPLCALARRHRDALDGLDDTAAADRLAELNVLEQVRLLRASPIVQGRERPPLVHGWIFSLADGRLQELDSGYTNPPVDVETMQAATAGALG

SEQ ID NO: 20636 - protein, 312 aa, Saccharophagus degradans 2-40
MNNSVAVIGESMLELMRAESDSSCRSMPAMLSYGGDTLNSSVYMSRLGAKVEYITAVGKDKNSEWLVKQWQSEGVGTRFVRTDEKKVPGLYMVTNDESGERYFTYWRNDSAARYIIDSEEKKQALYADLEGFDWIVISGISIAILDEASKKRMYELLQQCKARGAKIAFDGNYRPALWESKEQTRQAYQTVTAFADIILPTIDDEFQLYGEEPKDEVIDRLLSYGAKEIVLKMGGEGCYTVADNERTLVPGRKVVVVDTNSAGDSFNAGYLTGRMQGMSVEESALRGHLLASTVVQYRGAIIPKTAMPKMVG

SEQ ID NO: 20637 - protein, 341 aa, Mycobacterium avium subsp. paratuberculosis K-10
MTTILAIETSCDETGVGIARLDADGAVTLLADEVASSVDEHVRFGGVVPEIASRAHLEALGPTMRRALSAAGVTKPDVVAATIGPGLAGALLVGVAAAKAYSAAWGVPFYAVNHLGGHLAADVYQHGPLPECVALLVSGGHTHLLQVRSLGDPIVELGSTVDDAAGEAYDKVARLLGLGYPGGRVLDELARTGDREAIVFPRGMTGPRDAPYAFSFSGLKTAVARYLESHPDAVNADVAAGFQEAVADVLTRKAVRAATDLGVTTLLIAGGVAANSRLRELAEQRCAAAGLTLRIPRPGLCTDNGAMIASFAAHLVAAGAPPSPLDVPTDPGLPVVKAQVS

SEQ ID NO: 20638 - protein, 191 aa, Triticum aestivum
MESHSAMGKADDLSYPNCKEQNMNTDGSLPTEPTAPKGAVECCSNELCTGDTYSTSAVVGSSISRVNVGPSDTNHDECCKFTLFKDFTISGLGRLGCGFVEDVNLLEIWKDVQHFSEFIGPFWCLRAALGPLVETYVLLDRLLFLQEQGSAVEASLFPLFDPAMSPRNMALVAWKLTEDPLEPSHGNASHA

SEQ ID NO: 20639 - protein, 172 aa, Zea mays
MAASAPAVRPLARAAIPIPLSARPRTARVSLLPLAPPAPAQRLALGRTGQARLPARSRSVRCLAALSPEMRETLDKVVGSSKVLLFMKGTKDFPQCGFSHTVVQILRSLDVPFETLDVLANEALRQGLKEYSSWPTFPQLYIDGEFFGGCDITVEAYKSGELQETLEKAMCS

SEQ ID NO: 20640 - protein, 84 aa, Arabidopsis thaliana
MADTGKGSSVAGCNDSCGCPSPCPGGNSCRCRMREASAGDQGHMVCPCGEHCGCNPCNCPKTQTQTSAKGCTCGEGCTCASCAT

SEQ ID NO: 20641 - protein, 239 aa, Staphylococcus aureus subsp. aureus Mu50
MNFFDIHKIPNKGIPLSVQRKLWLRNFMQAFFVVFFVYMAMYLIRNNFKAAQPFLKEEIGLSTLELGYIGLAFSITYGLGKTLLGYFVDGRNTKRIISFLLILSAITVLIMGFVLSYFGSVMGLLIVLWGLNGVFQSVGGPASYSTISRWAPRTKRGRYLGFWNTSHNIGGAIAGGVALWGANVFFHGNVIGMFIFPSVIALLIGIATLFIGKDDPEELGWNRAEEIWEEPVDKENIDS

SEQ ID NO: 20642 - protein, 482 aa, Schizosaccharomyces pombe 972h-
MTTRRLTRQHLLANTLGNNDENHPSNHIARAKSSLHSSENSLVNGKKATVSSTNVPKKRHALDDVSNFHNKEGVPLASKNTNVRHTTASVSTRRALEEKSIIPATDDEPASKKRRQPSVFNSSVPSLPQHLSTKSHSVSTHGVDAFHKDQATIPKKLKKDVDERVVSKDIPKLHRDSVESPESQDWDDLDAEDWADPLMVSEYVVDIFEYLNELEIETMPSPTYMDRQKELAWKMRGILTDWLIEVHSRFRLLPETLFLAVNIIDRFLSLRVCSLNKLQLVGIAALFIASKYEEVMCPSVQNFVYMADGGYDEEEILQAERYILRVLEFNLAYPNPMNFLRRISKADFYDIQTRTVAKYLVEIGLLDHKLLPYPPSQQCAAAMYLAREMLGRGPWNRNLVHYSGYEEYQLISVVKKMINYLQKPVQHEAFFKKYASKKFMKASLFVRDWIKKNSIPLGDDADEDYTFHKQKRIQHDMKDEEW

SEQ ID NO: 20643 - protein, 375 aa, Saccharomyces cerevisiae
MLKVNNVFGSNPNRMTKLEDEHYFIDDIVSIKNRQKSKMYVREGKRIGHGSFGTVTQSILSSNSIEWLGPYAIKRVVKSPKVQSLELEILQNIRHPNLVTLEFFFESHCTTKDGGHLYQKNFVMEYIPQTLSSEIHEYFDNGSKMPTKHIKLYTFQILRALLTLHSMSICHGDLKPSNILIIPSSGIAKVCDFGSAQRLDDNTELKTYFCSRFYRAPELLLNSKDYTTQIDIWSLGCIIGEMIKGQPLFKGDSANSQLEEIAKLLGRFPKSSIKNSQELQDSLNDQKFKKFMHWFPSIEFFDVEFLLKVLTYDATERCDARQLMAHEFFDALRNETYFLPRGSSMPVHLPDLFNFSASEKRALGEYYNLIVPSLD

SEQ ID NO: 20644 - protein, 408 aa, Pseudomonas sp. KKS102
MSQEALKAPVVVLGAGLASVSFVAELRQAGYQGLITVVGDEAERPYDRPPLSKDFMAHGDAEKIRLDCKRAPEVEWLLGVTAQSFDPQAHTVALSDGRTLPYGTLVLATGAAPRALPTLQGATMPVHTLRTLEDARRIQAGLRPQSRLLIVGGGVIGLELAATARTAGVHVSLVETQPRLMSRAAPATLADFVARYHAAQGVDLRFERSVTGSVDGVVLLDDGTRIAADMVVVGIGVLANDALARAAGLACDDGIFVDAYGRTTCPDVYALGDVTRQRNPLSGRFERIETWSNAQNQGIAVARHLVDPTAPGYAELPWYWSDQGALRIQVAGLASGDEEIVRGEVSLDAPKFTLIELQKGRIVGATCVNNARDFAPLRRLLAVGAKPDRAALADPATDLRKLAAAVAA

SEQ ID NO: 20645 - protein, 484 aa, Sinorhizobium meliloti 1021
MRLKDRELFRQLGLIGGEWIAGASGVVVDVIDPANQAVLGTVPDMGTAETRAAIEAANAAFGPWKKKTHAERAAVLERWHALMIENLEDLAVLVTMEQGKPLEEARGEIRYGAAFVKWFAEESRRIGGHTIPSPTSDRRIVVLKEAVGVCAIVTPWNFPNAMITRKVAPALAAGCTVVIKPSEFTPFSALALGVLAERAGIPAGVVNIVTGMPTAIGNEFMTNETVRKISFTGSTRVGSLLMRGAADSVKRLSLELGGNAPFIVFDDANLDLAVEGAIASKFRNGGQTCVCANRILVQAGVYDAFAEKLGARVNAMKVGPGTEPGIAIGPMINEAAIDKIDRHVEDAIAKGAKLAARGRSVPEGRQYTAPIVLTGATTDMLLASEETFGPVAPLFRFETEDEAIAIANGTPFGLAAYFYTEGLKRSWRVAEALEFGMIGLNTGAISTEVAPFGGVKQSGLGREGAQVGIEEYLEMKSFHIGGLD

SEQ ID NO: 20646 - protein, 901 aa, Aspergillus nidulans FGSC A4
MSILVRPPKRRLADTENLDQNHRRVLRDFGQGNSASTPINTSADYGRFDERPGSGDGSRYASPFQELSSSQGSLTRVEDSLQTRRKFPPNASIVLIGIRGTGKSSLAVMLAASYGRRVIEADLYFQRVTGRCRGVYKREHTLSEYRRQEAIVMESLLMEHQENCVIVCGPGDVERNGQMRLREYAKTHPVIHIVRDLESIQSYLKARDTEKVRRFLELSGPIYRSCSNLEFFNVSEKGISDQPSAKDSQHYTQWDAEVDQRTQTTTPFLMLKRLQRDFLRFVALATGNIPELRNQLSPFPLHMQPIESRKFTYAATVPISHLLENDVDIEELESTADAFELKIDVSAAPSARLGTESNLADSISHTVATVRRNIIVPMIYHVESSVFPDSAPLRRSDASYLELVLHGLRLGPEFVTVDLSFEDSILSQIIGTKGSSKVIGHYSQTQPPPQGWSDPEYEAIYERAKKLGCDMVRLTQPATTIDDNFAVERFRHQIKTLPGPQLPVIAYNSGPLGRQSCCFNPVLTPVIPRSLISQSGTKGLPSITIQEAQEALYSSFVLDPMQFFVFGANTTYSLSPAMHNAAFKVRGMPHIYRIHQSPTLRGINYLVENPNFGGTSVSLPYKTEVIPLLHSMSPHARAIGAVNTLIPIRNLEGSTDNALDLEKNRAGPIKGLHGDNTDWIGIGICIRRGLSPANAIRPSTTGLIIGAGGMARAGIYAMIHLGVQNIFIWNRTVANAEKLAQHYMRLNLCTLGGSGSASYTIHVLKSLQESWPANYKQPTIVVSGIPAHRIGDQPAPNFQLPPQWIESPTGGVVVDLAYKPLNTPLMRQIRSLSHRGWAALDGLDVLPEQGFAQFELFTGCRAPRRLMRTVILQEYKEEEQGEEYDQSAMRTRLENLDGQPM

SEQ ID NO: 20647 - protein, 308 aa, Synechococcus sp. WH 5701
MTWTTASIPDQSGRIALITGANSGLGLESARALASHGATVVLACRSRRRGEEARAELLPAAVAGLEVLELDLADLASVRAGARWMQEQYGRLDLLLNNAGVMGPPRQLTRDGFELQFGTNHLGHFALTTALLPLMEGRADARVVTVTSGAQYFGKLAFDDLQSERRYDRWAAYSQSKLANVTFALELQQRLAAAGSTVSSLAAHPGLARTNLQPASVASSGSRFESLAYRLMDPLFQSAAMGALPQLYAATAPEARGGEHYGPDQWGGMRGGPTQVRIAPAALDPQIRQRLWEVSEQLVGQAAPAEAA

SEQ ID NO: 20648 - protein, 534 aa, Saccharomyces cerevisiae
MSSDEEDFNDIYGDDKPTTTEEVKKEEEQNKAGSGTSQLDQLAALQALSSSLNKLNNPNSNNSSSNNSNQDTSSSKQDGTANDKEGSNEDTKNEKKQESATSANANANASSAGPSGLPWEQLQQTMSQFQQPSSQSPPQQQVTQTKEERSKADLSKESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRHMQQKSSNNGGNNGGNNMNRRGGNFGNQGDFNQMYQNPMMGGYNPMMNPQAMTDYYQKMQEYYQQMQKQTGMDYTQMYQQQMQQMAMMMPGFAMPPNAMTLNQPQQDSNATQGSPAPSDSDNNKSNDVQTIGNTSNTDSGSPPLNLPNGPKGPSQYNDDHNSGYGYNRDRGDRDRNDRDRDYNHRSGGNHRRNGRGGRGGYNRRNNGYHPYNR

SEQ ID NO: 20649 - protein, 458 aa, Sinorhizobium meliloti 1021
MYSNSLIELDRAHLIHPVASYRGHEKLGVRVLASAKGATVTDASGRQLIDGFAGLWCVNAGYGQETIVEAAAKQMRELSYATAYFGLGSEPAIRLASELAERAPGNLNHVYFTLGGSDAVDSTIRFIRYYWTARGEPQRDQFISVEQGYHGSSTVGAGLTALPAFHTGFGIPFDWQHKIPSHYAYRNPVGDDPQAIIAASLTALRRKVEEIGPERVAAFYAEPIQGSGGVLVPPRGWMKAMRELCRDLGILFVADEVITGFGRTGPLFASTENEIVPDFITTAKGLTSGYVPMGAVFMADHIYQTIADGAGASAVGHGYTYSAHPVSAAVGLEVLRLYENGLLENGVKAGARLMEGLGSLRDHPLVGDVRGRGMLAAIELVVDKAQKTPLPAAAEPARRIFDRAWENGLVIRAFANGVLGYAPPLCCSETEIDAIIERTRQSLDETLEDPDVRRALKT

SEQ ID NO: 20650 - protein, 354 aa, Zea mays
  misc_feature (23)..(23): Xaa can be any naturally occurring amino acid
  misc_feature (58)..(58): Xaa can be any naturally occurring amino acid
  misc_feature (60)..(60): Xaa can be any naturally occurring amino acid
  misc_feature (62)..(62): Xaa can be any naturally occurring amino acid
  unsure (1)..(354): unsure at all Xaa locations
MPPPRGAGPELGDFHAHVAVRLXGLSAPGGEEFMSVAWVRRLLEAFLLCQEEFRAAVXEXRXRGGGVTAPADAEKLVAEARRWERLAGLAASALLAPAEGQVHEGQLWRARKALSDLSLLLADDAAAASAGAGGGLASFLASHRNRSFGRARASPSRASPSAHLRSLSWSVSRTWSAARQLQAIGAGLAAPRATEASCGFAAPAYAMGCLLHLAAWALVAAVPCPDRAAALQAHHLPAAPPRAAFPWAPPLLALQERLAEEGRRKDRRSSCGLLREIHALDKCAQRLAEAIDAAPVPLTGEREAELREAAAELAAACSAIKDGLDPLERQVRELFHRIVRSRMAGLDPPMANAD

SEQ ID NO: 20651 - protein, 43 aa, Apium graveolens var. dulce
YCSTWDANKPLAWRKKYGWTSFCGPVGPHGRPSCGRCLKVCFF

SEQ ID NO: 20652 - protein, 181 aa, Apium graveolens var. dulce
GNSIAYKNVIGARRASWRIISSIEQKEESRGNDAHVATIREYRSKIENELSSICDGILKLLDSKLIGAASNGDSKVFYLKMKGDYYRYLAEFKIAAERKEAAENTLNAYKAAQDIANAELAPTHPIRLGLALNFSVFYYEILSSPDRACNLAKQAFDEAIAELDTLGEESYKDSTLIKSLV

SEQ ID NO: 20653 - protein, 445 aa, Escherichia coli O157:H7
MGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPATTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTPLAIASSLILVASTFVWAPIPGLICAVIVIATGLPAYAFWAKRSRQLNALS

SEQ ID NO: 20654 - protein, 143 aa, Clostridium perfringens SM101
MRLEKSLVLIKPDAVERNLIGKILEVYEGAGLKIKAMEMKQINKDFAEKHYEEHRDKQFFNSLIKYITRSPLVALILEGEDAIDKIRSLNGATNPEKAEFGTIRRRFALSGTENSVHASDSIESAEKEIKLWFPKVFYEEICG

SEQ ID NO: 20655 - protein, 401 aa, Cryptococcus neoformans var. neoformans JEC21
MSTSTRRHVLEDKLANHKADPNAAANAGQVQERTTKGSSSSAPRKVRFNVGNNYHVVDVIGEGAYGVVASAVHRPSGTKVAIKKIAPFDHSMFALRTLRELKLLKYFAEEGVSENIISVLDIIKPPSYDTFKEVYLVQELLETDLHRVIRTQDLSDDHCQYFLYQTCRALKALHSAEIIHRDLKPSNLLLNANCDLKVCDFGLARSTQTAFPAEGNNQGFMTEYVATRWYRAPEVMLSFRMYTKSIDVWSVGCILAEMLSGKPLFPGKDYHNQLALILDVLGTPTIDEFHAITSKRSKDYIRSLPFRKKRTFESIYPSANPLAIDFLRKTLTFDPRKRYTVEQCLAHPYLDAYHDPEDEPSAKPLPPSFFEFDMMKDDISREELKRLLYEEIMGFRPVLEG

SEQ ID NO: 20656 - protein, 571 aa, Candidatus Desulfococcus oleovorans Hxd3
MSRRIVVVGGVALGSKAACRAKRVDPEADVYLIDRDEYISYGGCGIPFYISGDVSDVSELRSTSFHMLRDERFFLKDKGVVALTGTEVTRIDRQGKTVAIRRKDGTTDTLAYDKLVLATGTTPRMLPLPGRDLENVFTVANLHDALAIKEKVTEGSIGKAVVVGGGFIGLEMAEALADMWEIETSIVEVFDQIMPGFVSPSLATMARKTIEDKGVRVYTSEKVEALVGEGAVSAVKTDKRTLDADMVIMAVGVVPNTGLAKEAGLEVTPQGWIVVNDQMQTSDPDIYSGGDCAAVKNLVTGELGYFPLGSMANRQGRVIGTNVTGGSARFDGAVGSFVVKIFDNALAGAGLTADRASAAGFDAVGIQVAQFDRAHFYIEKEVIFLELVVDEKTRRVLGIQGFGGKDSGMVARINAVAPLLKYKPGVEEISNLELAYSPPFASAMDIINALGNAASNYLDGRYRPMTMEAFAACWENRSCGDTFFLDCRANADAQPFADKYPEIWKSIPHDQLVDRMDEVPKGKKLVLLCNTGVRSYEAQLNLNAKGITDNVSAGAGIAGLKTWGVDFGLDK

SEQ ID NO: 20657 - protein, 194 aa, Oryza sativa
RRKVRAKQRSAMGNSLPVESKFTDEKENDRIKYVVSSMQGWGEKMEDAHAAILNLDDTMTSFFGVYDGHGGAEVASYCAKRFHIELCNHEDYDSNLSNAMRSAFYSMDEDLQLSDAWRELVIPRNNGWMYFIKAGVCANLSPFPQATYTAPSYEGSTACVVVIRGDQLIVGHAGDSRCVLSRNGQASALSVDHK

SEQ ID NO: 20658 - protein, 459 aa, Bordetella pertussis Tohama I
MNDLATINDLHSVVEDDRNAIWHHMLQHDALQATAPWVVVEGKGTRIRDASGKEYLDATAGGFWTVNVGYGRERIANAMRDQMLKLNYFAQSAGNVPGALFARQLVSKMPGMSRVYFSNSGSEANEKVFKMVRQISARHHAGRKYKILFRERDYHGSSIATLAAAGQPERAAQYGPFPDGFVQVPHCLEYRKQWDVANYGERAADAIEEVILREGPETVGLLCLEPITAGGGIIVPPEGYWRRVQEICRRYDVLLHIDEVVCGLGRTGKWFGYQHFDIEPDFVTLAKGTASGYAAIACTVTHERIFEQFKDEPDDPLSFFRDVSTFGGCAGSAAAALENLRILEEEGLVEHAAQVGDYLQACLRQLADKHAVIGDVRGKGLLQGVELVSDRAAKTPVSEADAKRVVAQCKAQGVLIGVITRALPGLNTTLCLAPPLILTRDEVDELCGAIDRALATVFG

SEQ ID NO: 20659 - protein, 403 aa, Triticum aestivum
MTRPTMLMLGLLLLSLFSVGTVSAQQKFGINYGQIANNLPDPTQVAGLLRSMNVNRVKLYDADPKVLTAFANTGVEFIISVGNENLQTMAASPGAARQWVAQHVQPFLPATRITGIIVGNEVLGNNDTAMAASLVPAMQAVYDALAALGLSGRVTVSSAHSVNVLASSFPPSSGAFQEGVAQYVRPLLDFHSKTGSPFLINAYPFFAYKGSPGSVSLPYVLFQPNAGVRDGGLVYDNMLYAQIDAVYAAMKAMGHTDIGVRISETGWPSKGDEDEVGATAQNAAAYNGNLMQRIARGQGTPLKPNVPIDVFVFALFNENMKPGPASERNYGLFYPNGSPVYAINAGTAGSGSSSGDGGGSSVGRFDPYSSQSMFSSASRLAVRRTLSSLTLLLVLPVLSALAC

SEQ ID NO: 20660 - protein, 178 aa, Triticum aestivum
  misc_feature (27)..(27): Xaa can be any naturally occurring amino acid
  misc_feature (105)..(105): Xaa can be any naturally occurring amino acid
  misc_feature (115)..(115): Xaa can be any naturally occurring amino acid
  unsure (1)..(178): unsure at all Xaa locations
MAPTVMASSATSVAPFQGLKSTAGLPXSRRSNGASLGSVSNGGRIRCMQVWPIEGIKKFETLSYLPPLSTEALLKQVDYLIRSKWVPCLEFNKVGFIFREHNASXPGYYDGRYWXTCGKLPMFRGGTDATQVINEVEEVKKEYPDAYVRIIGFDNMRQVQCVSFIAFKPPGCEESGKA

SEQ ID NO: 20661 - protein, 307 aa, Silicibacter pomeroyi DSS-3
MTVLVADVGGTNTRVALASAGQLVHLARFANDAYGSFAEVLTAYARGRDLPGLRGVCVAVAGPVANGRAELTNRNWHFDTAELAAPLPGQGDVAARLINDLVALGHALPGLTAAQLDVIRAGAVQPSNDQALVAGLGTGFNTCLLKGGAVVEAELGHASLPLAIAEELRAQLGDAAGGFRTNECLFSGRGLSRLHAILSGQDRRGQDILADYAIGEDPQAAATVTLTARLLGLFARELVFQYLPFRGIHFAGGAARGILGSAARAEFLSAFEADGRFADHLDRVPVRLIADDAAALSGAARLMEECA

SEQ ID NO: 20662 - protein, 575 aa, Saccharomyces cerevisiae
MVNVGPSHAAVAVDASEARKRNISEEVFELRDKKDSTVVIEGEAPVRTFTSSSSNHEREDTYVSKRQVMRDIFAKYLKFIGPGLMVSVAYIDPGNYSTAVDAGASNQFSLLCIILLSNFIAIFLQCLCIKLGSVTGLDLSRACREYLPRWLNWTLYFFAECAVIATDIAEVIGTAIALNILIKVPLPAGVAITVVDVFLIMFTYKPGASSIRFIRIFECFVAVLVVGVCICFAIELAYIPKSTSVKQVFRGFVPSAQMFDHNGIYTAISILGATVMPHSLFLGSALVQPRLLDYDVKHGNYTVSEEQDKVKKSKSTEEIMEEKYFNYRPTNAAIKYCMKYSMVELSITLFTLALFVNCAILVVAGSTLYNSPEADGADLFTIHELLSRNLAPAAGTIFMLALLLSGQSAGVVCTMSGQIVSEGHINWKLQPWQRRLATRCISIIPCLVISICIGREALSKALNASQVVLSIVLPFLVAPLIFFTCKKSIMKTEITVDHTEEDSHNHQNNNDRSAGSVIEQDGSSGMEIENGKDVKIVYMANNWIITVIAIIVWLFLSLLNVYAIVQLGMSHGDIS

SEQ ID NO: 20663 - protein, 123 aa, Fraxinus mandshurica
KELVFYFHDILFKGDNYNNATSAIIGSPEWGNKTALAQPYNFGDLVAFDDPITLDNNLHSPPVGRAQGMYLYDQKSIYSAWLGFTFLFNSTKLVGTLNFAGADPLMNKTRDLSVIGGTGDFFM

SEQ ID NO: 20664 - protein, 380 aa, Schizosaccharomyces pombe 972h-
MVQTAALHGPKPMDSSHIKVTNVKELKPLPEWKSLKFGENFTDHMLIMKWNREKGWSTPEIVPFGKLCFHPASSVFHYGFECFEGMKAFRDEKGVPRLFRPIKNAERMLSTGTRISLPSFDPAELAEIIRKFVAHENRWVPDQRGYSLYIRPTFIGTDEALGVHHCDNAMLYVIASPVGPYYSSGFKAVKLCCSEESVRAWPGGTGHYKLGGNYAPSVLPQKEAAKKGYAQILWLYGDEDYITEVGTMNCFTVWINKNGEKEIITAPLDGMILPGVTRDSILEICRERLAPKGWKITEGKYSMKEVAQASKEGRLLEVFGAGTAALVSPVKAINYKGTEYEIPMPEGQEAGPITSEISKWILDIQYGKEPNNPWSVPALP

SEQ ID NO: 20665 - protein, 186 aa, uncultured bacterium
MNNLVFNFKSKKIKKIKNPKFILGGKGANLAQMGKLGLPVPPGFTISTGVCEIFYKNNKKLNSKLIKSIKQELKQIEKECGKKFGDLDNPLLVSVRSGARVSMPGMMDTILNLGLNDETVKALAKKTSNMRFAKDSYRRFIQMYSNVVLGVESYNFEELIENYKLTKGVFKTAFHMSSAYKVAFLK

SEQ ID NO: 20666 - protein, 727 aa, Arabidopsis thaliana
LFSMSQSLDYQNSCQDSFKVNVPTSFVPEEKEMNLTHLESALRKGFEVKLVIDEIPCQECSSSRGICGFNSTTQICCNVTSLSGGVTCVPQHQPSADELRRRCSERFSCGNQRNLYYPFWIPGREYCGHPDFKLDCSGGFAELNIASVNFRILNMSYDSSNKRLARSDYLNDLCPPNPLNDEPLIETVLQFSADTELLTLYYDCQLNSSATSPFPSSYFGELGCDEGRSYYVTRNLSSPLLDRFRGVLNNLREMCKRKVSVPASGPALNTLQTNPNSNNLKMALEHGFELQDNSNCSMCVLSGGSCGYNQNSSLFVCYCKDGPQDNQCDINLDVAIIIGIFVALCTIGGFIAFLVLLCPCCKVRIFRNRKTSDDRRQEKLKALIPLKHYTYAQVKRMTKSFAEVVGRGGFGIVYRGTLCDGRMVAVKVLKESKGNNSEDFINEVSSMSQTSHVNIVSLLGFCSEGSRRAIIYEFLENGSLDKFISEKTSVILDLTALYGIALGVARGLEYLHYGCKTRIVHFDIKPQNVLLDDNLSPKVSDFGLAKLCEKKESVMSLMDTRGTIGYIAPEMISRVYGSVSHKSDVYSYGMLVFEMIGARKKERFGQNSANGSSMYFPEWIYKDLEKADNGDLEHIEIGISSEEEEIAKKMTLVGLWCIQSSPSDRPPMNKVVEMMEGSLDALEVPPRPVLQQIHVGPLLESSWITEESSSISEIENRNLQVCEKILS

SEQ ID NO: 20667 - protein, 123 aa, Populus tremuloides
KELVFYFHDIIYNGKNARNATSAIVGSPAWGNKTNLATPNRFGDVVIFDDPITLDSDLRSTPIGRAQGLYLYDKKEILTAWFGFSFVFNSTQLKGTINFAGADDIMKTTRDLSVVGGTGDFFM

SEQ ID NO: 20668 - protein, 1246 aa, Arabidopsis thaliana
MRASVYSLILLFFSCLLHLSKSQPFLGVNYGLTADNLPPPSASAKLLQSTTFQKVRLYGSDPAVIKALANTGIEIVIGASNGDVPGLASDPSFARSWVETNVVPYYPASKIVLIAVGNEITSFGDNSLMSQLLPAMKNVQTALEAASLGGGKIKVSTVHIMSVLAGSDPPSTAVFKPEHADILKGLLEFNSETGSPFAVNPYPFFAYQDDRRPETLAYCLFQANPGRVDPNSNLKYMNMFDAQVDAVYSALNSMGFKDVEIMVAETGWPYKGDPEEAGATVENARAYNKNLIAHLKSGSGTPLMPGRVIDTYLFALYDENLKPGKGSERAFGLFRPDLTMTYDIGLTKTTNYNQTSMAPLSPTRPRLPPAAAPTRQTLPSPPQMILPSPVTPSDKNSGQTDVHNSTPRSASLAHICRSLSISASMFFVSVLCVYVAVSHWVIGKPNTRWNLLKAFGISRCYLSHLFNIQGHHLRGSIAGLHSPSLLFLIDPSKEKPSWRILNVPGKPPKLAWGHSTCVVGGTRVLVLGGHNGEEWILNELHELCLASWQDSDLKSSTAPSSAPESDTRSEKNSNADEGSTSQNDVAAVNKGKGILGHSPNKPNVNLTEKPNKSSSSSQRSKPPMQENKARVTTEKRSVCQQNLPSTRVIPSALTRFFPIGNFLSSSFLLLTIPESSSSPHLRRPSVMASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 20669 - protein, 533 aa, Aspergillus nidulans FGSC A4
MSILALVEDRPTPREVYNWRVYLLAAVASFTSCMIGYDSAFIGTTLSLQSFQNEFNWESLNTDLISANIVSLYQAGAFFGALFAYPIGHFWGRRWGLMFSALIFFLGAGMMLGANGDRGLGLIYGGRVLAGIGVGAGSNICPIYISEMAPPAIRGRLVGVYELGWQIGGVVGFWINYGVDETLAPSHKQWIIPFAVQLIPAGLLIIGALLIRESPRWLFLRGNREKGIETLAWIRNLPADHIYMVEEINMIEQSLEQQRVKIGLGFWKPFKAAWTNKRILYRLFLGSMLFLWQNGSGINAINYYSPRVFKSIGVSGGNTSLLTTGIFGVVKAVITFVWLLYLIDHFGRRNLLLVGAAGGSVCLWIVGGYIKIAKPENNPEGTQLDSGGIAAIFFFYLWTAFYTPSWNGTPWVINSEMFDPTVRSLAQACAAASNWLWNFLISRFTPQMFTSMGYGVYFFFASLMILSIVFVFFLIPETKGVPLESMETLFDKKPVWHAHSQLIRELRENEEAFRADMGASGKGGVTKEYVEEA

SEQ ID NO: 20670 - protein, 1111 aa, Arabidopsis thaliana
MLQQSSTHLLCGVVLLQLFAAQVDAQRSTSPWQTLSGDAPLVIARGGFSGLFPDSSLAAYQFAMVVSVADVVLWCDVQLTKDGHGICFPDLNLANASNSEEVYPNRQKSYPVNGVTTKGWFPIDFSLTELQKVLFSLIRGILSRSGKFDENGYSISTVQNVATQMKPALFWLNVQHDEFYEQHNLSMSSFLLSTSRTVSIDFISSPEVNFFRKIAGGFGNNGPSFVFQFMGKEDFEPTTNRTYGSILSNLSFVKTFASGILVPKSYILPLDDKQYLLPHTSLVQDAHKAGLKLYASGFANDVDIAYNYSWDPVSEYLSFVDNGNFSVDGMLSDFPLTASASVDCFSHIGRNATKQEQKHYHLPMVRASVDFLVISKNGASGEYPGCTKLAYEKAIKDGSDVIDCPVQMSSDGIPFCSSSIDLVNSTTVGQTHLRNRSIIVPEISSVAGIFTFSLTWHEIQSLTPAISNPFRENGMSRNPNERNSGNLISLYEFLNLAKNSTSLSGILISLENVVYLREKKGLDVVKVVLNRLTETGYIVGTLKVMIQSTTRLVLVDFKNQSTYKTVYKIKETIGNITDSAIEDIKKFANAVVINKASVFPNSDSFLTGQTTNVLERLQKFQLPVYVELFQNEFVSQPFDFFADETVEINAYIFGAGINGTITEFPYTAARYKRNRCLGREEVPPYMLPVNPGGVLTLISTSSLPPAQDPNPIFTHDDVTEPPLPPVIAKSPTSTLGTPSTIAKPLISWSVAGVVLFLVLLTLVFCFHRKRETRLRQQKLKALIPLEHYTYAQVKRITKSFAEVVGRGGFGIVYKGTLSDGRVVAVKVLKDTKGNGEDFINEVATMSRTSHLNIVSLLGFCSEGSKRAIIYEFLENGSLDKFILGKTSVNMDWTALYRIALGVAHGLEYLHHSCKTRIVHFDIKPQNVLLDDSFCPKVSDFGLAKLCEKKESILSMLDTRGTIGYIAPEMISRVYGNVSHKSDVYSYGMLVLEIIGARNKEKANQACASNTSSMYFPEWVYRDLESCKSGRHIEDGINSEEDELAKKMTLVGLWCIQPSPVDRPAMNRVVEMMEGSLEALEVPPRPVLQQIPISNLHESSILSEDVSVYTEG

SEQ ID NO: 20671 - protein, 490 aa, Schizosaccharomyces pombe 972h-
MSPKQEEYEVERIVDEKLDRNGAVKLYRIRWLNYSSRSDTWEPPENLSGCSAVLAEWKRRKRRLKGSNSDSDSPHHASNPHPNSRQKHQHQTSKSVPRSQRFSRELNVKKENKKVFSSQTTKRQSRKQSTALTTNDTSIILDDSLHTNSKKLGKTRNEVKEESQKRELVSNSIKEATSPKTSSILTKPRNPSKLDSYTHLSFYEKRELFRKKLREIEGPEVTLVNEVDDEPCPSLDFQFISQYRLTQGVIPPDPNFQSGCNCSSLGGCDLNNPSRCECLDDLDEPTHFAYDAQGRVRADTGAVIYECNSFCSCSMECPNRVVQRGRTLPLEIFKTKEKGWGVRSLRFAPAGTFITCYLGEVITSAEAAKRDKNYDDDGITYLFDLDMFDDASEYTVDAQNYGDVSRFFNHSCSPNIAIYSAVRNHGFRTIYDLAFFAIKDIQPLEELTFDYAGAKDFSPVQSQKSQQNRISKLRRQCKCGSANCRGWLFG

SEQ ID NO: 20672 - protein, 272 aa, Mannheimia succiniciproducens MBEL55E
MINKDTQLCISLSGRPSNFGTRFHNYMYEKLGLNFVYKAFTTNDIEHAVKGVRALGIRGCAVSMPFKESCMPFLDEISPSAKAIESVNTIVNTDGYLKAYNTDYIAISKLIAKYQLKPTACVIIQGSGGMAKAVAAAFKNAGFDNLKIYARNATTGGYLAKLYGYQYIDSLYGQNADILVNATPIGMKGGGKEESIISFPEAMIDQASVAFDVVAMPAETPLIKYARQQGKTVISGAEVAVLQAVEQFELYTGQRPGDELIAEAASFARANS

SEQ ID NO: 20673 - protein, 227 aa, Mannheimia succiniciproducens MBEL55E
MELVFIRHGLSEWNALNLFTGWRDVNLSEKGVEEAKEAGRKLKAAGFEFDIAFTSVLTRAIKTCNLVLEESNQLWVPQIKTWRLNERHYGGLQGLNKAEAAAEHGDEQVRIWRRSYDVLPPVLDPKDPNSAHNDRRYAHLPADVVPDCENLKVTLERVLPFWEDQIAPAIKAGKRVLVAAHGNSLRALAKHIEGISDADIMDLEIPTGQPLVYTLDDNLKVVSKRYL

SEQ ID NO: 20674 - protein, 434 aa, Acanthus ebracteatus
MAEKSFKYVILGGGVAAGYAAREFAKQGVQPGELAIISKEAVAPYERPALSKAYLFPEGTARLPGFHVCVGSGGERLLPEWYSEKGISLILSTEIAQADLASKTLTSAKGEAFKYETLIIATGSTVIKLSDFGVQGADAKNIFYLREIDDADQLVEAIKSKPNGKAVIVGGGYIGLELSAALRINNIDVSMVYPEPWCMPRLFTAGIAAFYEGYYANKGINIIKGTVAVGFGANEKGEVTDVKLKDGRVLEADIVVVGVGGRPLTTLFKGQVAEEKGGIKTDAFFKTSVSSVYAVGDVATFPMKLYNDIRRVEHVDHARKSAEQAVKAIFASEQGKSVDEYDYLPYFYSRAFDLSWQFYGDNVGDTVIFGDSNPTSATHKFGTYWIKDGQVVGAFLESGSPEENKAIANVARAQPPAGSLDELASEGLAFATKL

SEQ ID NO: 20675 - protein, 554 aa, Rhodococcus sp. RHA1
MPFKSPFPDVEIPNLSVYDFLFGQVDEADLDRPALIDGASGAVTTYQALIAQINGVAGALAARGLAVGGVAALHSPNVPAFASVFHGILRAGGVATTINALYTAEDIAKQLTDSKAKFLFTVSPLLPQAKAAAAQVGIPAAHVIVLDGADGHPSLQDLLAEGAPAPEVSFDPATQLAVLPYSSGTTGRPKGVMLTHRNLVANVCQIDRPIGIRADDKVLAVLPFFHIYGMTVLLNAALRKRAALVTMPKFDLVEFLTIVAEQKCTYVFIAPPVAVALAKHPLIDQYDLSSVHSIFSGAAPLDQELGKAVANRLGCRVRQGYGMSEMSPVSHAIPFDRDDIALDSVGPSIANMECKLVDPGTGAEIEQPAEGVSAPGELWCKGPNIMAGYLGDDEATAETLDAGGYLHTGDIATVDSEGVVTIVDRMKELIKYKGYQVPPAELEALLLTHPQIADAAVIGVLDDEGEEVPKAFVVRQPGAELDEAAVIAFVAERVSPHKKVRRVEFIDLVPKSAAGKILRKDLRATEPSSTHRAALVWIRRGSPTSAILLVTMRT

SEQ ID NO: 20676 - protein, 680 aa, Arabidopsis thaliana
MTATQMLLHLLLLPLLFLHFSNQVMAEITDELATLMEVKTELDPEDKHLASWSVNGDLCKDFEGVGCDWKGRVSNISLQGKGLSGKISPNIGKLKHLTGLFLHYNALVGDIPRELGNLSELTDLYLNVNNLSGEIPSNIGKMQGLQVLQLCYNNLTGSIPRELSSLRKLSVLALQSNKLTGAIPASLGDLSALERLDLSYNHLFGSVPGKLASPPLLRVLDIRNNSLTGNVPPVLKRLNEGFSFENNLGLCGAEFSPLKSCNGTAPEEPKPYGATVFGFPSRDIPESANLRSPCNGTNCNTPPKSHQGAILIGLVVSTIALSAISILLFTHYRRRKQKLSTTYEMSDNRLNTVGGGFRKNNGSPLASLEYTNGWDPLSDNRNLSVFAQEVIQSFRFNLEEVETATQYFSEVNLLGRSNFSATYKGILRDGSAVAIKRFSKTSCKSEEPEFLKGLNMLASLKHENLSKLRGFCCSRGRGECFLIYDFAPNGNLLSYLDLKDGDAHVLDWSTRVSIAKGIAKGIAYLHSYKGSKPALVHQNISAEKVLIDQRYSPLLSNSGLHTLLTNDIVFSALKDSAAMGYLAPEYTTTGRFTEKTDVYAFGILVFQIISGKQKVRHLVKLGTEACRFNDYIDPNLQGRFFEYEATKLARIAWLCTHESPIERPSVEAVVHELGNCSSCL

SEQ ID NO: 20677 - protein, 374 aa, Glycine max
MVATSTNELEAGTVSRYDRKSEIKVFDESKTGVQGLVENGVTKVPRMFYCEHSNLSDGLTTESNSNFTIPSIDLTGINDDPILRDAVVGKVRYACEKWGFFQVTNHGIPTQVLDEMIKGTGRFHEQDAKVRKEYYTRDMSRKVIYLSNFSLYQDPSADWRDTLAFFWAPNSPNDEELPAVCRDIVPEYSTKVMALASTLFELLSEALGLDRFHLKEMGCDEGLLHLCHYYPACPEPELTMGTSRHTDGNFMTILLQDQMGGLQILHENQWIDVPAAHGALVVNIGDLLQLVTNEKFISVQHRVLANHQGPRTSIASFFRIGDQSPEGLSRVFGPIKELLSEHNPPVYRETSLKDYLAHQYAKSIGASSLSLFKL

SEQ ID NO: 20678 - protein, 118 aa, Silicibacter pomeroyi DSS-3
MTGYLTTHVLDTARGCPAAGLRITLCRIENSARHKIVEMLTNADGRTDAPILPQESFSPGIYELEFAAGDYLRATGQDGVEPLFLDVVPIRFGISDPEAHYHVPLLLSPFGYSTYRGS

SEQ ID NO: 20679 - protein, 568 aa, Solanum tuberosum
  misc_feature (471)..(471): Xaa can be any naturally occurring amino acid
  unsure (1)..(568): unsure at all Xaa locations
MASSALISDTESWKDLRAHVEEINKTHLRDLMNNTNRCQSMMVEFDGILIDYSRQRATFDTLNKLFSLAEAARVKEKIIRMFNGEHINSTENRSVLHVALRAPRDAVINSDGKNVVPEVWHVLDKIRDFSERVRSGAWVGATGKTLKDVVAVGIGGSFLGPLFVHTALQTEAEASECARGRQLRFLANVDPIDVARNITGLNPETTLVVVVSKTFTTAETMLNARTMREWISSALGPQAVAKHMVAVSTNLKLVEQFGIDPNNAFAFWDWVGGRYSVCSAVGVLPLSLQYGFSIVEKFLKGASSVDQHFLSAPFEKNIPVLLGLLSVWNVSFLGYPARAILPYSQALEKLAPHIQQVSMESNGKGVSIDGVPLPYQTGEIDFGEPGTNGQHSFYQLIHQGRVIPCDFIGVVKSQQPIYLKDEVVNNHDELMSNFFAQPDALAYGKTPEQLQKENIPEHLVSHKTFSGNRPXLSILLPSLNAYNIGQLLAIYEHRVAVQGFVWCINSFDQWGVELGKSLATQVRKQLHASRKKGESVEGFNFSTKTLITRYLEASADVPSDPSTLLPNI

SEQ ID NO: 20680 - protein, 470 aa, Silicibacter pomeroyi DSS-3
MADTSIGTPEQLRDPNYTPPLIKAVPLGIQHVLAMFVSNVTPAIIVAGAAGFGFGSNSPDFPELLYLIQMSMLFAGVATLLQTVTLGPVGAGLPIVQGTSFAFLPIMIPLVAGKGVDALAALFGGAILGGLFHFCLGFFIGRIRFALPPLVTGLVVTMIGLALVKVGIQYAAGGVPAIGTPEYGSALNWSAALVVILVTLGLKFFARGMLSVSAVLLGLIVGYVYALMVGMVTFEAIGTSWSRAAGFALPVPFKYGFEFSLAAVIGFAMMAVVSAIETVGDVSGITKGGAGREASDNEIAGATYADGLGTAVAGLFGGFPNTSFSQNVGLIAMTGVMSRHVVTIGALFLILCGLVPKVGAIIRTVPIEVLGGGVIVMFGMVVAAGVSMLSDVHWNRRNMVIFAIALSVGLGLQLEPGAVQHLPDTARILMTSGLLPAAVIAIVLNLILPQELGEEATEEVSGGMDGHGRR

SEQ ID NO: 20681 - protein, 122 aa, Magnaporthe grisea 70-15
MTAINSKDAAPPAGPYSHAIKTPHAIYCSGSIPVDAQGNMVEGTIQQKTEACIKNLAAVLKEAGSSIEKVVKVNIFLADMDNFAAMNEEYAKWFTHKPARSCVAVKTLPKNVDVELECIAMP

SEQ ID NO: 20682 - protein, 617 aa, Solanum lycopersicum
  misc_feature (84)..(84): Xaa can be any naturally occurring amino acid
  misc_feature (189)..(189): Xaa can be any naturally occurring amino acid
  unsure (1)..(617): unsure at all Xaa locations
MASSSLSSIYSPSSSFKSEVKSIHKITSSQLGSIYLPNKSRFHVHAVAREVSASLSAGNNDVVHKLKKENVGLEKNPNALWKRXVEWLYQHKELGLYLDISRVGFSDGFLEEMEPRLQKAFKDMVDLEKGAIANPDEGRMVGHYWLRSPHLAPNSFLRLQIENTLEAVCEFANDVVSGKVKTPSGGRFXQILSVGIGGSALGPQFVAEALAPDNPPLKIRFIDNTDPAGIDHQIAQLGPELASTLVIVISKSGGTPETRNGLLEVQKAFREAGLIFAKQGVAITQENSLLDNTARIEGWLARFPMFDWVGGRTSEMSAVGLLPAALQGIDIREMLAGAALMDEANRTTVVRDNPAALLALCWYWATDGVGSKDMVVLPYKDSLLLFSRYLQQLVMESLGKEFDLDGNRVNQGISVYGNKGSTDQHAYIQQLREGVHNFFATFIEVLRDRPPGHDWELEPGVTCGDYLFGMLQGTRSALYSNDRESITVTVQEVTPRSVGALVALYERAVGIYASLVNINAYHQPGVEAGKKAAGEVLALQKRVLQVLNEASCKQPVEPLTLDEIAERCHCEDDIEMIYKIIAHMAANDRALIAEGNCGTPHSIKVYLGECNVDDLYA

SEQ ID NO: 20683 - protein, 478 aa, uncultured bacterium
MSDKKKFYINGKWVSPKSIKSIEVINPATEDVCAVISLGSKEDVNDAVLSAKEAFKTWAFSSKKERLEPLEKLYELYKKRWSDIAETITTEMGAPKDFSTKLQAGTGAAHIKTFIRYLKEFDFEKPLGEHAKNQRLIYEPKGVCALITPWNWPMNQTCLKVMPALASGCTMILKPSEVAPLSAMILTELIDEAGFPPGVFNLVNGDGATTGDALTSHPDINMISFTGSTRAGALISQNAAKDFKRVSLELGGKGANIIFKDADPEAIERGALRCFRNSGQSCNAPTRMLVEKNMYDEAVERVKKFANNMKVGDPKKEGEHIGPVVSEVQYEKIQSLIQKGIDEGAKLVAGGVGKPDGINKGYFVKPTAFADVNNQMEIARTEIFGPVLSIIPFENEEEAISIANDTDYGLTNYIQTKDKEKANRVARRLRSGMVDVNGAGIAVDAPFGGFKHSGIGREAGKEGLLEFLEVKSVGGWAN

SEQ ID NO: 20684 - protein, 446 aa, Synechococcus sp. WH 5701
MNRSQRTSLITSSDPPPSDAAVLRVPVVVIGAGQAGLSVASCLQQQGLTPVVLERHRVAHSWQHQRWDSFCLVTPNWQCRLPEFPYDGDDPEGFMGRDAIVDYLRRFAYHAAVPVREGIAVERLQPLETGGYRLSTSDGVIETPQVVIATGAYHRPRRHPLAARLPARLLQLDARDYRRPDQLPDGPVLVVGSGQSGCQIAEDLFLAGRRVHLSVGSAPRSPRRYRGKDVVDWLDRMSYYDTPIEQHPDPRSVRRKTNHYLTGRDGGREIDLRRRALEGMVLHGRLEEISVSGFRFAPDLAANLDGADAVYRRIRASIDTYIESNGLEAPEDPAYEPCWQPPPQDPPLDLGDEPLAAVIWCTGYRSDFRWVEVPIFDGAGEPVHQRGVTPAAGLYVLGLPWLHTWGSGRFCGVGSDAAYLAGLIRRQVDRRDANQERLECTALLGS

SEQ ID NO: 20685 - protein, 350 aa, Schizosaccharomyces pombe 972h-
MTCRIAIRKYSFILCLAVGSVTIYTSEVIGTPLYFVNKELYNKYIAFTKSFAGILFTALVQLFSPTPVTLTYDPELRNLFYLDRNGCLETIAAERNIVIANHQLYSDWMYVWWLSYTAKQHGHVYIMLKNSLKWLPVIGWGMQLFRFIFLSRKWDKDYETMSRHFKFIRNVRDSVSLILFPEGTNLVESTYQRSRVYADKIGVKMPKHLMLPRVRGLFYSISQLRDSMTYLYDYTFYFSDPSPKKYAADAFSLPKLFFEGVPIKRLHIHVRRFPISEIPTEEDQFTDWLYQRWYEKDKLIDTLLETGNFPGPKKLHTTVRLKHRLEILSLFSVLFTCIVAGLFLKLFISH

SEQ ID NO: 20686 - protein, 418 aa, Synechococcus sp. WH 5701
MTDLARYAADHGLRHFLFSFSDLFGVQRAKLVPASAVNQLARDGAGFAGFAAWLAMTPADPDVLGLPDPASLAVLPWQRSVAWVATDLQVEGRPLEQSPRWVLRRQLERATQLGYSFRTGVEAEFFLLQPGGTAIADVHDTQSKPCYDQLALMRQFELIGGLLEAMEELGWGPYQADHEDANGQFEINWTFADALVTADRHALFRVMAQSMAEPLGARVSFGPKPFPQLTGSGAHLHHSLWDDSGRNLFHDPRGELGLSRLAYHFLGGLLEHAPALCAITNPTAESYARLGGQTTNSGATWSPGWISYGGNNRSHMVRIPDDQRLELRLADSAANPYLLPAAVLAAGLDGLERQLDPGPRNDANLYTDPPAPGTATPLPATLKEALAAFAADTVLREALGESFCQAYESLRARHSASL

SEQ ID NO: 20687 - protein, 111 aa, Streptococcus pyogenes SSI-1
MKERYFFCDVVGKCLEEYVDRGIFDKEPFQTFDQKGIGRLFSTAVSLARSVKPDLKLGICGEHGGDPTSIAFCHSQGLTYVSCSPFRVPLTRLAAAQAAIKASGHSLTQDK

SEQ ID NO: 20688 - protein, 351 aa, Staphylococcus aureus subsp. aureus Mu50
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCKSKDYNLCNHRKGIGTQVDGVFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDIIRKKGFYSQIGIFKDAEIPFDMEKVIQKEITVVGSRSQKPADWEPSLQLMADGLVNAEALVTKIYDISKWDEAYQHLKSGEGIKALLKPLDLDENEGEN

SEQ ID NO: 20689 - protein, 535 aa, Oryza sativa (indica cultivar-group)
MLLFGRKRLLAVLGSCCTILSLLTPTQCASSSPDSLNQSYKIVQPLELTPKLSLQLKLHAFLLWSSVGFLMPIGVLLIRVTSNVKSTRSIRILFYCHVASQIVAVILATAGAVLSISNFENAFNNTHQRIGLALYGFIWLQPLIGFLRPDRGVRFRSIWYLTHWLLGIAICVVGVANVYIGMHTYHERTGRSVRPWTVLLTVEVSAMAFVYLFQDRWNHVVRQQQQQEAAALGDDDDDDDEQSEEHVYPANDHKEVAVVPDGSHGGGGGSWVGEDGRVWHSHDGLAPHSHEPIYSPGDFSKRAPPLISRRFAERAFTVGIGGPVGTGKTALMLALCRSLREKYSLAAKAVEKVSESSMSGAAAAARASRCHDELASLFAERPPNGAMPGMLQQQQPWSFIDYHHHLMQESAPTTPPLDYEAFAGEFDDDVAPLEEVKRELVVDGVGLFPGGGASAAAAAAAVAGPMTPNSMSVSSTSSEACGVGGGAGGDEESAGKCKKEEEGDGGDDDGKEGSSTTKGDGDGEDKNKKGLLLMP

SEQ ID NO: 20690 - protein, 171 aa, Oryza sativa (indica cultivar-group)
MVTNDIFTKEDGEFLIKHGALPEERIRAVETGGCPHAAIREDISINLGPLEELSNLYKADLLLCESGGDNLAANFSRELADYIIYIIDVSGGDKIPRKGGPGITQADLLIINKTDLAPAVGADLAVMERDALRMREGGPFVFAQVKHGVGVEEIVNHILQAWEIATGNKRR

SEQ ID NO: 20691 - protein, 342 aa, Rauvolfia mannii
KLSDSQTMALFTVFLLFLSSSLALSSPILKEILIEAPSYAPNSFTFDSTNKGFYTSVQDGRVIKYEGPNSGFVDFAYASPYWNKAFCENSTDAEKRPLCGRTYDISYNLQNNQLYIVDCYYHLSVVGSEGGHATQLATSVDGVPFKWLYAVTVDQRTGIVYFTDVSTLYDDRGVQQIMDTSDKTGRLIKYDPSTKETTLLLKELHVPGGAEVSADSSFVLVAEFLSHQIVKYWLEGPKKGTAEVLVKIPNPGNIKRNADGHFWVSSSEELDGNMHGRVDPKGIKFDEFGNILEVIPLPPPFAGEHFEQIQEHDGLLYIGTLFHGSVGILVYDKKGNSFVSSH

SEQ ID NO: 20692 - protein, 344 aa, Rauvolfia serpentina
MAKLSDSQTMALFTVFLLFLSSSLALSSPILKEILIEAPSYAPNSFTFDSTNKGFYTSVQDGRVIKYEGPNSGFVDFAYASPYWNKAFCENSTDAEKRPLCGRTYDISYNLQNNQLYIVDCYYHLSVVGSEGGHATQLATSVDGVPFKWLYAVTVDQRTGIVYFTDVSTLYDDRGVQQIMDTSDKTGRLIKYDPSTKETTLLLKELHVPGGAEVSADSSFVLVAEFLSHQIVKYWLEGPKKGTAEVLVKIPNPGNIKRNADGHFWVSSSEELDGNMHGRVDPKGIKFDEFGNILEVIPLPPPFAGEHFEQIQEHDGLLYIGTLFHGSVGILVYDKKGNSFVSSH

SEQ ID NO: 20693 - protein, 196 aa, Zea mays
WYPAVRSGFLLNHASAIVFAVENNLWAIGMSHIRATSDPEIWKKGPAFGMPGVHVDGMDVLKVREVAKEAIERARRGEGPTLVECETYRFRGHSLADPDELRKPDEKTHYAARDSITALKKYIIEQNLATESELKSIEKKIDDVVEEAVEFADASPHPPRSQLLENVFADPKGFGIGPDGKYRCEDPKFTQGTAQV

SEQ ID NO: 20694 - protein, 207 aa, Hypocrea jecorina
MPLCGGSKTVQRKLVLLGDGASGKTSLLNVFTRGYFPTVYEPTVFENYVHDIFVDNVHIELSLWDTAGQEEFDRLRSLSYDDTDLIVLCYSVDSKDSLENVESKWVGEIADNCPGVKLVLVALKCDLRQQEDDEPEDQAAADGNAQREKPPTISYDEGLEVAKRIGASRYLECSAMKNRGVNEAFTEAARVALSVKKEREDNKCTIM

SEQ ID NO: 20695 - protein, 264 aa, Hypocrea jecorina
MGHEDAVYLAKLAEQAERYEEMVENMKIVASEDRDLTVEERNLLSVAYKNVIGARRASWRIVTSIEQKEESKGNSSQVALIKEYRQKIEAELAKICDDILEVLDQHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSAGQVEAPPKEDTPAEAAAPAEEPKAE

SEQ ID NO: 20696 - protein, 209 aa, Bacillus subtilis subsp. subtilis str. 168
MKQADELRFNEDGLIPAIVQDAASKEVLTLAYMNKESYEKTLETKETWFYSRSRQALWHKGETSGNTQAVKGIRYDCDQDALLVLVEPSGPACHTGSYSCFTKEQTEEQAADRFGIMNELERVIAERQAEMPEGAYTTYLFREGVDKILKKVGEEASEVIIAAKNRDHEELKWEAADLLYHLLVLLREQSLPLDDVLDVLKKRHSEIEE

SEQ ID NO: 20697 - protein, 479 aa, Cryptococcus neoformans var. neoformans JEC21
MASRNPVVTRRAATRSRNDENAAPQQSVRTKPSISHLGPASKTAAVNVSVAAGKKPVAVKVGAKRTALGGVVVNGKGETEAGKKPLKASGKTVTEARQPLASRQNNAQPTRPIAAIPHRSKATPANVYAPVEAPAKLTVEEDMQMEIDARRSQPVSNAADFATVDEELLDDESEEDDMEEEDEEDWLRMSEEEMVKAQEQLDVVQATFKDDVDMFDTTMVAEYADEIFEHMERLEESVMPNPRYMDFQTEIEWTMRTTLIDWLLQVHLRYHMLPETLWIAVNIVDRFLSTRVVSLVKLQLVGVTAMFIAAKYEEILAPSVEEFVYMTENGYTKDEILKGERIILQTLDFTISSYCSPYSWVRRISKADDYDVQTRTLSKFLMEVTLLDHRFLRCKPSMIAAIGMYLARKMLGGDWNDAFIYYSNFTESQLITGASLLCERLIEPDFESVYVYKKYANKKFLRASTFARDWALTNAANSS

SEQ ID NO: 20698 - protein, 272 aa, Hypocrea jecorina
MATERESKTFLARLCEQAERYDEMVTYMKEVAQLGGELSVDERNLLSVAYKNVVGTRRASWRIISSIEQKEESKGSDKHVATIKEYRSKIELELEKVCEDVLNVLDTSLIPNAATGESKVFYHKMKGDYHRYLAEFASGEKRKVAATAAHEAYKNATDVAQTELTPTHPIRLGLALNFSVFYYEILNSPDRACHLAKQAFDDAIAELDSLSEESYRDSTLIMQLLRDNLTLWTSSDSGEAEQAGEAKKDEGEAAKPAEEEPKAEEPAPEATS

SEQ ID NO: 20699 - protein, 253 aa, Zea mays
  misc_feature (213)..(213): Xaa can be any naturally occurring amino acid
  unsure (1)..(253): unsure at all Xaa locations
MERRLSATSRRSAPSAIQRLSHLAQRVGAVNLAEGFPDFPAPPHVKAAAVAAIAADLNQYRHVQGICDILANTMKRDHDLDVDPLTDFVICCGQSEAFAAAIFAIIDQGDEVLIFDPAYETYETSIELARGVPVYVPLDPPSWTLNEEKFLKSFTSRTKALVLNSPHNPTGKVFSKEELLIISQACQKMDCFVITDEGYEYITYDANKHISLXASLPGMQDSTIITSSLSKTYSVTGWRLGWACAAAKHRLSY

SEQ ID NO: 20700 - protein, 688 aa, Ustilago maydis 521
MSASQSRTSTRPSSEVERNTYANGSTTSRGNGHARQRSNTASSVRSNGTVRAPRVSMEDNTSPLARFGIKGDGLMLFVTCFASLGVFLFGYDQGVMSGIITGPYFKAYFKHPTAYEIGTLVASLELGALVTSLACGRLADIFGRKNTLFWGAVIFSVGGAIQTFTSGYDTMLIGRVISGLGVGVLSMIVPTYQSEISPAENRGKLACIEFTGNIIGYASSVWVDYFSSFIESDLSWRLPLSLQVVIGATLAFGSVLLPESPRWLLDKDMDEQGMRVLADLHGAGDPNEPRAKLEFREIKENVLYLRKQGDNSYKRMLTQYRYRTMIAMSSQMFAQLVGINSVCYYLPMILESAGWIGRDALLMTGVNGIIYTLATVPTWFLIDLWGRRIILLSGAIGCGAALTACSYFMYLDQSYTPQAVVGCIIVFNAWFGYSWGPVPWLYPPEILPLAFRAKGASLATATNWSFNWLVGELTPILMEKIAWRLYLILAFFAGLAFVTVYFGYPETSGVPLEEIGALFGDEINVPQDEEDDDDDDDQQDEDGQGGSGERIRPRVSVDGSQDGAEYTPRPIRRSISSHPRLQSEEERAARAAAARVAAEERQVAQSFFRLGGGGPFGWVSRLLRGGKREGPPDRSLGSSMGEAASSGKQVLPKREVLLLQQLGPRDDHHVLILDEDEQDGVTERELPR

SEQ ID NO: 20701 - protein, 321 aa, Bordetella pertussis Tohama I
MNLPELIAPIADDMKAVDTVIRDRLNSDVVLIRTIGDYIIGAGGKRMRPAMVLMVARALGYQGTHHQLLAAVVEFIHTATLLHDDVVDESDLRRGRDTANAVFGNAASVLVGDYLYSRSFEMMVEADSMRIMQILSQATTVIAEGEVLQLLNVHDPDVSQERYLQVVRYKTAKLFEAAAQVGAVLAGASPEQETAAAAYGRHVGTAFQLVDDVLDYSGDAHALGKNVGDDLREGKPTLPLIRVMETGTPEQRELIREAIKTGQADFAAVAQAIQATDALAHARQAAENEAELARQALSAFPVSLYQKSLLEFCAFAVNRDR

SEQ ID NO: 20702 - protein, 347 aa, Staphylococcus aureus subsp. aureus Mu50
MKALKLYGVEDLRYEDNEKPVIESANDVIVKVRATGICGSDTSRYKKMGPYIKGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDLAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 20703 - protein, 242 aa, uncultured bacterium
MTRPAAVVARRMAIPCVSGSSEIDITYEQKIFRTSSNVQFKEGDVLTIDGSTGRAILDKVPTIKPEISGDFSKLMSWADRYRKLKVRTNSETPLDTKTAREFGADGIALCRTDHMFFDEDRILSVTEMILSKTIKDRNNALAKLLPHQKNDFIQIFELMNGLPVTDRLLDPPLHEFLPKNDKDIGDLTSVTRLNANEIRSRTDELHEHNPMLGHRGCRLGISFPEIYEMHCLAFFEALGECK

SEQ ID NO: 20704 - protein, 532 aa, Mesorhizobium sp. BNC1
MIFRFFRIVAAASSLILLYLGERRRGVGADASALPVRLRQMLDELGGSFIKIGQALSMRPDLFPEAYLRQLRDLREHARPFSAQEARAELENAMRRPLDEVFRTFESEPFAAASIAQVHRATLTDGQDVIVKIRRPHMRERIDGDMRILVGVARLAGVAVPGLRRFQPARLAREIWANLRRETDLLQEARNIRRFREAYKQRADVYVPAAFEALCSEAILVQVMSHGRSIEDPAVVQDGPRIAGVLVDFYLEQLLKTGLFHGDPHPGNLFVMEDGRICFHDFGLVGYLDRTTRRNLGIFLQAFVQQDAGWMLDAAIALSLIDRQAERTLFVQGIEEILSDYSSLPLKDWSIADAFLRVMRLGDGAHVVVPYNLMVFVRALFLIEGCLRRLDPDFNVLDTLIAKGEAAVAHTLGGRPDRAAMARLKTELALSAEDLPALLASWLHRAHQDGGDLALGLRVHHSDETERRLDRRAVLAALALLSVGILVTSALLAEARVGPDVLGLPVAALIGFVVAIWLCLRVLGLVSSLWRR

SEQ ID NO: 20705 - protein, 344 aa, Polaromonas sp. JS666
MSAITELVNHQVRLASRPAGLPTRANWNFTTEPVAEPGPGGVLVKTLYLSLDPAMRGWMNDAKSYIPPVELGAVMRAGGVGKVIASQNPAFAVGDYVNAGLDVQEYCLIPADQIKRSGMFKIDPRLGLTSWLNVLGLPGMTGYFGLLEVGLPKAGETVVVSGAAGAVGQTVGQIARLKGCRVVGIAGGKAKCDWVVNELGFDACIDYKNSDVRAGLKEHCPKGVDIYFDNVGGEILDLVLAKLARGARIIICGAISQYNNTTPVKGPANYLSLLVNRARMEGIVVFDYADRYHLAVAELAGYLKAGTMKSKEDVVVGLDTFPETLLKLFNGENFGKLVLQVAKE

SEQ ID NO: 20706 - protein, 212 aa, Oryza sativa
SSKGAAAAPAPKVVAVLAGLLERAAARGDADADARGGSAAAAAATAFRGRTRPEISVRRYAERIYRYAGCSPACFVVARVYLDRLAGRSPAVCVDSYSVHRLLITSVMVAAKFMDDIHYNNAYFARVGGVEVAEMNGLELELLFALRFRLNVTPATFATYCAALEGEMAADDGPLPSPSPSPEEEGNDRRQPPPRRKDGITNKVAAAVDRSA

SEQ ID NO: 20707 - protein, 468 aa, Aspergillus nidulans FGSC A4
MSFVRAASRRMPLAKRLVSAVESPMQRRYVSATLKAQGAVVTPDPGADSVSAAFVNERAPYLVPTYVRPAPIMVKGQGCYLWDMENRRYLDLTAGIAVNSLGHCDPEISKIIAEQAETLLHASNLYHNAWVGALSKDLIILTRESGAMRDAAQVFIANSGTEANEAAIKFARKTGRARDPSGAKHEIVSFHNSFHGRTMGALSATPNPKYQTPFSPMLPGFKYGKYNDVAQLKDLVTEKTCGVIVEPIQGEGGVNVATPEFLSALRKRCDDVGAVLIFDEIQCGLSRTGSFWAHAHPSLVPSSGEAAHPDILTTAKALGNGIPIGATIVSGKTVADNIKAGDHGTTFGGNPLACRVAHHIIHRLASPELQKSVQDKSAILVAGFQALQQKYPDLVSEVRGRGLILGLQLSKDFSARAGEIVTAARERGMLIITAGEGCLRFVPPLTITEEQLKTALRILEQAFEAVKA

SEQ ID NO: 20708 - protein, 90 aa, Plantago major
HRRSGSSSSSSSEDDGMGGRRKKGLKDKIKDKLPGHHGDQTQQTTGAGYGTGTGAGYGTGTGAGYGGEGHEKKGMVDKIKDKIPGMGGNR

SEQ ID NO: 20709 - protein, 472 aa, Spiroplasma citri
MNLELNALINGELINNGDWLEIISPINNKPYGRVPALKEKEINEAFKGVRHSQKAWAKLTLFERISYLQKWAKLLESHKTELAKIMAHEVGKSLKDGQIEVERSIEYIDYTIEEAKRVFPETLTGDGWNVKNKIGIFSRVPKGVVLAISPFNYPVNLSIAKIAPSLVVGNTVVFKPATNGSLTGLYMAKLAFEVGFPKGVFNVVTGRGRDIGDLLVLNPEINVISFTGSVAVGNHIRKLGHGKDLVLELGGKDPVLVLKDADLAKAVKEIVAGAYAYSGQRCTAIKRVLVDETIAAELVQLLKIEVGKLEVGSPLDNKAIIPVIDLKAADFVQGLIDDALAKKATLVLGNQRKDNLLSATLIDHVTPEMRLAWEEPFGPVLPIIRCKNVEEMITLANKSNFKLQACIFTKDINAAFNIANELETGTVNINGRTQRGPDSFPFLGIHDSGQGVQGIRETINSVTRFKGLVINY

SEQ ID NO: 20710 - protein, 194 aa, Bacillus subtilis subsp. subtilis str. 168
MRKAERVRKTNETDIELAFTIDGGGQADIKTDVPFMTHMLDLFTKHGQFDLSINAKGDVDIDDHHTTEDIGICLGQALLEALGDKKGIKRYGSAFVPMDEALAQVVIDLSNRPHLEMRADFPAAKVGTFDTELVHEFLWKLALEARMNLHVIVHYGTNTHHMIEAVFKALGRALDEATTIDPRVKGIPSTKGML

SEQ ID NO: 20711 - protein, 144 aa, Triticum aestivum
ATPFCKKKKKKKKKRAAAAQQANNVRATYHYYRPAQNNWDLGAPAVSAYCATWDASKPLSWRSKYGWTAFCGPAGAHGQAACGKCLRVTNPATGAQVTARIVDQCANGGLDLDWDTVFTKIDTNGVGYQQGHLNVNYQFVDCRD

SEQ ID NO: 20712 - protein, 259 aa, Clostridium difficile 630
MEENMKRKVQVKNITIGEGRPKICVPIIGKNKKDIIKEAKELKDACLDIIEWRVDFFENVENIKEVKEVLYELRSYIHDIPLLFTFRSVVEGGEKLISRDYYTTLNKEISNTGLVDLIDVELFMGDEVIDEVVNFAHKKEVKVIISNHDFNKTPKKEEIVSRLCRMQELGADLPKIAVMPQNEKDVLVLLEATNEMFKIYADRPIITMSMSGMGVISRLCGEIFGSALTFGAAKSVSAPGQISFKELNSVLNLLHKSIN

SEQ ID NO: 20713 - protein, 186 aa, Paxillus involutus
MEDEVAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNAPAFYVAIQAVLSLYASGRTTGIVMDSGDGVTHTVPIYEGFALPHAILRLDLAGRDLT

SEQ ID NO: 20714 - protein, 493 aa, Bordetella pertussis Tohama I
MSLSVGNAALLPGRNLIGSEWREAALGARFAVADPATGKVIAHVPDSGARDAGAAVTAAHQAFADWRRTPAKVRAQIIKRWNALLHENAEDLARLISSEQGKPLAEARGEVSYAASYVEWFAEEATRADGDLIPSPAQGRRMFALREPVGVVAAITPWNFPAAMIARKIAPALAAGCTVVCKPAEDTPLTSLALTALAQQAGVPPGVLNIVTASRGRAAEVADAWLDDPRVRKITFTGSTPVGKHLARRSADTLKRVSLELGGNAPFIVFDDADLDAAVEGLMVSKFRNGGQTCVCPNRIFVQAGVHDAFVRKLAARVEGLVVGPASDPASQIGPMINARAVEKIEHHVADALERGARLAVGGKRIHSARCAGDHYYAPTVLTGVDETMACFREETFGPVAPITVFASEAEVVAAANATAFGLAAYFYSTDVRRIWRLADALETGIVGVNEGALAAEAAPFGGVKDSGYGREGSRHGLAEYMQIKYVCQGQLD

SEQ ID NO: 20715 - protein, 331 aa, Arabidopsis thaliana
MSFFRSKTSKTETQQPSSYGQQQDAMYSSYGTVSDEVLLQIHGCRAHLINGSEAVELAAGDFELVQVLDSNVALAMVVRIGNDLQWPVIKDEPVVKLDSRDYLFTLPVKDGEPLSYGITFFPIDENDIVFVNSIELLDDFLRENSCFSSSPSSSSSSSSSSSSSVNNGIDWKEFAPKIEDYNNVVAKAIAGGTGHIIRGMFKCSNAYTNQVHKGGEIMITKAEKKNGASSKRNATTNKNQINKNLQRVRKLSRATEKLSKTMLNGVGVVSGSVMGPVVKSKPGKAFFSMVPGEVLLASLDALNKLLDAAEAAERQTLSATSKALQEWLVRG

SEQ ID NO: 20716 - protein, 345 aa, Glycine max
MKRLLLITNCLLLTIGTSGGPLVMRLYFLHGGHRVWLSSFLETAGFPLMLLPLAVSYFRRRRTASAAGTAKPKLISMKPPLLAASTFIGILTGLDDYLYAYGVARLPVSTSALIIATQLGFTAFFAFLLVRQKFTAYSINAVVMLTVGAGVLALHTSGDRPPGESVKEYVMGFVMTVIAAALYGFVLPLIELVYQKIKQPLTYSLVMEIQFVMCFSATLFCLLGMIINNDFKVIPREAKQFEHGEGSYYAVLVGSAIIWQVFFLGAIGVIFCASSLFSGILIAVLLPVTEVLAVIFYKEKFQAEKGVSLLLSLWGMVSYFYGEIKHSRKRKKKNSDPEAEPSQYS

SEQ ID NO: 20717 - protein, 281 aa, Ostreococcus tauri
  misc_feature (1)..(1): Xaa can be any naturally occurring amino acid
  unsure (1)..(281): unsure at all Xaa locations
XRPGTRGRSHIGTYPTALTETFWRALAEESGMSLRLTKRRGDNAHHIVESTFKAFARGLRAAMDSVEGIDVYDSKTPSEEAPRKSEIKRSTKETSIDVELDLDGDASTSKISTGIVALDGLLSSIQREANIQLVINASGDLWIDDHHTAEDVSIALGQALNKALATKKGCNRMGSAMSTEGDATVECVMDLSNRPYLGYGLEFDCDKVGGDLSVEMVEHVFMSLAFNGQMTVHLIEHSRGVNEDEVATAAAKAFGKCLRQCAAIDPRRAGSVASSKGTLSV

SEQ ID NO: 20718 - protein, 304 aa, Staphylococcus aureus subsp. aureus Mu50
MTNKVVILGSTNVDQFLTVERYAQPGETLHVEEAQKAFGGGKGANQAIATARMQADTTFITKIGTDGVADFILEDFKAAHIDTSYIIKTTEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSLGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 20719 - protein, 779 aa, Saccharomyces cerevisiae
MPTTYVPINQPIRDGEDVIDTNRFTNIPETQNFDQFVTIDKIAEENRPLSVDSDREFLNSKYRHYREVIWDRAKTFITLSSTAIVIGCIAGFLQVFTETLVNWKTGHCQRNWLLNKSFCCNGVVNEVTSTSNLLLKRQEFECEAQGLWIAWKGHVSPFIIFMLLSVLFALISTLLVKYVAPMATGSGISEIKVWVSGFEYNKEFLGLLTLVIKSVALPLAISSGLSVGKEGPSVHYATCCGYLLTKWLLRDTLTYSTQYEYLTAASGAGVAVAFGAPIGGVLFGLEEIASANRFNSSTLWKSYYVALVAITTLKYIDPFRNGRVILFNVTYDRDWKVQEIPIFIALGIFGGLYGKYISKWNINFIHFRKMYLSSWPVQEVLFLATLTALISYFNEFLKLDMTESMGILFHECVKNDNTSTFSHRLCQLDENTHAFEFLKIFTSLCFATVIRALLVVVSYGARVPAGIFVPSMAVGATFGRAVSLLVERFISGPSVIIPGAYAFLGAAATLSGITNLTLTVVVIMFELTGAFMYIIPLMIVVAITRIILSTSGISGGIADQMIMVNGFPYLEDEQDEEEEETLEKYTAEQLMSSKLITINETIYLSELESLLYDSASEYSVHGFPITKDEDKFEKEKRCIGYVLKRHLASKIMMQSVNSTKAQTTLVYFNKSNEELGHRENCIGFKDIMNESPISVKKAVPVTLLFRMFKELGCKTIIVEESGILKGLVTAKDILRFKRIKYREVHGAKFTYNEALDRRCWSVIHFIIKRFTTNRNGNVI

SEQ ID NO: 20720 - protein, 148 aa, Haemophilus influenzae
MIKKIAVLTSGGDAPGMNAAIRGVVRSALAEGLEVFGIYDGYQGLYNNKIKQLNRYSVSDVINRGGTFLGSARFPEFKDPNIRAKCAEILRSHGIDALVVIGGDGSYMGAKLLTEEHSFPCVGLPGTIDNDVAGTDYTIGYQTALQTA

SEQ ID NO: 20721 - protein, 284 aa, Chenopodium rubrum
MEGKEEDVRLGANKYSERQPLGTSAQSKDYKEPPPAPLFEPGELQSWSFWRAGIAEFMATFLFLYITVLTVMGVKRSPNMCASVIQGPSWAFGGMIFALVYCTAGISGGHINPAVTFGLLLARKLSLTRAVFYMVMQCLGAICGAGVVKGFQPTPYDVLGGGANKVNHGYSKGDGLGAEIVGTFVLVYTVFSATDAKRSARDSHVPILAPLPIEFAVFLVHLATIPITGTGINPARSLGAAIIYNKERSWNDHWIFWVGPFIGAALAAVYHQIVIRAIPFKSKG

SEQ ID NO: 20722 - protein, 451 aa, Shewanella sp. MR-4
MAQHFDYICLGAGSGGIASANRAAMRGAKVLLIEAKHVGGTCVNVGCVPKKVMWYGAHIAEAMHLYAKDYGFDVSVNKFDWNTLVNSREAYIGRIHEAYGRGFTNNKVTLLNGYGRFVNGNTIEVNGEHYTADHILIATGGAPTIPNIPGAEYGIDSDGFFALREQPKRVAVVGAGYIAVEVAGVLHALGSETHLFVRKHAPLRNFDPMLIDALVDAMKTEGPTLHTNSVPQSVVKNADDSLTLHLENGESMTVDCLIWAIGRSPATGNIGLENTDVQLDSKGYVITDAQQNTTHKGIYCVGDIMAGGVELTPVAVKAGRLLSERLFNGMSDAKMDYSQIPTVVFSHPPIGTMGLTEPEARAQYGDDNVKVYTSSFTSMYTAVTSHRQACKMKLVCAGKEEKVVGIHGIGFGMDEILQGFGVAMKMGATKADFDAVVAIHPTGAEEFVTMR

SEQ ID NO: 20723 - protein, 420 aa, Oryza sativa
MDRASENRRLAAVGKPVPGIGEMGNRRPLRDINNLVGAPSHPSAIAKKPMLEKSGKEEQKPALVVSHRPMLRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLSAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 20724 - protein, 470 aa, Oryza sativa
MAAAAPAGAQNRCVFVGNIPYDATEEQLVQICEEVGPVVSFRLVIDKETGKPKGYGFCEYKDEETALSARRNLQGYEINGRQLRVDFAENGRNADRNREKGRGGPGMASSVDTQKQLAGTPVVGDTGLHQPVGLPSAIHAASVMAGILGGSQTANVQNGLPVQYGLGNDPLTHYLARMSKHQLYEIMSELKSLTSQNKDVANKLLQGIPQLSKALFQSQIMLGMVTPQMMQMAKSQQPSSSLAQSSSHISEPFPQPDAMISTLPNPNVLQDPSAQLHNFPQYPHSSQPAGTIFPHWKSVWGWAITFLQLYSQPLGASSSVPPLPLATSGSLISQVQPPFMPHHPRPPAMPAGMQQLPLTHPHVPQVPAIPDIAQKEMRFPEQANRSTEFAHHPKLRKLEDGTSTPGIVNNNPAVYPAPSQGMLPVPQLTPDVESALLQQVLQLTPEQLSSLPVEQQQQVIQLQKMLSAGK

SEQ ID NO: 20725 - protein, 232 aa, Nanoarchaeum equitans Kin4-M
MHMPKNIKVKPHKLEGVYIGNNKFLLTKNLVKGQKVYTERIFKSKGEEYREWIPFRSKLASAIKKGLKTWPFKKGTIVLYLGIASGTTASHISDIIGEEGIIFGVEFAPRVLRELMFVAKKRKNIVPILADANQPETYQHIVVQSDVIYQDVAQPHQVEIFLKNLRFFAKPNAIGFLAVKARSIDVTKDPKVIFREVERKLREAKLQLLESIRLDPYHKDHMMFVVKVPKAW

SEQ ID NO: 20726 - protein, 494 aa, Ostreococcus tauri
MESDYGVVNGFDEPPHAYIKSLLSRKIIEKKLAKKFFSGDVARVENEYDSISEEDLEKFFIDEFGGGTFRAGREYSFVLYGGSGYTGSLCMEYILKNVSDLGERVTFALAGRSEAKLRARWKEVTERHPTNYEPGFITCDLSDPVAIRAMVISARAVVNIAGPFMLTPADMLAEACIEYDTDYIDVNGEVPFTKKLLKYHDWAKANRVLVVPNSAGAGGIPDVGCYYTVRELRNKLSQEVSVSKMHMYLYGSAAGAPSGGTLATRAAMNAAMKDVAGLMANPFALGGSIDGGRRPEDADRNLSQVEYDEEYDAWKAPFTYAFYETRLVRRSNWLMRDLGMSPYGRQLNYLEHLIMPSEESAQALQKSNTSSKAEEEKLRKEGRLFKLGQGLDEQARESIWSEYWFDACTATGERIRTRLTGKDGYDETAHMSIELAILCSEYREKLPFKGGVLTPGVAGGDAYIEALHATGLRFEVMADDAKVDFSLMIAENKS

SEQ ID NO: 20727 - protein, 1262 aa, Hordeum vulgare
MAHVAGLLASAVVSAVGNKLGSAIGDEVTMLWSFKDDLKDMKDTLESMEAVLKDAERRSVKEELVRLWLNRLKHAAYDISYMLDEFQANSEPASRKMIGKLDCFAIAPKITLAYKMKKMRGQLRKIKEDHESFKFTHANSSLINVHQLPDPRETSSNVVESLIIGREKDRMNVLSLLSTSNNIKEDFTVLPICGLGGIGKTTLAQLVFNDAQFNDYHRVWVYVSQVFDLNKIGNSIISQVSGKGSEHSHTLQHISKQLKDLLQDKKTLIVLDDLWETGYFQLDQLKLMLNVSTKMKVLVTTRSIDIARKMGNVGVEPYMLDPLDNDMCWRIIKQSSRFQSRPDKEQLEPNGQKIARKCGGLPLAAQALGFLLSGMDLSEWEAICISDIWDEPFSDSTVLPSLKLSYNTLTPYMRLCFAYCGIFPKGHNISKDYLIHQWIALGFIEPSNKFSAIQLGGKYVRQFLGMSFLHHSKLPETFGNAMFTMHDLVHDLARSVITEELVVFDAEIVSDNRIKEYCIYASLTNCNISDHNKVRKMTTIFPPKLRVMHFSDCKLHGSAFSFQKCLRVLDLSGCSIKDFASALGQLKQLEVLIAQKLQDRQFPESITRLSKLHYLNLSGSRGISEIPSSVGKLVSLVHLDLSYCTNVKVIPKALGILRNLQTLDLSWCEKLESLPESLGSVQNLQRLNLSNCFELEALPESLGSLKDVQTLDLSSCYKLESLPESLGSLKNVQTLDLSRCYKLVSLPKNLGRLKNLRTIDLSGCKKLETFPESFGSLENLQILNLSNCFELESLPESFGSLKNLQTLNLVECKKLESLPESLGGLKNLQTLDFSVCHKLESVPESLGGLNNLQTLKLSVCDNLVSLLKSLGSLKNLQTLDLSGCKKLESLPESLGSLENLQILNLSNCFKLESLPESLGRLKNLQTLNISWCTELVFLPKNLGNLKNLPRLDLSGCMKLESLPDSLGSLENLETLNLSKCFKLESLPESLGGLQNLQTLDLLVCHKLESLPESLGGLKNLQTLQLSFCHKLESLPESLGGLKNLQTLTLSVCDKLESLPESLGSLKNLHTLKLQVCYKLKSLPESLGSIKNLHTLNLSVCHNLESIPESVGSLENLQILNLSNCFKLESIPKSLGSLKNLQTLILSWCTRLVSLPKNLGNLKNLQTLDLSGCKKLESLPDSLGSLENLQTLNLSNCFKLESLPEILGSLKKLQTLNLFRCGKLESLPESLGSLKHLQTLVLIDCPKLEYLPKSLENLSGNRF

SEQ ID NO: 20728 - protein, 257 aa, Zea mays
  misc_feature (14)..(14): Xaa can be any naturally occurring amino acid
  unsure (1)..(257): unsure at all Xaa locations
IRLLDPPLHEFLPXGNVEEIVRELCAETGANEEEALERVEKLAEVNPMLGFRGCRLGISYPELTEMQARAIFEAAIAMSNQGVEVFPEIMVPLVGTPQELGHQVNVIKQTAEKVFANAGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKVGLDYVSCSPFRVPIARLAAAQVLV

SEQ ID NO: 20729 - protein, 397 aa, Burkholderia pseudomallei K96243
MSQVKRLTDLIAEGKLSGKRVFIRADLNVPQDDHGNITEDTRVRASVPAIQAALDAGAAVMVTSHLGRPTEGEFKPEDSLAPVAKRLAELLGRDVPLVANWVENGVEVAPGQVVLLENCRVNKGEKKNSDELAQKMAKLCDVYVNDAFGTAHRAEATTHGIAKYAPVACAGPLLAAELDALGKALGNPKRPLVAIVAGSKVSTKLTILKSLAEKVDQLIVGGGIANTFMLAAGLAIGKSLAEADLVGEAKAIIDEARKRGASVPIPTDVVVAKEFSPTAAATVKKVADIEADDMILDIGQDTAKALAGQLEKAGTIVWNGPVGVFEFDQFGNGTKTLADAIASSAAFSIAGGGDTLAAIAKYGIHDKVSYISTGGGAFLEFLEGKKLPAVEVLETRA

SEQ ID NO: 20730 - protein, 427 aa, Oryza sativa (japonica cultivar-group)
MHGHGGGMMEADDEEIVAAVASGALPSHRLESRLGDCRRAARLRREALRRVTGRGVEGLPFDGMDYQAILGQCCEMPVGYVQLPVGVAGPLLLDGREYHVPMATTEGCLVASVNRGCRAISASGGAFSVLLRDAMSRAPAVKLPSAMRAAELKAFAEAPANFELLAAVFNRSSRFGRLQDIRCALAGRNLYMRFSCITGDAMGMNMVSKGVENVLGYLQNVFPDMDVISVSGNYCSDKKPTAVNWIEGRGKSVVCEAIIKGDVVQKVLKTTVEKLVELNIIKNLAGSAVAGALGGFNAHASNIVTALFIATGQDPAQNVESSQCITMLEEVNDGDDLHISVTMPSIEVGTIGGGTCLASQAACLNLLGVKGSNHGSPGANAKRLATIVAGSVLAGELSLLAALASGHLVKSHMMYNRSSKDVAKAAS

SEQ ID NO: 20731 - protein, 246 aa, Mesorhizobium sp. BNC1
MTENIKDKVVVITGASSGLGAETARHLVREGAKVVLGARRLDRLEALAKELSLGEEAIFKVDVTDREQVKAFVDHAVKTQGKIDVMINNAGIMPLAPLEMMRFDEWDQCIDVNIKGVLWGIAAALPFFKEQKSGQFINVSSVAGHTIGAGGAIYSATKYSVRVISEALRKEVKPYNIRTTILSPGAVDTELPGSVGAPGVSEAVAGFYHQTAIPADSFARCVLFAMSQPENVDINEILFRPTAQEL

SEQ ID NO: 20732 - protein, 537 aa, Arabidopsis thaliana
MNFRNLIASGSRLGKRFCATVFAPASATGIVEASVSSPAAANVVEASVSSPAAENGVRTSVAAPTVASRQRELYKKLSMLSVTGGTVAETLNQFIMEGITVRKDDLFRCAKTLRKFRRPQHAFEIFDWMEKRKMTFSVSDHAICLDLIGKTKGLEAAENYFNNLDPSAKNHQSTYGALMNCYCVELEEEKAKAHFEIMDELNFVNNSLPFNNMMSMYMRLSQPEKVPVLVDAIKQRGISPCGVTYSIWMQSCGSLNDLDGLEKIIDEMGKDSEAKTTWNTFSNLAAIYTKAGLYEKADSALKSMEEKMNPNNRDSHHFLMSLYAGISKGPEVYRVWESLKKARPEVNNLSYLVMLQAMSKLGDLDGIKKIFTEWESKCWAYDMRLANIAINTYLKGNMYEEAEKILDGAMKKSKGPFSKARQLLMIHLLENDKADLAMKHLEAAVSDSAENKDEWGWSSELVSLFFLHFEKAKDVDGAEDFCKILSNWKPLDSETMTFLIKTYAAAEKTSPDMRERLSQQQIEVSEEIQDLLKTVCP

SEQ ID NO: 20733 - protein, 369 aa, Festuca arundinacea
MVMMVDPPNGMGNHGKHYYTMWQTMFEIDTKYVPIKPIGRGAYGIVCSSINQETNEKVAIKKINNVFDNRVDALRTLRELKLLRHLRHENVICLKDIMMPIHRRSFKDVYLVSELMDTDLHQIVKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAEPLGRKPIFPGTECLNQLKLIVNVLGTMSDSDLEFIDNRKARNYIKSLPYTPGIPLSNMYPQAHPLAIDLLQKMLVFDPSKRISVLEALAHPYMSALYGPAANPPAQVPIDLDIDENIGVETIREMLWQEMLQYHPEAATMVNM

SEQ ID NO: 20734 - protein, 291 aa, Saccharomyces cerevisiae
MSSIYKALAGKSKDNKSEKKQGNVKQFMNKQRTLLISSRGVNYRHRHLIQDLSGLLPHSRKEPKLDTKKDLQQLNEIAELYNCNNVLFFEARKHQDLYLWLSKPPNGPTIKFYIQNLHTMDELNFTGNCLKGSRPVLSFDQRFESSPHYQLIKELLVHNFCVPPNARKSKPFIDHVMSFSIVDDKIWVRTYEISHSTKNKEEYEDGEEDISLVEIGPRFVMTVILILEGSFGGPKIYENKQYVSPNVVRAQIKQQAAEEAKSRAEAAVERKIKRRENVLAADPLSNDALFK

SEQ ID NO: 20735 - protein, 1294 aa, Saccharomyces cerevisiae
MSQQENGDVATELIENRLSFSRIPRISLHVRDLSIVASKTNTTLVNTFSMDLPSGSVMAVMGGSGSGKTTLLNVLASKISGGLTHNGSIRYVLEDTGSEPNETEPKRAHLDGQDHPIQKHVIMAYLPQQDVLSPRLTCRETLKFAADLKLNSSERTKKLMVEQLIEELGLKDCADTLVGDNSHRGLSGGEKRRLSIGTQMISNPSIMFLDEPTTGLDAYSAFLVIKTLKKLAKEDGRTFIMSIHQPRSDILFLLDQVCILSKGNVVYCDKMDNTIPYFESIGYHVPQLVNPADYFIDLSSVDSRSDKEEAATQSRLNSLIDHWHDYERTHLQLQAESYISNATEIQIQNMTTRLPFWKQVTVLTRRNFKLNFSDYVTLISTFAEPLIIGTVCGWIYYKPDKSSIGGLRTTTACLYASTILQCYLYLLFDTYRLCEQDIALYDRERAEGSVTPLAFIVARKISLFLSDDFAMTMIFVSITYFMFGLEADARKFFYQFAVVFLCQLSCSGLSMLSVAVSRDFSKASLVGNMTFTVLSMGCGFFVNAKVMPVYVRWIKYIAFTWYSFGTLMSSTFTNSYCTTDNLDECLGNQILEVYGFPRNWITVPAVVLLCWSVGYFVVGAIILYLHKIDITLQNEVKSKQKKIKKKSPTGMKPEIQLLDDVYHQKDLEAEKGKNIHITIKLEDIDLRVIFSAPFSNWKEGNFHHETKEILQSVNAIFKPGMINAIMGPSGSGKSSLLNLISGRLKSSVFAKFDTSGSIMFNDIQVSELMFKNVCSYVSQDDDHLLAALTVKETLKYAAALRLHHLTEAERMERTDNLIRSLGLKHCENNIIGNEFVKGISGGEKRRVTMGVQLLNDPPILLLDEPTSGLDSFTSATILEILEKLCREQGKTIIITIHQPRSELFKRFGNVLLLAKSGRTAFNGSPDEMIAYFTELGYNCPSFTNVADFFLDLISVNTQNEQNEISSRARVEKILSAWKANMDNESLSPTPISEKQQYSQESFFTEYSEFVRKPANLVLAYIVNVKRQFTTTRRSFDSLMARIAQIPGLGVIFALFFAPVKHNYTSISNRLGLAQESTALYFVGMLGNLACYPTERDYFYEEYNDNVYGIAPFFLAYMTLELPLSALASVLYAVFTVLACGLPRTAGNFFATVYCSFIVTCCGERLGIMTNTFFERPGFVVNCISIILSIGTQMSGLMSLGMSRVLKGFNYLNPVGYTSMIIINFAFPGNLKLTCEDGGKNSDGTCEFANGHDVLVSYGLVRNTQKYLGIIVCVAIIYRLIAFFILKAKLEWIKW

SEQ ID NO: 20736 - protein, 459 aa, Bacteroides fragilis NCTC 9343
MKQTRGYLLLICIVSAMGGLLFGYDWVVIGGAKIFYEPYFGIENSAALRGWAMSSALIGCLAGALLSGIWSDKYGRKKMLVIASFLFALSAWGTGAVDHFSYFIFYRIVGGLGIGIASNISPVYIAEVSPAHVRGKFVSLNQLTIVLGILLAQLANWQIGEYYTQGSDILSETSVQWAWRWMFWAELIPAGIFFLLSFIIPESPRWLATVHQQEKAQKTLTRIGGETYARQTLEELNQLTQSQGNRQNNEWKSVFRPEMRKVLIIGIVLAIFQQWCGINVIFNYAHEIFSSAGYAVSDVLMNIVVTGITNVIFTFVAIYTVDKWGRRTLMLIGSAGLALIYLILGTCYFLDVNGLPMLLLVVLAIACYAMSLAPVVWVVLSEIFPVKIRGMAIAISTFFLWVACFILTYTFPVLNESIGAEGTFWLYGGICLAGFLFIRQNLPETKGKTLEEIEKELIK

SEQ ID NO: 20737 - protein, 831 aa, Paracoccus pantotrophus
MTISRRDLLKAQAAGIAAMAANIPLSSQAPAVPGGVESLQITWSKAPCRFCGTGCGVMVGVKEGRVVATHGDLLAEVNRGLNCVKGYFLSKIMYGADRLTQPLLRKKDGVYAKDGEFTPVSWEEAFDTMAAQAKRVLRDKGPTALGMFGSGQWTIFEGYAATKLMRAGFRSNNLDPNARHCMASAAYAFMRTFGMDEPMGCYDDFEAADAFVLWGSNMAEMHPILWTRVADRRLGHPHVKVAVLSTFTHRSSDLADIPIVFKPGTDLAILNYIANHIIQTGRVNRDFVDRHTTFVAGATGIGYGLRDDDPREMAARTAEDPAATTPSTFEEFAELVSEYTLDKVSELSGVEPAFLEQLAELYADPDRKVMSLWTMGFNQHVRGVWANQMVYNLHLLTGKISEPGNSPFSLTGQASACGTARQVGTFRHRLPSDMTVTNPERRQDAEEIWRIPHGVIPEQPGLHAVAQDRALHDGTLNFYWIQVNNNLQASPNNDGEAWPGYRNPDNFIVVSDAYPTVTALAADLILPAAMWVEKEGAYGNAERRTHVWHQLVEAPGEARSDLWQMMEFSTRFTTDEVWPEEILAANPNYRGQSLFDVLFRNGSVDRFDLSELNPVTPTAESNAFGFYVQKGLFEEYAPFGRGHGHDLAPYDTYHEVRGLRWPVVDGKETLWRYREGLDPYVEPGAGVQFYGNPDGKARIIAVPYEPPAEPPDEEYNIWLVTGRVLEHWHSGSMTMRVPELYRAFPGARCFMNPEDARDMGFNQGAEVRIVSRRGEIRSRVETRGRNRMPRGVVFVPWFDASQLINKVTLDATDPISKQTDFKKCAVKILPV

SEQ ID NO: 20738 - protein, 591 aa, Rubus idaeus
MISIASNNNNNNSVVVETPTKPEISPNIISDVISTSQTQPEQKQQPPTTTTHHVFKSKLPDLPNISNHLPLHTYCFENISDFSERPCLIIGSTGKSYTFSETRLLSQKTGVGLSKLGIHKGDVVMILLQNCAEFVFAFMGASMIGAVTTTANPFYTASEIFKQLEASNAKLIITQSQYVDKLRQPGQHFQVVTIDDPPENCLHFSVLSDANENELPQVSIDPDDPVALPFSSGTTGLPKGVILTHKSLITSVAQQVDGENPNLYLKGDDVVLCVLPLFHIFSLNSVLLCSLRAGAAVLVMPKFEIGTLLELIQRYRVFCGGGWCLAGDSAGEESMVADYDLSSIRVVLSGAAPLGKELEEALRNRVPQAVLGQGYGMTEAGPVLSMCLAFAKQPFPTKSGSCGSVVRNAELKVVEPETGRSLGYNQPGEICVRGSQIMKGYLNDGEATATTVDVEGWLHTGDIGYVDDDDEVFIVDRVKELIKFKGFQVPPAELESLLISHPSMQMQLVVPQKDDAAGEVPVAFVVRSNGGNELTEEAVKEFIAKQVVFYKRLHKVYFVHAIPKSPAGKILRKDLRAKLAAAATPNPHHPI

SEQ ID NO: 20739 - protein, 168 aa, Oryza sativa (indica cultivar-group)
MQLQRPRRWRDGDGDGEEGPTTAGGGGGVGCRCRSCAAVMLADCIALGCCPCALVSMLSLALVKAPLAVGRRCVGRLRSRRRTLLHNKRVRDVAATSAAAAGEKKAIAKPEEELEAADIVANDDDTASAAAATAGAGAPTDEDLAWLEEMYQMGHWGFGRVSISGKTP

SEQ ID NO: 20740 - protein, 544 aa, Rubus idaeus
MENKHQDDHEFIFRSKLPDIYIPNHLPLHTYCFENISQFHDRPCLINGNTGETFTYAEVELTSRRVAAGLDKLGIQQNDVVMLLLQNCPEFAFAFLGASYIGAMSTTANPFYTPAEVAKQAKASNAKLIITQSAYVDKVKDFAKLNDVKVMCVDETSSEDVLHFSELMSADESETPAVKINPDDVVALPYSSGTTGLPKGVMLTHKGLVTSVAQQVDGENPNLYFHKEDVILCVLPLFHIYSLNSVFLCGLRVGAAILIMQKFEINKLLELVEKEKVTIAPFVPPIVLSIAKCPDLHRYDLSSIRMVMSGAAPMGKELEDTVRAKLPNAKLGQGYGMTEAGPVLSMCLAFAKEPYEIKSGACGTVVRNAEMKIIDPDTNESLPRNQSGEICIRGSQIMKGYLNDPEATENTIDKEGWLHTGDIGYIDDDDELFIVDRLKELIKYKGFQVAPAELEAMLISHPNLSDAAVVSMKDEAAGEVPVAFVVRSNGSKISEDDIKQYISKQVVFYKRISKVFFTDKIPKAPSGKILRKDLRARLAAGLPN

SEQ ID NO: 20741 - protein, 469 aa, Streptomyces viridochromogenes
MFQNADEAKKLIADEDVKFIDVRFCDLPGVMQHFTIPASAFDPAEELAFDGSSIRGFQAIHESDMAVRADLSTARVDPFRRDKTVNINFFIHDPITGEQYSRDPRNVAKKAEAYLASTGIGDTGYFGPEAEFYVFDSVRLANSATESFYHIDSEAGAWNTGALENNRGYKVRYKGGYFPVPPVDHFADLRAQISLELDRAGLQVERHDHEVGTAGQAEINYKFNTLLAAADDLQLFKYIVKNVAWQNGKTATFMPKPIFGDNGSGMHVHQSLWTGGQALFYDEAGYAGLSDTARYYMGGILKHAPSLLAFTNPTVNSYHRLVPGFEAPVNLVYSQRNRSAAMRIPITGSNPKAKRVEFRAPDSSGNPYLAFSALLLAGLDGIKNKIEPAEPIDKDLYELAPEEHAGVPQVPTSLPAVLDRLEADHEFLLAGDVFTPDLIETWIDYKRTNEIAPLQLRPHPYEYEQYYDV

SEQ ID NO: 20742 - protein, 439 aa, Pyrococcus woesei
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFKYITKAVAEMHGLYATFMPKPLFGFPGNGMHLHISLSKDGENVFMGEEGLSEIALHFIGGILKHAKALIAVTNPTVNSYKRLVPGYEAPVYISWGYRNRSALIRVPAFWGKGARIEYRCPDPSANPYFAFAAVLKAGLDGIKHKIDPFAYVEENVYEMSEEKRKELGIETLPGSLGEALEELEKDKVVKEALGDAYKNFINYKWKEWESYLEYLEEKHMPKDTKKVTEWELERYFFL

SEQ ID NO: 20743 - protein, 543 aa, Rubus idaeus
MAVQTPQHNIVYRSKLPDIHIPNHLPLHSYIFQNKSHLTSKPCIINGTTGDIHTYAKFKLTARKVASGLNKLGIEKGDVFMLLLPNTSEFVFAFLGASFCGAMMTAANPFFTPAEIAKQAKASKAKLIITFACYYDKVKDLSCDEVKLMCIDSPPPDSSCLHFSELTQSDENDVPDVDISPDDVVALPYSSGTTGLPKGVMLTHKGLVTSVSQQVDGENPNLYYSSDDVVLCVLPLFHIYSLNSVLLCGLRAGAAILLMQKFEIVSLLELMQKHRVSVAPIVPPTVLAIAKFPDLDKYDLGSIRVLKSGGAPLGKELEDTVRAKFPNVTLGQGYGMTEAGPVLTMSLAFAKEPFEVKPGGCGTVVRNAELKIVDPETGASLPRNHPGEICIRGHQIMKGYLNDPEATRTTIDKQGWLHTGDIGFIDDDEELFIVDRLKELIKYKGFQVAPAELEALLVTHPNISDAAVVPMKDDAAGEVPVAFVVSPKGSQITEDEIKQFISKQVVFYKRIKRVFFIEAIPKSPSGKILRKELRAKLAAGFAN

SEQ ID NO: 20744 - protein, 173 aa, 'Chlorella' ellipsoidea
  misc_feature (44)..(44): Xaa can be any naturally occurring amino acid
  misc_feature (99)..(99): Xaa can be any naturally occurring amino acid
  unsure (1)..(173): unsure at all Xaa locations
VGYKLMTRLTYTLDEISGDFKIDGSGNVELKEEDGIDYAAVTVXMPGGERVPFLFTIKELEAKGTADAFGGEFTVPSYRGSSFLDPKGRGGSTGYDNAXALPARSDPDELQKENNKSVAALKGQAVFSIAKVDPATGEIAGVFESIQPSDTDLGSKAPKDVKIIGLWYGQLTQ

SEQ ID NO: 20745 - protein, 313 aa, Rhodococcus sp. RHA1
MALSAAARQIVDAAAARFPGSMTATPVQQLRDMLAASAIPSSTGIHGRFDVMVPSAAGGIPVRIYRPTPAPDLPVVVWLHSGGFVVGSLDQNDEYLRQLSNAARVVVVSVDYRLAPENRYPAALEDARTVWDWMKAAPDELAADVGTAVLAGESAGGNLTFALSQQLKDHGAPMPDAQISFYGTAETRVSNPECSTSMLSPQDCEWFWDQYVPRRAGRADPYVSPARARDVTSLPPTLVATAEVDPTRDATEDYARRLAAAGVSVDLQRYEGMMHGFATMTGALQPAAALFERTVQFIDRSLYARETGDSRRK

SEQ ID NO: 20746 - protein, 345 aa, Bacteroides thetaiotaomicron VPI-5482
MMSKYPLLGMTLIELQSLVKRLGMPGFAAKQIASWLYDKKVTSIDEMTNLSLKYRELLKQNYEVGAEAPVEEMRSVDGTVKYLYPVGENHFVESVYIPDDERATLCISSQVGCKMNCKFCMTGKQGYSANLTAHQIINQIHSLPERDKLTNVVMMGMGEPLDNLEEVLKALDILTGSYGYAWSPKRITVSTVGLRKGLRRFIEESDCHLAISLHSPVTAQRAELMPAEKAFSITEMVELLKNYDFSKQRRLSFEYIVFKGLNDSQVYAKELLKLLRGLDCRMNLIRFHSIPGVALEGADMDTMTRFRDYLTTHGLFTTIRASRGEDIFAACGMLSTAKQEENNKS

SEQ ID NO: 20747 - protein, 146 aa, Triticum aestivum
TRPPGFWASPALARTFRGRRACYFNTGVMVLDLPRWRAAGYTAQIEGWMELQRRVRIYELGSLPPFLLVFAGRIAAVDHRWNQHGLGGDNYQGLCRGLHAGPVSLLHWSGKGKPWDRLDAGRPCPLDAVWAKYDLLRPDTGIDAVL

SEQ ID NO: 20748 - protein, 528 aa, Ostreococcus tauri
MLKNVKKQFGLVKANKPSGEGGRDGATSADEAGTANGGRDRTGSSASAASKEGAKREDGSMFNRVAGAAASAAGGFRALSGRIGGGNRDGSVRGRSIPSMETLYDKSKPLFLFRDVPVSERPGLFVKKLQLCSYSFDFSDPSTNTREKEIKRQTLIEIVDYVNQGPGRFNNQVLEHINFMLAQNLFRTLPPSSSEQTGLAKAGMFDPEEDEPSLEPAWPHLQIVYELLLRYVLSNDMDIKNDNPYIGQFFVLKLLDLFDSEDPRERDYLKTILHRIYGKFMIHRPFIRQAINNIFFRFIYETEKHNGIAELLEILGSIINGFALPLKEEHKTFLKRALLPLHKPKCVGMYHSQLVYCVTQFVEKDPRMADVVIRGLLKYWPVTNSQKEVLTLGELEEVLELTQSAQFATVMIPLFKQISLCINSTHFQVAERALFLWNNDYIVNLMAQHRHALLPVCFGALEKNASDHWNPVVGGLTINVRKMLQEMDPELFAQCREQWLAEKERLAEVEKERQQRWSKVEKLANGTH

SEQ ID NO: 20749 - protein, 523 aa, Haemophilus influenzae R2846
MTNIHNHKILILDFGSQYTQLIARRVREIGVYCELWAWDVTEEQIREFAPTGIILSGSPESTTEENSPRAPEYVFNAGVPVLGVCYGMQTMAMQLGGLTETSDHREFGYASVSLENSTALFANLNDNLTASEPKLDVWMSHGDKVTRLPQNFQVTGTTPTCPIAAMSDESRRFYGVQFHPEVTHTKKGLELLTNFVVNICGCETKWTAENIIEDAVARIKEQVGDDEVILGLSGGVDSSVVALLLHRAIGKNLHCVFVDNGLLRLHEGDQVMEMFGDKFGLNITRVDAESRFLGELAGVSDPEAKRKIIGKVFVDVFDDESKKLTNVKWLAQGTIYPDVIESAASKTGKAHVIKSHHNVGGLPDYMKLGLVEPLRELFKDEVRKIGLALGLPAEMINRHPFPGPGLGVRVLGEVKKEYCDLLRRADAIFIEELRNSGWYEKTSQAFSVFLPVRSVGVMGDGRKYDWVISLRAVETIDFMTAHWAHLPYDLLGKVSNRIINEVNGISRVVYDISGKPPATIEWE

SEQ ID NO: 20750 - protein, 294 aa, Oryza sativa (japonica cultivar-group)
MEQYEKEEKIGEGTYGVVYRARDKVTNETIALKKIRLEQEDEGVPSTAIREISLLKEMHHGNIVRLHDVIHSEKRIYLVFEYLDLDLKKFMDSCPEFAKNPTLIKSYLYQILRGVAYCHSHRVLHRDLKPQNLLIDRRTNALKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQDLATIVPTLDPAGLDLLSKMLRYEPNKRITARQALEHEYFKDLEMVQ

SEQ ID NO: 20751 - protein, 894 aa, Coccidioides immitis RS
MMLGTQNPYTAVLPSIPSAISSTYMTLPGKGQAGSMLNREGVFSSPTESEFSEGCDGFDSVRLWDEKKVADWLHSIRCGQYEAIFKANHFNGDNLLDCDQKILQEMGIKKVGDRVRISVAVKQLRTKSVSSRKKKNRDSFVALDSSRFTPPSAESPRPSTARQQPSNSRQWPRHENGKGSPRAASPLTEHDRGLRPYRYAGASPVESARREQGGSYFSRPSDPSQSSRAAAHMRQAPSIDGLTMGALPPNSPVIRVIYTGGQTKVLNVKHCKTAEEVMLAVLRKLLLPESHFRNYCFYVLDGLDPDPANCRRISDSELLQICDGSGRSERGRLILRKLHAGEPEAEELQRAAQLAMDENQVAHMNALSTTNVRNQIKLQKLTGESWHNIRQPRSPLTATDRHRDDYPKIATAKAGDRQQSTKLRSFFGARPPSEMIIHELTSYFPSHQKEDIEKTMRLSVRRSQRLSRAASRLSVVSNISLASSLKDAPPIPSIADTWLTGAGQQPTRGSRPLSVSRFNLPQASFRDSIASSNLQPLQEESPVEPNRKSYVSFDSASEIAGGESRQGFLDESICLNAPDTGGSLNERLSIIVAEDGEEDDDGLADFLAGNNFSNKNWMKGSLIGEGSFGSVFLALHAITGELMAVKQVELPSATKGTEFDNKKTTMVNALKHEISLLQGLQHPNIVQYLGTSTDDQYLNIFLEYVPGGSIATMLKQYNTFQEPLIRNFVRQILTGLSYLHSRDIIHRDIKGANVLVDNKGQIKISDFGISKRVEASNMLSAGGSARHLHRPSLQGSVYWMAPEVVRQTAHTKKADIWSLGCLVVEMFIGAHPFPDCSQLQAIFAIGNNKARPPPPENASKEATAFLDMTFEIDHEKRPSADDLLNDPFLETMIG

SEQ ID NO: 20752 - protein, 347 aa, Triticum aestivum
  misc_feature (222)..(222): Xaa can be any naturally occurring amino acid
  misc_feature (233)..(233): Xaa can be any naturally occurring amino acid
  misc_feature (267)..(267): Xaa can be any naturally occurring amino acid
  misc_feature (275)..(275): Xaa can be any naturally occurring amino acid
  misc_feature (278)..(278): Xaa can be any naturally occurring amino acid
  misc_feature (283)..(283): Xaa can be any naturally occurring amino acid
  misc_feature (287)..(287): Xaa can be any naturally occurring amino acid
  misc_feature (294)..(294): Xaa can be any naturally occurring amino acid
  misc_feature (307)..(307): Xaa can be any naturally occurring amino acid
  misc_feature (319)..(319): Xaa can be any naturally occurring amino acid
  misc_feature (321)..(321): Xaa can be any naturally occurring amino acid
  misc_feature (324)..(324): Xaa can be any naturally occurring amino acid
  misc_feature (328)..(328): Xaa can be any naturally occurring amino acid
  misc_feature (331)..(332): Xaa can be any naturally occurring amino acid
  unsure (1)..(347): unsure at all Xaa locations
MGKGGKGEAAAAVAGEGENMAAWLVAKNTLKIMPFKLPPLGPYDVRVRMKAVGICGSDVHYLKEMRIAHFVVKEPMVIGHECAGIIEEVGDGVKHLAVGDRVALEPGISCWRCRHCKGGRYNLCDDMKFFATPPYHGSLADQIVHPGDLCFKLPDNVSLEEGAMCEPLSVGVHACRRADVGAEKSVLIMGAGPIGLVTMLSARAFGAPRIVIADVDDHRLSXVAKSLGADAVXKVSGNTEDLAGEIERIQAAMGGDIDVSLDCAGFXSKTISTAXEAXRPGGXVCLXGMGHNEXTVPLTSAAIPEVXDVVGIFRYKDTXPXCLXSLRXGKXXVKRLSKGPFGVRLSR

SEQ ID NO: 20753 - protein, 501 aa, Glycine max
  misc_feature (106)..(106): Xaa can be any naturally occurring amino acid
  unsure (1)..(501): unsure at all Xaa locations
MARKMLIDGEAEIAQGGGEEVSNFDFDLFIIGAGSGGVRAARFSSNFGAKVGICELPFHPISSETIGGVGGTCVIRGCVPKKILVYGASFGGDLQDARNYGWELSXKVDFNWKRLLQKKTDEINRLNGLYKRMLSNWGVKLFEGEGKIVGPNEVEVTQLDGTKLSYSAKHILIATGGRAQRPNIPGQELGITSDEALSLEDLPKHAVVLGGGYIAVEFASIWRGMGSTVDLVFRKELPLRGFDDEMRAAVARNLEGRGINLHPRTNLTQLIKTEDGIKVITDHGEELIADAVLFATGRAPNSKRLNLETVGVELDNTGAIKVDEYSRTSIPSIWAVGDVTNRMNLTPVALMEASYFAKTVFGGQTIKPDYSNIPYAVFSIPPLSVVGLSEEQAIEQTNGDLLVFTSTFNPMKNTISGRQEKTVMKLVVDAETDKVLGASMCGPDAPEIMQGIAVALKCGATKAQFDSTVGIHPSAAEEFVTMRSVTRRVAGTGSVKPKTNL

SEQ ID NO: 20754 - protein, 329 aa, Oryza sativa (indica cultivar-group)
MGHYTNLTDPRTELEVVRDWNGVDQVVLRSPRGAYARVSRFLRMDFDRLGIESFGLVWCDSDGFVFFVVVCVLQAIFKPPKAMRGGIPICFPQFGNSGTLEQHGFARNRIWALDEEHPPLNQNDNNSKASVDLILKPSEDDLKCWPHGFEFRLRVSLTKDGNLSLVSRIRNVNGKPFSFSFGYHTYLSVSDISEVRIEGLETLDYLDNLSQRERFTEQGDAITFESEVDRVYVSSPNVIAVLDHEKKRTFVIRKEGLPDVVVWNPWEKKSKNIVDFGDEEYKQMLCVDAAAAERQITLKPGEEWTGKLELSEVPSTNCSGHLDQPGIII

SEQ ID NO: 20755 - protein, 138 aa, Brassica napus
  misc_feature (106)..(106): Xaa can be any naturally occurring amino acid
  unsure (1)..(138): unsure at all Xaa locations
VHPRIRKEAEYVGDIVILPFMDRYELMVLKTIAICEFGVQNVTAPYVVKCDDDTFIRLGSILKQIDGVSLDQSLYMGNLNLRHRPLKIGMWAVTLEEWPQTIYPPXANGPGYISSSIIAKYKVSQNSIQKLTLFKMVD

SEQ ID NO: 20756 - protein, 349 aa, Oryza sativa (japonica cultivar-group)
MVDLVNGVLNWVATPAMVASLLLFYPPYYLFKTVHSFLSYLFPDDLARKVVLITGASSGIGEQLAYNYALNRASLVLVARREWSLRKVADQAFELGAPDVIILPGDVANPEDCKRFVQTAIDHYGRLDHLVCNAGIASVGAFQEIPDVTNYSSQFDVNFWGSVQSTFEALPHLKRSRGRIVVTASATGWNPVPRMTFYNAANAALINFYETLRTELGSQVGITIVTPGWIESEMSKGKFLKDHGEMEVDQEMRDAQIGLFPVEYAKNCAKAMVQAVRQGKRCLTVPPWFSTMYLWRVFAPEVVEFCYRLLYMHRHGGSQADAPSKKMAEAGGKKLLYPTSLRSDDIKDE

SEQ ID NO: 20757 - protein, 486 aa, Pseudomonas stutzeri
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDTEAEAIELANSLPYGLASAIWTENASRAHRVAGQIEAGIVWVNSWFLRDLRTAFGGSKQSGIGREGGVHSLEFYTELKNICVKL

SEQ ID NO: 20758 - protein, 397 aa, Legionella pneumophila str. Lens
MSQFPRIKRLPPYVFNTINQLKMEARARGEDIIDFGMGNPDQPTPPHIVNKLIEVAQRPDTHRYSMSKGIPRLRRAMATWYLRHYDVHLDSEKQILATIGSKEGLAHLALAISGPGDTVLVPDPAYPIHTYGFIIAGANVKQIPLIDEVQFLAAVEDAINRTWPKPKALVLNFPANPSTHCVEYEFFEKVVDLAKRNNIWIIHDLAYADIVFDGYKAPSILQVPGAIDIAIETYSMSKSYNMPGWRVGFACGNEELVAALTRIKSYLDYGTFTPIQVAAITALEGPDDCVLEIRNLYEKRRNLLCDGLNDIGWEVSKPKGTMFVWAPIPLNYRAMGSLEFSKYLLKEAQVAVSPGIGFGQQGDGYVRFGLIENKDRIRQALRNIKALFKRDGLLKAI

SEQ ID NO: 20759 - protein, 408 aa, Oryza sativa
  misc_feature (54)..(54): Xaa can be any naturally occurring amino acid
  unsure (1)..(408): unsure at all Xaa locations
CNCVVILGREGRASQAKASHLSLSFQAKAKQHEGLLLLPPAFRQLLNRTRRRTXHRAQFTAEISTPYPMGISHPLSDDFDASPVLSPPPPPSSCCPPAHDDHYLEHQVSRMDTLPGLAIKYGVEISDIKRANSLMTDSQMFAHKMLLIPLPGRPMPSSVRLNGSGQKMKRAWAPNNQQNRDVTDSLDSSNYNSSKQQMSLAMSTLQSYYGLTPQNGAMTDAGTEMSLYSKGSLERINSETLVTSSRLPDTHNTDRSRNSEDTSNGFSATNGASGAKINGTAKAKQDGSIRRRQKVEADQVSNTTDTQDDVFTDPIKMTKSLLPRPISSIRQNMDTSNPESSLKSNGSFLSGFRSVRKSPSTPNFADAGNGISMWSSSAWTFNHESFTRPLLDGLPKPTAPRRTKAALD

SEQ ID NO: 20760 - protein, 250 aa, Zea mays
MGRKFFVGGNWKCNGTTDQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 20761 - protein, 745 aa, Ostreococcus tauri
MSSQLAQAPALVALRAKLNAKVHSRRGRRPGRGLHGDGERFDQYHSFLGDRCDQQEQLRSPGSPDGLRADGLRDLPRGDDAQPEEHQVVQPRSIRVVRGTRVHVALFIAPLDRLPERFGACAREKTRERTRDRGELDKPWFWDAGGRARGTRGVDQKSETTDVNVTFTRTQIEDIKQFRQWDSKTPGHPENFITDGIEVTTGPLGMGICNAVGLAMVEKHLAGRFNKPDCEIVDHYTYCIMGDGCNMEGMSGEGASLAGHWGLGKLIVFYDDNHISIDGHTDISFTEDVQARFDAYGWHTQHVQNGNTDVDAIRAAVNAAKADPRPSLIKVTTLIGYGSPNKSNTHDVHGAPLGKDETAATRENLKWKYGEFEVPEAVAKAMDCTEKGAAAEAEWNAKWATYKSKYPEDAAELDSIMSGKLPADWAKSLPTFTPEDKGVATRIHSQTMLNALGGAIPGFMGGSADLAPSNMTLMKQFGDFQKDTPAERNVRFGVREHGMGAIANGMKLHSPGIIPYCATFFIFSDYMRCAMRIAALSQAGTIFVMTHDSIGVGEDGPTHQPIEHVASFRAMPGMDMMRPADGNETAACYKMAVENSMNGAPTTLALSRQVVPNLPGTSMEGAQKGAYVVQGAAAGEACDVILIGTGTELELACKAGAELESKGKKVRVVSMPCWEVFERQPASYQDSVLPKSMYANTASIEAGTTFGWSKYAAKSIGHDDFGASAPAPILYKEFGITAEKLAALF

SEQ ID NO: 20762 - protein, 626 aa, Oryza sativa (japonica cultivar-group)
MDGGGGGDPGGRVGEAKADATRAANKRRAPSPAGVGGVEAKRRRKDAMGSSVSGSRSGGGGGRRLRHGRGRRARAFRRKLEEENKNSNNRPRASNVVIAYTPNLIRRYGTLLRNISFLLPYDGQGKAYACPSDKINVFLKWSRCNFCLFFEWAEGDQMMICHMFNTLKEIHISFLINPAFLDESMEVKVTNPLLSFSSNFVEDETWALVKEMLMMMFSPVQEDERAASDLYVFTKSRDSVYFRIFKITSIPAGESENSLVLDEVGLNFCLKLLDVHGAFVGSDCDQALDGLQSQTRNELKLSPDIYYCVPNDKLGCCTLHSVALNNQNYLFFLENGLDLSHFEGFCLTLEEFLERNSFLKIKHIVGSRNDEECNFVRNIAKAIIRSMLSHLVNLFSLGKCLRMGTDLLRRRKILLKGSDVKFFQLEVIAYEEDEAINNVLQVVELVKSCFVGEMIPADLQGDLHDLKENPLKRLESVIDSSSLMSAKEKKGLLVNLHTEYKTNISPAISEDDRDSLFKHIPYLDCWMNRTEDNEYLKLVANLDSKKVALKVNKVGTDKRKPSKNGILQFDFMRNSDVHIPEKALKDGITPFRLSWTDYILTSRYPTYLRAIQKSLEPYMKSRKKLK

SEQ ID NO: 20763 - protein, 503 aa, Bacteroides thetaiotaomicron VPI-5482
MKIFPSSSIKKLDAYTIEHEPIASIDLMERAAQALTKAITNRWNPETPVTIFAGPGNNGGDALAVARMMAEKGYKIEVYLFNTKGELSPDCQTNKELVEMMEEVTFHEISTQFVPPTLTPEHLVIDGLFGSGLNKPLSGGFAAVVKYINASPAMVVSIDIPSGLMGEENTFNVKSNIIRADVTFSLQLPKLAFLFAENTEFVGEWELLDIQLSEEGIEETETNYEMLEIEEIRSLIKPRQQFAHKGNFGHALLIAGSKGMAGASVLAARACLRSGVGLLTVHAPLCNNDILQTSAPEAMVETDVSETCFAVPTDTDDYQAVGIGPGLGRNEETEAALIEQLEHCQTPTVLDADALNILANHRHTLTHLPKGSILTPHPKELERLVGKCQDSYERLMKACELAHTAKVHIILKGAYSAIITPEGKCYFNQTGNPGMATGGSGDVLTGVILALLAQGYPAEDAAKIGTYIHGLAGDIAQKKQGMIGLIASDIVTCLPTAWRLVSE

SEQ ID NO: 20764 - protein, 362 aa, Glycine max
MASAASISSSQPEAPKVHASDISSIKAFAESKGASLIPYTYHSITEHHDDDVADELAASIPVIDLSLLTSHDPQIHAKAVHQLGKACAEWSFFMLTNHGIPESLVEELMKKSREFHDLPMEEKKEFGNKGPFEPIRHGTSFCPEAENVHYWRDYLKAITFPEFNFPYKPPGYREVAYDYSKKIRGVTRKLLEGISESLGLESNSIIESTDFDSGHQLFVVNLYPPCPQPHLALGLPSHSDVGLLTLLTQNGIGGLQVKHNGKWVNVNPLPNCLIVLLSDQLEVVSNGKYARVMHRAILNNADTRISVVLANGPALDKEIGPLPELLQNYKPLFRSIKYRDYFQIQQKSRLQDKSSLDEIRLN

SEQ ID NO: 20765 - protein, 537 aa, Arabidopsis thaliana
MDALSQAISSGISVPYKNNSSSLVPSHGLTSLILRKSRSPVNPSSRSRVSVRASEIQHSKTSASSIDLSDPDWKLKYEKDFEQRFSIPHITDVLPDAEAIRSTFCLKMRSPTEDFVGGYPSDEEWHGYINNNDRVLLKVISYSSPTSAGAECLDHDCSWVEQWIHRAGPREKIYFRPEEVKAAIITCGGLCPGLNDVIRHIVITLEIYGVKNIVGIPFGYRGFSDKDLTEMPLSRKVVQNIHLSGGSLLGVSRGGPSVSEIVDSMEERGINMLFVLGGNGTHAGANAIHNECRKRKIKVAVVGVPKTIDNDILHMDKTFGFDTAVEEAQRAINSAYIEAHSAYHGIGVVKLMGRNSGFIAMQASLASGQVDICLIPEVPFNLHGPNGVLKHLKYLIETKGSAVICVAEGAGQNFLEKTNAKDASGNAVLGDFGVYIQQETKKYFKEISTPIDVKYIDPTYMIRAVRANASDGILCTVLGQNAVHGAFAGYSGITVGIINTHYAYLPITEVIAYPKSVDPNSRMWHRCLTSTGQPDFI

SEQ ID NO: 20766 - protein, 446 aa, Arabidopsis thaliana
MSEFDKHVQNHIKNEKPFNSIKPSEIDSTLSLSDSLLLKIIEKLPESQSNDVSLVCKRWLNLQGQRLRSLKLLDFDFLLSERLTTRFPNLTHVDLVNACMNPRVNSGILFCHKSISFHLSSDSSNWEFLEENLLHSDVIDRGLRILSRESFDLLNLKVINASELGLLSLAGDCSDLQELELHKCNDNLLHGIAACKNLKGLRLVGSVDGLYSSSVSDIGLTFLAQGCRSLVKLELSGCEGSFDGIKAIGQCCEVLEELSICDHRMDDGWIAALSYFESLKILRISSCRKIDASPGPEKLLRSCPAMESLQLKRCCLNDKEGIKALFKVCDGATEVNIQDCWGLSDDCFSLAKAFRRVRFLSLEGCSVLTSGGLESVILHWEELESMRVVSCKSIKDSEISPALSSLFSLLKELTWRPDTRSHLSSSLEGAGIGIRGSKFFKKSVLH

SEQ ID NO: 20767 - protein, 481 aa, Burkholderia pseudomallei K96243
MLLLRFVNAHNVEPPSKQNHGVRQMQSNTVHPCDEVLPSGKLLTLGLQHVLVMYAGAVAVPLIVGGALKLPKDQIAFLISADLFACGIATLIQTLGVWLFGIRLPVIMGCTFAAVGPMIAIGTNPGLGILDIFGSTIAAGAIGIVLAPMIGKLLRFFPPVVVGTVISVIGLSLMEVGINWAAGGVGNPNYGDPVYLGLSFIVLALILAINKFGRGFVANISVLLGMIAGFAIAFAAGRVNTDGVAAAPWVGFVAPFHFGLPHFDPLSIATMVIVMFVTFIESTGMFLAVGDMVERPVDQETLVRGLRVDGLGTLIGGIFNSFPHTSFSQNVGLIGVTGVKSRFVCATGGMILVLLGLFPKMAQLVASVPPFVLGGAGIVMFGMVAANGVKVLSKVDFVRNHHNLFIVAVSVGLGLVPVVSPNFFSKLPAAFAPILHSGILLASVSAVVLNIVFNGMKGEKDARCDIRRAGRDFDGQPADLH

SEQ ID NO: 20768 - protein, 368 aa, Burkholderia pseudomallei K96243
MKTKAAIAWKAGEPLTIEEVDLEGPRAGEVLIEVKATGICHTDYYTLSGADPEGIFPAILGHEGAGVVVDVGPGVGTLKKGDHVIPLYTPECRECKFCLSRKTNLCQKIRATQGCGLMPDATSRFSVGGKPIFHYMGTSTFSNYIVVPEIAVAKVREDAPFDKICYIGCGVTTGVGAVVYSAKVEAGANVVVFGLGGIGLNVIQGARMVGADKIIGVDLNPKRVELARKFGMTHFINPNEVENVVDHIVQLTDGGADYSFECIGNVKVMRQALECTHKGWGQSFIIGVAAAGEEISTRPFQLVTGREWKGSAFGGARGRTDVPKIVDWYMEGKINIDDLITHTLPLEKINEGFELMKKGESIRSVVLY

SEQ ID NO: 20769 - protein, 693 aa, Candida albicans SC5314
MTSLQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKSRVPTLKELTIMCRNAYDEEMFVQMEMHILSTLDWSIGHPTLEDCLQLAIDSNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQSDVRHSSFDEDIDLDSGDEGDDDEDYIDEFYETNNYDDTNATTFDESISKSTTVNDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGSLITNNGSLITNNGSFTNIVNNTNSSSPLMNQQQQQQVTQSSLYQHHHQYHQ

SEQ ID NO: 20770 - protein, 174 aa, Zea mays
MWNCSSLLLQYGDDYALLDEMDGSGGDGDRWRGKPSQGIEEAQDKDASHSTRSTAPRPAAPPCKRSQKLGDKITALQQLVSPYGKTDTASVLHEAATCIKHLHEQIQILTASYPELSSPASQQDTGDEEGGATGLRRRGLCVASLSPAVVQLVSAEAALGNRDTEDHWRWLGTL

SEQ ID NO: 20771 - protein, 133 aa, Glycine max
RISSHVVTTVNRAGAGLVVPLTGLKSMAGFPTGKTNIAIPSIVGTGGGVHCMQGGPPIGRKKFGTFSYWPDLVDAQLAKEVESFLRKGWIPCLEFGWEHGFGFRGPTSLPGSFDGPLWTMWKLPMLGCTDAFK

SEQ ID NO: 20772 - protein, 277 aa, Carboxydothermus hydrogenoformans Z-2901
MELWFTEKQTPNVGITCKITRTLHTETTPFQELAVIETLQFGRMLVLDGMVQTTVVDEFVYHEMIAHVALNTHPNPEKVMVIGGGDGGTIREIVKHPKVKKAVLVEIDERVIEVSKQYLPEIAVALMGNPKVEVRVEDGIKHVKEHKGEYDVIIIDSTEPVGPAVELFSEDFYKNVYESLKDDGIMVAQTESPFFNRDIIKNSFTRIGKNFPITRLYFATVPTYPSGVWTFTLGSKKYDPLAVKKEDIFVDPSNKYYNAEVHFGAFMLPNFIAEIIK

SEQ ID NO: 20773 - protein, 785 aa, Oryza sativa (indica cultivar-group)
MSAHYAFGLQEDDAIIKRRLLTRTTTTRGEPPLKKLQKKFMSFATEVEKDADNISDCERLYKAFLQEINAFVLPLLKSKAVVDANLREKESFTELQDEIQRQILQAQTDIEELKKKLVQSRIERLYKEECEAIRKMISLQPPRSETEKLIAGLEKEIANLEAENTACIRTLELRKKQLSLLLHVVEELQISIEDEQRSIADELRAGAEEQQNMSTDEDPYFNADAGTISPHEHGEVFVLDDGGEADLDLGNYERFLDIKLTRDHSITAGKIHHYVYEKERRGDYLGQTVQVIPHITNEIQDWIERVAIVPVDGEVDPADVCIIELGGTIGDIESTQFIEAFSQFSYRVGAGNLCVVHVGLVPVLNVVGEQKTKPTQNSIRKLREYGLTPNIIACRCTKELERSVKEKLSLFCHVPVANIFTLCDVSNIWRVPLLLRDQKAHEAILKVLNLGSVAGEPNLEEWTARADLYDTLQETVRIAMVGKYTGVSDTYLSVMKALLHACIACGRKLVVDWVPSTDLEDSTATVAPDAYNTAWSLLRGADGILVPGGFGERGVEGKILAVKYARENDVPFLGICLGMQLTAVEFARHVLKLPDANSTEFDAKTENPCVTIMPECSNEGKGGTMRRGSKRIFFKVAGSKSAKLYGSVSHIDERFRHRYQVNPNMVQLFENSGLQVVGTDKTGERVQIVEIPNHRFFVGVQFHPEFKSRPSKPSALFVGLIAASCGQLDDALQDAACNHEPQQNRRGEKRLAASDLGDGTCRSKRQVKACSNSNDTDEAQDVTTC

SEQ ID NO: 20774 - protein, 166 aa, Triticum aestivum
  misc_feature (148)..(148): Xaa can be any naturally occurring amino acid
  unsure (1)..(166): unsure at all Xaa locations
MAVLVARQGRELQRYSASTGGRIVVGCIPYRVRAGGDGDGEGELEVLVISSQKGHGMMFPKGGWELDESMDDAARREALEEAGVRGEMGKVLGCWHYQSRRYQTTYEGIMYPLRVTDELQQWPEMASRKRTWATVQQVMEGCQHCWMXREALEELVARHAKPQSAL

SEQ ID NO: 20775 - protein, 278 aa, Arabidopsis thaliana
MIKSEADLSDVIVIRDVWAYNLESEFDLIRGIVEDYPFISMDTEFPGVIYKADLDVLRRGNPNYLYNLLKSNVDALSLIQVGLTLSDADGNLPDLGGQKNRRYIWEFNFRDFDVERDPHAPDSIELLRRHGIDFERNRREGVESERFAELMMSSGLICNESVSWVTFHSAYDFGYLVKILTRRQLPVALREFLGLLRAFFGDRVYDVKHIMRFCEQRLYGGLDRVARSLEVNRAVGKCHQAGSDSLLTWQAFQRMRDLYFVEDGAEKHAGVLYGLEVF

SEQ ID NO: 20776 - protein, 248 aa, Bordetella pertussis Tohama I
MTTAENRARLVLGNWKMHGNLAENAALLAELRAADAAAHCEMGVCVPFPYLAQTAAALQGSAIGWGAQDVSAHAKGAYTGEVAAPMLAEFGCRWVLVGHSERRTLHAESDQLVADKARAALEAGLTPVVCVGESLQEREGGNTLGVIERQLEPVLALGRDALVRMVLAYEPVWAIGTGRTASPEQAQEVHSAIRVALDGLQASQVRVLYGGSVKGANAASLFAMPDIDGGLVGGASLVAEEFLRIAAA

SEQ ID NO: 20777 - protein, 196 aa, Oryza sativa (japonica cultivar-group)
MVVYTQEHVYRHPWDRVTAAAWRKFTDPASRTALSHVADVHTLHRRVDPEAGRLQAARSITVRSPRFPFILRRLLPAAASSPSGAALCHCVETSLVDAPRRAMDVVVRNVSLRGLIEVEERSTYRPHPERPEEWTQFRQETTIRCRPLSALAAVAEKVETRCAERFLQNSAKGREVVERICRYLEAEAAGAASSAI

SEQ ID NO: 20778 - protein, 318 aa, Burkholderia pseudomallei K96243
MAAIVAAGELLAEFVAAKRGQGFDAPGEFAGPFPSGAPAIFADQAARMGASVAYAGCVGRDAFGDAIVARLASHGVDVAHIRRAARPTGIACVAYRADGGRQFVFSIDGSASALLEPADVVPSMFAGCRYFHVMGSSLTSENAIAAVKRGVIEAARVGAKISFDPNVRAEMLAFAPMRAALREMLDACHLFLPSEADLPFFCGPQPAERAIAGLLATHPLLERVVLKRGAAGSAAFDRTGSVAAPAYETAEVDPTGAGDCFGGTFVACAIAGLPVASALARANAAGALAVSRIGPMEGNSMPADIDRFLAERGARCAA

SEQ ID NO: 20779 - protein, 464 aa, Mycobacterium tuberculosis
  misc_feature (1)..(1): Xaa can be any naturally occurring amino acid
  misc_feature (101)..(101): Xaa can be any naturally occurring amino acid
  misc_feature (184)..(184): Xaa can be any naturally occurring amino acid
  misc_feature (297)..(297): Xaa can be any naturally occurring amino acid
  misc_feature (344)..(344): Xaa can be any naturally occurring amino acid
  misc_feature (446)..(446): Xaa can be any naturally occurring amino acid
  misc_feature (461)..(461): Xaa can be any naturally occurring amino acid
  unsure (1)..(464): unsure at all Xaa locations
XTHYDVVVLGAGPGGYVAAIRAAQLGLSTAIVEPKYWGGVCLNVGCIPSKALLRNAELVHIFTKDAKAFGISGEVTFDYGIAYDRSRKVAEGRVAGVHFLXKKNKITEIHGYGTFADANTLLVDLNDGGTESVTFDNAIIATGSSTRLVPGTSLSANVVTYEEQILSRELPKSIIIAGAGAIGXEFGYVLKNYGVDVTIVEFLPRALPNEDADVSKEIEKQFKKLGVTILTATKVESIADGGSQVTVTVTKDGVAQELKAEKVLQAIGFAPNVEGYGLDKAGVALTDRKAIGVDDYXRTNVGHIYAIGDVNGLLQLAHVAEAQGVVAAETIAGAETLTLGDHRXLPRATFCQPNVASFGLTEQQARNEGYDVVVAKFPFTANAKAHGVGDPSGFVKLVADAKHGELLGGHLVGHDVAELLPELTLAQRWDLTASELARNVHTHPTXSEALQECFHGLVGHXINF

SEQ ID NO: 20780 - protein, 96 aa, Triticum aestivum
MPPSVSLVLALRLYDTGEERCIACYLWEDICPGQALSMEANERVDGSRRTTTFYICMTKCIDCGVWQEARPVLAIDARPNCELFTVTNGGLLNSKE

SEQ ID NO: 20781 - protein, 237 aa, Gossypium barbadense
LTDDHCQYFLYQLMRGLKYIHSANALHRDLKPSNLLLNANCDLKICDFGLARTTSETDFMTEYVVTRWYRAPESLLNCSEYTAAIDIWSVGCILMEIIRREPLFSGKDYVQQLGLITQLLGSPEDSDLGFLRSDNARKYVKQLPHFPKQPFAGKFPDVSPLAIDLAEKMLVFDPSKRITVEEALNHPYLSSLHEINEEPTCPSPFVFDFEQMALNEEDIKELIWRESLNFNQDKMPE

SEQ ID NO: 20782 - protein, 603 aa, Oryza sativa (japonica cultivar-group)
MVGMLPETNAQAAAEEVLGDAWDYRGRPAARSRTGRWGAAAMILVAELNERLTTLGIAVNLVTYLTATMHAGNAEAANVVTNFMGTSFMLCLLGGFVADSFLGRYLTIAIFTAVQASGVTILTISTAAPGLRPAACAAGSAACERATGAQMGVLYLALYLTALGTGGLKSSVSGFGSDQFDESDSGEKSQMMRFFNWFFFFISLGSLLAVTVLVYVQDNLGRPWGYGACAAAIAAGLVVFLAGTRRYRFKKLVGSPLTQIAAVVVAAWRKRRLELPSDPAMLYDIDVGKLAAAEVELAASSKKSKLKQRLPHTKQFRFLDHAAINDAPDGEQSKWTLATLTDVEEVKTVARMLPIWATTIMFWTVYAQMTTFSVSQATTMDRHIGASFQIPAGSLTVFFVGSILLTVPIYDRLVVPVARRATGNPHGLTPLQRIGVGLVLSIVAMVCAALTEVRRLRVARDARVGGGEAVPMTVFWLIPQFLFVGAGEAFTYIGQLDFFLRECPKGMKTMSTGLFLSTLSLGFFVSSALVAAVHKLTGDRHPWLADDLNKGQLHKFYWLLAGVCLANLLVYLVAARWYKYKAGRAAAAGDGGVEMADAEPCLH

SEQ ID NO: 20783 - protein, 165 aa, Microsporum canis
MAAAATSKITLTSSDGVDITIDRQVAERSILIKNMLKDLGDSGEAIPIPNVNESVLKKVIEWCKHHKGDPPSTGDDDVDSRRKTTDIDEWDQKFMQVDQEMLFEIILAANYLDIKALLDVGCKTVANMIKGKSPEEIRKTFNIQNDFTPEEEDQIRRENEWAEDR

SEQ ID NO: 20784 - protein, 323 aa, Wigglesworthia glossinidia endosymbiont of Glossina brevipalpis
MNFEKIFKLINKDIINFQIELERSLYSNVDLIKKCNKYILNNNGKFIRPIAIILAAKSLFYNKKKHIILASLIELIHMSTLLHDDIIDDAKKRRGNASVNVVFGNIPTILIGDFIYTRAFQMISKLRSFKIFKIISNAVNMIVEGEILQLTYCNSVDITIKNYMQIIYKKTAKLFEVSLQSAAILSKSSYKEEQAFKNYGRYLGISFQIIDDFLDYKSDFKKFGKILGNDLKEGKVTLPLIHAMKNSNNSQFLLIKEAIQKGNHSHLLNDILKIMEEHRSLEYTREYAKKKIEKAISFLNELKYSIYIEALENLAKFYLNCIK

SEQ ID NO: 20785 - protein, 107 aa, Glycine max
HRQPCRARGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 20786 - protein, 328 aa, Wigglesworthia glossinidia endosymbiont of Glossina brevipalpis
MISLREFIFSNNVNKYISKEDLYSLFIIIELTSKIIHNYIILNNITRIKQEKIKKNIHGEHQTKLDLLSNKKFIDMIKTHYNIAGIASEEEAKFISFKQEKYGKYIFLIDPLDGSLSADCNTPVGTIFSLYCRVTPIGVEISEKDFLQPGNKQILSGYILYGSSTILVFTVKSGVHIFTYHPFFSTFFLSKKNFNYPKKNNIYSINEANYNNFSLGIKKYIMSCKSNNNISSRYTGSLVADFHRNLIKGGIYLYPNTKIYKHGKLRLMYECNPIALISSQANGSSSDGNINILDINPKILHQCSPFFVGTKSMVKLVNKFILGYYNHN

SEQ ID NO: 20787 - protein, 149 aa, Brassica napus
MFGTPSSSPAFGTPSSTPMFGSSSTSAFGTPSSTPAFGTPSSTPAFGTPSATPAFGTPSSTPAFGTPSTSSFASGGFGNSLFSTPFSSQQPQQQQQQQQQNSPFQQPASSGFGFQSPFNTAQQQTPFQTTQLTTQMAPVAPIPFSLADR

SEQ ID NO: 20788 - protein, 482 aa, Cryptococcus neoformans var. neoformans JEC21
MPEQPDYGTTSPPRPSSSASMSQHPLHDPKNGHASVVSSVSNLSNTILGAGALAFPSAFAAMGLLPGILSCAFSGVTAIFGLYLLSRCATIVGTRPGDEGKKASFNEIAKLTFGKGWATKAFDLAIAIKCFGVSISYLIICKTLLPQVCYTIAKLVKQPLPDDSILLASHFWLIVWMAIITPLSFMRTLDSLRFTSQIALLTVVYLVLVVVGWYTLKGPSPERGQVVLFRFGKSTLSSFPVQVFAYTCSQNLFPIFNELKDRTQKKMNTVIGSSIGTAIGVYQVIGIVGYLTFGDRVSSNVIAMYPATTMLVAIGRLGIVLLVGLSYPLQLLPCRASLYHLTHSLFHHHDVSGAPTNGRSIQDDSDTDMEDEEIGPLVPKAHEDHAHHKHDMPQLQFLVLTLGILISGFLIAYNVHELDIVLSFVGSTGSTIISFILPGFFYFRLFRDEPGTMKWWALALGIYGLGVMGFCLTFNIIKLVQH

SEQ ID NO: 20789 - protein, 101 aa, Glycine max
  misc_feature (30)..(30): Xaa can be any naturally occurring amino acid
  misc_feature (39)..(39): Xaa can be any naturally occurring amino acid
  misc_feature (87)..(87): Xaa can be any naturally occurring amino acid
  unsure (1)..(101): unsure at all Xaa locations
ALFPHCKFNNFMIGAVVSKFGDKSVYLDLXDLGNTTKKXNLCGLYAPSPYNHIKSLFFETLAAPFTKRGLLLKFLIFERVSPLHTSXNCLRDILPIKKGPQ

SEQ ID NO: 20790 - protein, 417 aa, Nocardioides sp. JS614
MSGQRMSKQIPDRVVVVGSSVGGTRAAQGLRAAGFTGQVVIVGAEKVAPYDKPPLSKQLLSGEWSVEDIALASVEELGGAGIELRLGVAAGGVDVANRTLTLVDGTTLGYDALVIATGVRPRTLSAPRTVALHTVRELADVSALRGALDSGHGLVVVGGGFIGAEIASTAAGLGVPVSIVEALPAPFSRVLGDEVGGLLAQLHAENGVEVVSGTGVVALRCGPTGLTEVELGDGRVLSAGAVAVGIGCVPNTDWLAGSGIPLADGVATDQFSRVREVPGVYAIGDVANWHDVRTGTSRRVEHWTHAFQQAQLVAHNIVHPDDLQAQTRAPYFWSDQHGVKIQMVGRRGREDAVDVMWRDTSDGQRPVALYSDRGRFTGGVTFGAPQLSARLRRAWEDGLALTDACALVAGLPAPARA

SEQ ID NO: 20791 - protein, 753 aa, Oryza sativa
MGAVGVEAGVFDTVDGLVGEVMRLHRSLPARPAVEEVEAAEALAAAADREERARADAVARLRRSPAVPDELLCVAQEMHRALAGFQCREQKRDAARLLELEALHTLFDDLIQRASQCLPSTSTRAAPRIAAPAAATTTTSTAAAGSSSSSAVGNAERHASSGTNGFTASRVAGTSTSTGRVSMDDSYVRKAKAAMWDGDDNEKLSLIKLASMIEVSAKKGARDLNLQGKLMAQIEWLPDSIGKLTGLVTLDISENRLLALPDAIGKLFSLAKLDIHANRISQLPESIGDLRSLIYLNMRGNQLSSLPSSIGRLLNLEELDVGSNGLSSLPDSIGSLTRLKKLIVETNDLDELPYTIGHCVSLVELQAGYNHLKALPEAVGKLEPLEILSVRYNNLRSLPTTMASLTKLKEVDVSFNELESIPENFCFATSLIKLNVGNNFADLQYLPRSIGNLEMLEELDMSNNQIRVLPDSFGNLKHLRVLRAEENPLQVPPRDIALKGAQAVVQYMSDASKRTTKSEPMKPKKTWGARGILSYPSDPRGCVAPRLSLDRHVAATRQRTHALPCVRWRGGRYALSRQQQGIDMRVKDFAGDHLRTGVYFAFGPRHGQLFNPGPWSTSRDYDASRGRRNRAAAAMGVVVAYRKLSPASRRGGGAARAWVALLRRAAAGVAARLQRAARRRCVGVGCGGARRLTWAGLCVGRGVAVAAPARRISSAAGSYDPASYARNFDDGVWKAEEGCAGAARFAGANVNAD

SEQ ID NO: 20792 - protein, 183 aa, Brassica napus
  misc_feature (95)..(95): Xaa can be any naturally occurring amino acid
  misc_feature (153)..(153): Xaa can be any naturally occurring amino acid
  misc_feature (162)..(162): Xaa can be any naturally occurring amino acid
  unsure (1)..(183): unsure at all Xaa locations
MASSMLSSAAVVTSPAQATMVAPFTGLKSSAAFPVTRKANNDITSIASNGGRVSCMKVWPPVGKKKFETLSYLPDLTDVELAKEVDYLLRNKWIXPCVEFELEHGFVVPVSTGSTPGILMMDVYWTMWKASPWFGCTDSAQVLKEVKNAKRSXPNAFIRIIXIDTRQSVHQFIAYKPPSFTGA

SEQ ID NO: 20793 - protein, 133 aa, Triticum aestivum
MVCRRRKKHNSPPLLDPHPLAARTKKRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 20794 - protein, 462 aa, Ralstonia metallidurans CH34
MAQAPHIASRKLRDIVTSRTLDSFLAGVSRRDPNQPEFFQAVKEVMMTLWPFVERNPRYGDQALLERLVEPERVIQFRVAWTDDRGQVQVNRAFRVQHSSAIGPYKGGMRFHPTVNLSVLKFLGFEQTFKNALTTLPMGGGKGGSDFDPKGKTDAEVMRFCQALITELYRHLGPDTDVPAGDIGVGAREVGFMAGMMKKLSNQSACVFTGKGLAFGGSLMRPEATGYGTVYFAQEMLHRRGREFDGLRVLLSGSGNVAQYAAEKAIELGAKVLTVSDSGGVLHFPEGMNREQLDALMTFKNDTRGRLSDFAEQHGLRFEAGKTPWHVPADVALPCATQNELNGQDAERLLSNGVFCVAEGANMPSTLDAVDRFVAARILYAPGKASNAGGVATSGLEMSQNAMRMAWHHAEIDEKLHAIMKDIHGNCIHYGQKEDGYINYVEGANIAGFVKVADAMLAQGVI

SEQ ID NO: 20795 - protein, 237 aa, Populus tremuloides
SGTENKINRQVTFAKRRNGLLKKAYELSVLCDAEVALIIFSNRGKLYEFCSTSNMLKTLERYQKCSYGAEEVNKPAKELENSYREYLKVKARFEALQRTQRNLLGEDLGPLNTKDLEQLERQLESSLNQVRSTKTQYMLDQLADLQNKEHLLLEANRGLTIKLDEISARNSLRPSWEGDDQQNMSYGHQHAQSQGLFQALECNPTLQIGYNAVGSDQVSAITHATQQVHGFIPGWML

SEQ ID NO: 20796 - protein, 300 aa, Polaromonas sp. JS666
MQTARNANQVTPVTPDFSGLWIPLVTPFDHGQVDHASLKRLVAHYRGSGIAGLVACGSTGEAAALSDEEQLAVLQAVMREAPELPVVMGLSGYHLGKTAARIKVLGELGIAGILLPAPHYIRPAQAGLIEWFTQLADASAVPVILYDIPYRTGVKIELETLRALASHPRICAIKDCGGDADKTQALIRDGRLQVLCGEDGHIFSTLAQGGHGAIAAAAHVHTRRFVQGMDLIRTGDEAQARTLWEPLLPLIEGLFAEPSPGPLKALLARRGLVREELRSPMTPASGALVERLQRLDGLIG

SEQ ID NO: 20797 - protein, 280 aa, Oryza sativa (japonica cultivar-group)
MAAATVSVRFHPAASAARCGGGSRRSRRLSGVIRAQSAPASAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGVSVKTK

SEQ ID NO: 20798 - protein, 477 aa, Nocardioides sp. JS614
MSSGLWIDGGWQESRGDRGEFAVVDPATTGVLARVVDGSVEDMAAAVDAASRTHETWAETPARERSVVLRRAWELMTERSEELARLIVLENGKALPDARSEVVYAAEFFRWFSEEAVRAHGDMRRSPSGQNWIMVTEEPIGVALLVTPWNYPAAMATRKIAPALAAGCTAVLKPAAETPLTALALAELLADAGLPDGVLNVVCTTRAGQLVEHALGDPRVRALSFTGSTEVGRKLLALAARNVVRASMELGGNAPFVVLDDADLEEAVEGLMVAKLRNGGSACTAANRIYVADRVADEFVERFTARMAGVRHGNGLDEGVELGPLVNEDTQRKVGELVDGALREGASLATGGGHDGLPGYSYRATVLTDVKPDAEILKHEIFGPVAPIVRFGEDAEAVALANDSEFGLISYLYTRDLDRGLAVSRRLRSGMVGVNRGVVSDPAAPFGGVKQSGIGREGAAEGLREFTEMKYTAIPYR

SEQ ID NO: 20799 - protein, 506 aa, Carboxydothermus hydrogenoformans Z-2901
MSVLLTILDGWGIAETTYGNSIKEAGTPNFNRYWDNYPHTILEASGLAVGLPRGQMGNSEVGHLNMGAGRIVYQELTRITKEIEEGSFFQNRELLEAVNHAQKTGGNLHLMGLLSDGGVHSHIEHLFALLELCRREKFSRVFIHPFLDGRDVPPQNAREYIEALEARLKELGFGQIATVMGRYYAMDRDKRWERTEKAYRAMVFGEGFKVTEPEAAVALAYDRGETDEFVSPTVVLTSEGQPRGVVKEGDSIIFFNFRPDRARQITRAFVDDDFTGFNRKKIENLHFVCFTQYDKTIKAPVAFLPQTIENCLGEYLSKKQKKQLRIAETEKYAHVTFFFNGGVEKPYPGEERILIPSPKVATYDLKPEMSAYEVTEKLLEEMEKGYDLIVLNYANPDMVGHTGVFEAAVRAIKAVDECLGRVVDKFLSLGGTAIITADHGNAEKMLEEDGSPHTAHTTNPVPFILVGEKYRGIKLKEKGSLANVAPTILKILELEIPEEMTSEPLF

SEQ ID NO: 20800 - protein, 809 aa, Malus x domestica
MEMPGRRSNYTLLSQVPDDQAAAFYETESKNNKGKGDRGFDWETGADFRANQQPNRAGNPYSSAGLQRQSSGSSFAESSISGEYYPPTLSTAAVSEIDGFGYVPDDVFKVSGGGGEFRMKGVDGAVTATGGGGGSSSGKSWAQQTEESYQLQLALALRLSSEATCADDPNFLDPVPDESASRTSGSVDAVSHRFWVNGCLSYFDKVPDGFYLIHGIDQYVWTVCTDLQENGRIPSIESLRSVDPGIGSSIEVVLIDRRSDPSLKELQNRVLTISCTCINTKEIVDHLAKLVCSRMGGSSSVGEDEILSIWRESSDDLKDCLGSVVVPIGSLSVGLCRHRALLFKVLADTIDLPCRIAKGCQYCTRDDASSCLVRFGLDREYLVDLIANPGYLREPDSLLNGPSSISISSPLRFPRLKPVEPTIDFRLLAKQYFSDCQSLNLVFDEAPAGSAVDEDNIHPKKFDRKSTEGKNLISNLSGDTSAHAKIPRTSGHRDGPRVDTITGSRFVEGVQLVPSKPSRELGFDIEDLDIPWSELIIKERIGAGSFGTVHRADWHGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDLNPNVAAIIEACWANEPWKRPSFASIMDSLTPLIKAPVAQPSRADMPLLT

SEQ ID NO: 20801 - protein, 166 aa, Zea mays
  misc_feature (116)..(117): Xaa can be any naturally occurring amino acid
  misc_feature (156)..(156): Xaa can be any naturally occurring amino acid
  unsure (1)..(166): unsure at all Xaa locations
AGAPTAPDKTQTTSAAPLSQSPQWRAPSFMIKPDGVQRGLIGEIISRFEKKGFYLKALKLVNVERSFAEKHYADLASKPFFQGLVDYIISGPVVAMVWEGKSVVTTGRKIIGATNXXASEPGTIRGDFAVDIGRNVIHGSDSIESANKEIALWFPXSSQHPWIYEK

SEQ ID NO: 20802 - protein, 350 aa, Mycobacterium smegmatis str. MC2 155
MLLAHATRLGLAAIPRMSDRRKHLLLGGRSVTVDGNTLDTTMQFMLTTQRLAGLPGLVADYDPEHGVAVSRAKLRETAAMMRMPIHVDVSDISIPGPAGPLAARRYVPVERGSASALVLYFHGGGFVIGDLEVHDNLCRLICRDGDVQVVSVDYRLAPEHKAPAAAEDAYAAYQWALEHAGGLGASRIVVAGDSAGGNLAAVVSQWARDDELPLPALQVLLYPITDWVSETRSRTLFSDGYFLNRQDMDWFAGHYLDGADVTPEDPAVSPLLAEDLSGLPPALVVTAGFDPLRDEGNRYAAAMRDAGVLVDLREERSMIHAFANFFPLGGGGAAATTAMISALRAHLRHV

SEQ ID NO: 20803 - protein, 352 aa, Clostridium difficile 630
MGNKMRASVLYNVGDVRYEMVDIPEITDTQVLVNVKYVGICGSDLPRSMVSGLSGNTKYPLILGHEFSGEVVKIGEKVKHINVGDRVAVAPLVPCGKCDYCNEGNFGLCDDYNIIGTRVNGAFAEYVRVPEEHILKLPDTLDYETAAGIEPATIAYHGISKSNIRVGDSVVVLGCGPIGQFVIQWAKVFGASKIIAVDIFDEKLELSKLLGANYILNSKEVNVIKEIKKITNGGADVVIETAGSRFTQEQSLFVAKKRGNIVFVGISHTELPLSADATECILRGELTLKGSWNSYTSPYPGRAWTATLDFMEKGDIIFKPMISDKIGLNEVGDFLSKMSKREINFNKILVEI

SEQ ID NO: 20804 - protein, 422 aa, Oryza sativa (japonica cultivar-group)
MGAFLLFVCVLAPFLLVCAVRGRRRQAGSSEAAACGLPLPPGSMGWPYVGETFQLYSSKNPNVFFNKKRNKYGPIFKTHILGCPCVMVSSPEAARFVLVTQAHLFKPTFPASKERMLGPQAIFFQQGDYHAHLRRIVSRAFSPESIRASVPAIEAIALRSLHSWDGQFVNTFQEMKTYALNVALLSIFGEEEMRYIEELKQCYLTLEKGYNSMPVNLPGTLFHKAMKARKRLGAIVAHIISARRERQRGNDLLGSFVDGREALTDAQIADNVIGVIFAARDTTASVLTWMVKFLGDHPAVLKAVTEEQLQIAKEKEASGEPLSWADTRRMKMTSRVIQETMRVASILSFTFREAVEDVEYQGYLIPKGWKVLPLFRNIHHNPDHFPCPEKFDPSRFEVSITNPLFRVFVPFPPFPFPVRPTS

SEQ ID NO: 20805 - protein, 389 aa, Brassica napus
  misc_feature (262)..(262): Xaa can be any naturally occurring amino acid
  misc_feature (274)..(274): Xaa can be any naturally occurring amino acid
  misc_feature (281)..(281): Xaa can be any naturally occurring amino acid
  unsure (1)..(389): unsure at all Xaa locations
MADNTDNRRAIWGVPEKLQLHIAMLTLQFGYAGFHVVSRAALNMGISKLVFPVYRNIIALLLLLPFAYFLEKKERPAITLNFLIQFFFLALIGITANQGFYLLGLDYTSPTFASSMQNSVPAITFLMAALLRIEKVRINRRDGISKVLGTALCVAGASVITLYKGPTIYTPTSHLHAHLLTTNSAILAPLGDAAPKNWTLGCLYLIGHCLSWSGWLVFQAPVLKSYPARLSVTSYTLLFGIIQFVIIAAFCERDSQAWAFHXGWELFTILYAGXVASGIAXAVQIWCIDRGGPVFVAVYQPVQTLVVAIMASIALGEEFYLGGIIGAVLIIAGLYFVLYGKSEERKFAALEKAMIQSSAEHVIERAPVSRGSVKSSITAPLLHQSTDNV

SEQ ID NO: 20806 - protein, 269 aa, Psychrobacter arcticus 273-4
MQAWVIGNWKQNPATSHDVDALLNELCTAISTTKQLSHNNSTRCQIMVAPSFLHLAAVSSRLKDTSVLCAAQDVSAYSASVGAYTGDCSAQQIADVGATWTILGHSERRQYHQESNDTLLQKMTHALTQELGVVFCIGETQAQYDAKQTLPVIDSQLAVVKKLIAEQPEVIDSLSTRLIIAYEPVWAIGTGKVPTVSEVSATHQYIKQTLAGFADSLSNMTVLYGGSVNADNADSFAADPMIHGALVGGASLKAESFLAIVTAFSKGSM

SEQ ID NO: 20807 - protein, 313 aa, Zea mays
MSPFYLARGASKLVRRITSETSVELKILSDKWRLLLAGLIFQYIHGLAAHGVHYLHRPGPTLQDLGFMILPELGKERGYISETLFTFVFLTFVLWTFHPFILQTKRFYTVLIWRRVLAFLCASQFLRIITFYATQLPGPNYHCREGSPLARLPPPQNAAEVFLINFPTGVIYGCGDLIFSSHMIFTLVFVITYQKYGSIRFCKMLAWCIAVAQSLLIICSRKHYSVDVVVAWYTVNLVVFFVDKKLTELPDRSVGSTSVLPVSARDKDTKLKEENTRLLNGNSMDSADRRPRTQMNGKQIENESHVDSETVKT

SEQ ID NO: 20808 - protein, 313 aa, Candida albicans SC5314
MSLKLVPQQRGIVHTYGFNLTAFEFTTDPSNISPNIILFVGGLGNGLLNIPYLPELADSASNEFQSTDGGSWSLVQVLLSSAYQGWGTSSLDRDTSELQSAIEYFRSERGGNRQKIVIMGHSTGCQDVIHYLTKTLYKENIPETSQVQGGILQAPVSDSEALSSGRDPTKHEALVQRVYDEYISKGKESEILPQEYRKLTWGVPTSAYRFYSLASKRGDDDYFSSYLTQEDYTKSFGKVNKPLLVLYGSIDEFVPEYVDKENLVSTWKQSTSSQYWSEHSQIIKGATHNLGDGSDAGVIEHLVSVVKKFISDL

SEQ ID NO: 20809 - protein, 843 aa, Malus x domestica
  misc_feature (118)..(118): Xaa can be any naturally occurring amino acid
  unsure (1)..(843): unsure at all Xaa locations
MEMPGRRSNYTLLSQVPDDQAAAFYETESKNNKGKGDRGFDWETGADFRANQQPNRAGNPYSSAGLQRQSSGSSFAESSISGEYYPPTLSTAAVSEIDGFGYVPDDVFKVSGGGGEFXMKGVDGAVTATGGGGGSSSGKSWAQQTEESYQLQLALALRLSSEATCADDPNFLDPVPDESASRTSGSVDAVSHRFWVNGCLSYFDKVPDGFYLIHGIDQYVWTVCTDLQENGRIPSIESLRSVDPGIGSSIEVVLIDRRSDPSLKELQNRVLTISCTCINTKEIVDHLAKLVCSRMGGSSSVGEDEILSIWRESSDDLKDCLGSVVVPIGSLSVGLCRHRALLFKVLADTIDLPCRIAKGCQYCTRDDASSCLVRFGLDREYLVDLIANPGYLREPDSLLNGPSSISISSPLRFPRLKPVEPTIDFRLLAKQYFSDCQSLNLVFDEAPAGSAVDEDNIHPKKFDRKSTEGKNLISNLSGDTSAHAKIPRTSGDDRNPQLFNPLQNILHTPPMVNDPIPLKCMPPVGHRDGPRVDTITDSRFVEGVQLVPSKPSRELGFDIEDLDIPWSELIIKERIGAGSFGTVHRADWHGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDLNPNVAAIIEACWANEPWKRPSFASIMDSLTPLIKAPVAQPSRADMPLLT

SEQ ID NO: 20810 - protein, 327 aa, Polaromonas sp. JS666
MSHPDSPAGAAEPVAITATEAPAEVVCVASWNADLVSHVARPIARGETLMASAFSISPGGKGSNAAVAAARQGARVALIARIGDDDFGRMGMTLWHAEGVATDHVEHAAGECSGVAQILVYDDGDNSIAVCPGAGSGLGASQVQAAHGVLRSCRVVMASCEVPVEATLQAFRLAREAGAITLLNPAPARPLPEELLALVDVLTPNESELYQLAGAEHSGSLDAAANHLLAGGTGAVLVTLGAAGCRLYQGRQTPIGLAGRSMPVLDTIGAGDTFTGTLAAALARGEPLASAMQWANAAAALSVTRRGAIDGIPARADVAALMSQVAR

SEQ ID NO: 20811 - protein, 843 aa, Malus x domestica
MEMPGRRSNYTLLSQVPDDQAAAFYETESKNNKGKGDRGFDWETGADFRANQQPNRAGNPYSSAGLQRQSSGSSFAESSISGEYYPPTLSTAAVSEIDGFGYVPDDVFKVSGGGGEFRMKGVDGAVTATGGGGGSSSGKSWAQQTEESYQLQLALALRLSSEATCADDPNFLDPVPDESASRTSGSVDAVSHRFWVNGCLSYFDKVPDGFYLIHGIDQYVWTVCTDLQENGRIPSIESLRSVDPGIGSSIEVVLIDRRSDPSLKELQNRVLTISCTCINTKEIVDHLAKLVCSRMGGSSSVGEDEILSIWRESSDDLKDCLGSVVVPIGSLSVGLCRHRALLFKVLADTIDLPCRIAKGCQYCTRDDASSCLVRFGLDREYLVDLIANPGYLREPDSLLNGPSSISISSPLRFPRLKPVEPTIDFRLLAKQYFSDCQSLNLVFDEAPAGSAVDEDNIHPKKFDRKSTEGKNLISNLSGDTSAHAKIPRTSGDDRNPQLFNPLQNILHTPPMVNDPIPLKCMPPVGHRDGPRVDTITGSRFVEGVQLVPSKPSRELGFDIEDLDIPWSELIIKERIGAGSFGTVHRADWHGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDLNPNVAAIIEACWANEPWKRPSFASIMDSLTPLIKAPVAQPSRADMPLLT

SEQ ID NO: 20812 - protein, 1125 aa, Oryza sativa (japonica cultivar-group)
MTMMTPPPIEQQQQEDEEMLVPHQELPAAAAVVADAVQPMEVVAQTEPANAAESQPPEDPQTSRFTWTIENFTRINGKKHYSEPFVVGGFKWRVLIFPKGNNVDHFSMYLDVADSVNLPYGWNRYAQFSLAVVNQIHPKYTIRKDTQHQFNARESDWGFTSFMPLSDLYDPSRGYLVNDTVVVEAEVAVRRMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKETVVEGTIEQLFEGHHINYIECINVDYKSNRKESFYDLQLDVKGCSDVYASFDKYVEVERLEGDNKYHAEQYGLQDAKKGVLFLDFPPVLQLQLKRFEYDYMRDTMVKINDRYEFPLQLDLDRDDGKYLAPDADRSIRNLYTLHSVLVHSGGVHGGHYYAFIRPTLSDQWYKFDDERVTKEDTKKALEEQYGGEEELPQINPGFNNTPFKFTKYSNAYMLVYIRESDKDKIMCNVDEKDIAEHLRIRLKKEQEEKEHKKKEKAEAHLYTIIKVARDEDLKEQIGKNIYFDLVDHEKVRSFRIQKQLPFTSFKEEVAKECGIPVQFQRFWLWAKRQNHTYRPNRPLGPHEESQSVGQLREVSNKAHNAELKLFLEVETGVDLRPIRPPEKSKEDILLFFKLYNPEKEELCFVGRLFVKATGKPSEILTKLNEMAGFAPNEEIELYEEIKFEPNVMCEHIDKKLTFRSSQLEDGDIICFQKSPVSDGETQVRYPDVPSFLEYVHNRQVVHFRSLEKPKEDDFCLELSKLHTYDDVVERVARQLGLDDPSKIRLTSHNCYSQQPKPQPIRYRGVEHLLDMLVHYNQTSDILYYEVLDIPLPELQCLKTLKVAFHHATKDEVVIHSIRLPKNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLLVIREGETAAEILERIQKKLRVPDEEFSKWKLAFISMNRPEYLQDVDVVSARFQRRDVYGAWEQYLGLEHTDTTPKRSYTANQNRHTFEKPVKIYN

SEQ ID NO: 20813 - protein, 199 aa, Glycine max
  misc_feature (36)..(36): Xaa can be any naturally occurring amino acid
  misc_feature (72)..(72): Xaa can be any naturally occurring amino acid
  misc_feature (102)..(102): Xaa can be any naturally occurring amino acid
  misc_feature (191)..(191): Xaa can be any naturally occurring amino acid
  unsure (1)..(199): unsure at all Xaa locations
MTRSFFRPDIGGLRLYWLQTDMMETLCELWGENYSXEPATNEICTKHEGQYLLKHKALTEERIPHCSKLSGXCSHAAIREDIRLNLGPMDELSNLLNGDILXCECEGDNPDDNFSRQLADYIIYIIDEYGGDTNPREGGPEITQADLLERNRTDRAHASEADLGGMQCDALALRDGGPFVIAQTKRKIGVXEIGNLVLS

SEQ ID NO: 20814 - protein, 652 aa, Cryptococcus neoformans var. neoformans JEC21
MLHSWEVLAKILQSEEAKGIVCDIGMPLEHKNNNYNCRVIIFNGKILLIRPKMWMANDGNYRELRHFTPWHKHRQVEKHSLPHMIRIVTGQTYVPFGDAVIATEDTVIGVELCEELFTPASPHILMGLDGVEIFTNSSGSHHELRKLNRRVELIKEATMKLGGIYLYANQQGCDGDRLYYDGACLIAMNGQILAQGPQFSLSEVEVVSATVDLRAVRAHRTTSSRRMQSAQAEAYERVVADTRLDGGEQIKVGLRETKGSMDVRYHTPEEEIALGPACWLWDYLRRSRTQGYFLPLSGGIDSCATAIIVHSMCRLVVEAAAKGDEQVITDARRITNEPEDSTYIPEDPREFAGRIFHTCYMGTENSSSETRERAKNLADAIGAYHVDLNMDTAVSAVKGIFSFVTGKTPQFKAHGGTNAENLALQNIQARLRMVVSYMFAQLLPWVRGKNGGLLVLGSANVDESLRGYFTKYDCSSADVNPIGGISKVDLKRFIAWAQVKFDLPILYNFLHAVPTAELIPIGPDNIIQSDEIEMGMTYDELSVYGRLRKVEKCGPFSMFGKLVQEWGSFLSPKEIAEKVKHFFFMYAINRHKMTTITPSVHMESYSPDDNRFDLRPFLYPSQFTHQFRKIDELAGKLPDMAQKPKVDTNEVD

SEQ ID NO: 20815 - protein, 628 aa, Legionella pneumophila str. Lens
MKQFPGFYFDRNRAIDLICMGRVAVDLYAEQIGLDLKDVASFKKYLGGCAGNIAVGAARLGLKSQMFSCVGSDELGKFLKEELEREGVNIELLSETDNHLTGLVLLGIKPPSNFPLLFYRNDCADMQIKSDQISFTHLKNAKALLITGTGLSTESMKNTTLEVVHLARKAETTIVFDLDYRPVLWRLTVIGNGESRYCQNEYVTQVYQQVLPLCDLIVGTEEEICIAGGSNDIEVSLINIRQRTDVPIVVKLGEKGAHVHFGADKGLLQAKSFPVEVLNVLGAGDGFMSGLLAGLLQGKSWERAVTYANACGALVVTRHGCAPAIPYKEELNYFIQEYDHDPEIWSSSQLTQLHEELSKNQKTQLLIKNPCGFADGLNSIVTMQDSPTAMSFSSLKLNKGQSHQFNSSYEFAALLMTGKVAFQYGSYSQEVERTDYFSQSPYVLHCSKNEVSSVIALTDCEILLMETENENLFSPILFDASNMLELDNRGEGVLENTSYRLVRTVFDKRNRPESNLVVGEIITFQGRWSSYPSHYHQQPEIYHYRFSEPQGYAFGENGKEVMRIEHYDTYQIANNQEHAHCTAPGYALYTLWFIRHLNNNAYTLPTFTKDHEWTRTSRANLRAWQQKQ

SEQ ID NO: 20816 - protein, 471 aa, Legionella pneumophila str. Lens
MNKGMNAFVFLIAVIAGFGGFLFGFDSSVIADVKDQVISQLALTDWQWAQVVSSSLLGCILGIPISGLVADKLSRRSLLKVVALGFMLGSSLCALAPGLVSILLGRFIIGICIGIASYIAPLFIAEIAPPHQRGTLVLINGLTITFGQAVAYLIGYFLHDYSLMSWRYLFWIGSLPALVLFSGMYFVPHSPRWIMMKYGADATLKTLKQIRPVGYNIQQELTEISNNLVNPAPAYIQMFKKPIVFVLLLGIGLGLFQQFSGINALMYYGPVVFESFGFSPVKNAILATFFLGLVNFIFTVVTLFYVDKLGRRFLLISGTLIASISLYFVSVLSCNSLFVNKFWILGGLSFYVMGYCISLGSLFWVLISEIYPLSVRGLAMSIATVFQWGANFVVSLLFLPIYQFSGQTVTFAMFATFCLLACWFIYYFVPETTSVSLEKLEENLSSGKKVRDIGQPVSKNIKIAKFNLIMD

SEQ ID NO: 20817 - protein, 337 aa, Beta vulgaris
MAKIKIGINGFGRIGRLVARVILQRDDVELVAVNDPFITTDYMTYMFKYDSVHGQWKHHELKVKDEKTLLFGEKPVSVFGCRNPEEIPWSQTGADFVVESTGVFTDKDKAAAHLKGGAKKVVISAPSKDAPMFVVGVNEHEYKSDLHIVSNASCTTNCLAPLAKVINDKFGIVEGLMTTVHSITATQKTVDGPSAKDWRGGRAASFNIIPSSTGAAKAVGKVLPALNGKLTGMAFRVPTVDVSVVDLTVRLEKAATYEDIKAAIKAESEGKMKGILGYTEDDVVSTDFIGDNRSSIFDAKAGIALNDHFAKLVSWYDNEWGYSSRVVDLIVHMSKTE

SEQ ID NO: 20818 - protein, 298 aa, Nanoarchaeum equitans Kin4-M
MLLLYNMKVWFNGQILDYEDVRIPIDTHALHYGSSVFEGIRSYKAKKGVAVFRNEDHVKRFFYSMQTLRMKIKFDENTIREAIKEVVRVNNLEDSYIRPIAFYSKGGIGLDPRKNEVDIAIFAIPWGKYLKEEARVTIVSYARPNTLITNPKAKIGGMYVNSILATLEAKERGFDEAIMLDLNGFVAEGPGENIFLIYKDSKTAVTPIEGSILPGITRDTVKHLLRDLGYNVIERNVLVDELFIADELFFVGTAAEVTPIKELDGQTFDTSFGKKVYEEYMKVVRGENKKYEYWLDYI

SEQ ID NO: 20819 - protein, 780 aa, Candida albicans SC5314
MSKNKLSSLGNHGTTTTSSLSSSSSISNNTSIARIIFVFSNILKLVQSIPIGHITHGNVGGDYSTETKRPVLTPEEFYMNLFTSIFLVLAGGVFAGLTLGLMGQDEVYLKVIAHSGDSTERKHAKKVLQLIGRGKHWVLVTLLLSNVITNETLPIVLDRCLGGGWPAVVTSTVSIVIFGEIIPQSICVRYGLQVGSLFAPFVLVLMYIMYPVAYPCAMLLDHILGEDHGTVYKKSGLKTLVTLHKTMGVERLNQDEVTIISAVLDLKEKPVSSIMTPMDRVYTMSADALLDEKTVEEIFNAGFSRIPIHLPNEPTNFIGMLLVRVLISYDPEDALPVASFPLATLPETGLDTSCLNILNYFQEGKSHMIVVSENPGEPTGAVGVLTLEDVIEELIGEEIVDESDVYIDINKNIKRKHPGPLAKRNLTSYLHTLYQRNSSSNPNSKRNSIDSSVYRNANANANGNGGRVSPPLDISERLRQGSESSQISYTTNNNNTKNRKQQDQNEVAGAAAATATAATNWKPKNPASNPLETKKKFVTIKRPDQDKIESMKKITSPKLVPTQVGTIYSTEKGALEEAHRRSLDEREHGPKFLLPMEREGDVSEINQQNYHGENGSHHHIDIPMNGNGNGNGNDNHNQANDSNGSHTGNIDIPIPEYQESRSYKTGGIVESVVNVQGVSKVIIENVTDADDDEDEIALAIENLSSNDNNNKKHKLKKSKKSKKKSKKSPSSTLKSVTTSLNDDDVNDVNDDQTVEQTQSLLHSGNGSRNSSIGSNTSNNK

SEQ ID NO: 20820 - protein, 595 aa, Candida albicans SC5314
MSSDVKQLLPQWIYIISFYSSITSTIIILLSIYFHLLNYRKPFQQRLMIRIQLIVPLFAISCYSMLINQTSPINKFLLEPIREVYEAFVIYTFFSLLTDMLGGERQIIIVTSGREPISHPGILRYLLPKLDISDPHTFLNIKRGILQYVWLKPILCITIIILELIGLYNVNDLSIKSIYFWLTLIYNASVTLSLYCLAIFWKILWNDLKPFKPVGKFLCVKLIIFASYWQGVILAILSVLKLLPNGDIAENDGENIGIAIQNALLCIELIGFAIGHWISFSYYPFTISQLPYGRFQFKYAIKDCLGFKDLISDFGLTFHGDYYKDYKQFDSVEAMVAHPESKGRMSRIHQGLRYHYDGKHKHWLPENQSLLSATTLLSQQGQGQGQGQGQLSISSNSMSVPSTSEIHALDTSSILSNNTSMKGLYPISSRRSSSLEDNYSPLLDLQQQQQQQASSEQQYIQQPISIQDIMENDLELSSSLSSSSNNHGDSIDYTNEEFDIDEILYDESIKQINIYRLDDEKIKKIINYPIVDEVIDSHLYGYKVQKLRQRQKIRDLKSKQQQQQQQHQQNRDASGGSSVSPILQSNESYRYGSIV

SEQ ID NO: 20821 - protein, 442 aa, Carboxydothermus hydrogenoformans Z-2901
MSYTKNDIMDMVREQNVKFIRLQFTDIFGVLKNVAIPVEQLEKALNNELMFDGSSIEGFVRIEESDMYLRPDPNTFAVFPWRPRNGAVARLICDVYNPDGTPFEGDPRYVLKRALAEAKELGYTMYVGPELEFFLFQVDAEGKPTLVTHDNAGYFDLSPVDLGENARRDMVLALEQMGYEVEASHHEVAPGQHEIDFKYSDALDVADKIVTFKVVVRSIAQRHGLHATFMPKPLFGVNGSGMHTNQSLFKDGQNAFYDPNGELQLSETAYYYIGGIMKHIKAITAIANPVVNSYKRLVPGYEAPVYIAWSARNRSPLIRIPAKRGSSTRIELRSPDPSANPYLALAVMLKAGLDGIKNKIKPPAPVNQNLYEMTAEERKALGVDTLPGSLKEAIDCLLEDKVIQEALGKHVFERFVEAKLKEWDEYRVQVHEWEVKKYLTMY

SEQ ID NO: 20822 - protein, 218 aa, Wigglesworthia glossinidia endosymbiont of Glossina brevipalpis
MIEEKLKKQAAWAAIKYIKPGDIVGVGSGSTAEYFIDALGSIKNLIKGTVSSSRISSSKLKDLNIPLFDLNEVSLLNIYVDGADEINQKKHMIKGKGAALTREKIIASAAKKFICIVDSSKFVHVLGRAPLPIEVIPMARTLVSKKIIDIGGSPKYRKGIITENGNVLLDVHNLIILDSLFLEEKINNIPGVVSVGLFAHRAADIAIISGKNGIKIID

SEQ ID NO: 20823 - protein, 604 aa, Wigglesworthia glossinidia endosymbiont of Glossina brevipalpis
MSSSKKESRNNAKNFIKNFSENLYPNSNRVYLNNSDKSIKVPVRSVELNRTEIIDNNNKIKYEENSPVMIYDTSGPYGDPKSLIDMKSGLNKLRNKWIIDRKDVELISKNLNLENKNNNFKKNIDHYISKKNRCITQLYYAKSGIITKEMEFVSIRENMNYEYSESEAKNNKKITPEFVRKEVASGRAIIPSNINHPESEPMVIGRNFFVKINANIGNSSISSSIEEEVQKLIWSVKWGADTVMDLSTGRNIHETREWILRNSPVPIGTVPIYQALEKANGIVENLNWKIFKKTLLEQAEQGVDYFTIHAGLLLRYIPMTSNRLTGIVSRGGSIIAKWCLFHHKENFIYENFEEICKICSCYDISLSLGDGLRPGSIKDANDEAQFAELYTLGKLTKVAWNYNVQVMIEGPGHVPINMIKENMTKQLKYCHEAPFYTLGPLTTDIAPGYDHFTSGIGAALIGWYGCAMLCYVTPKEHLGLPNKEDVKQGLIAYKIAAHAADIAKGHHISQIRDDAISKARFEFRWEDQFNLSIDPNTARSFHDETLPKSSGKNFHFCSMCGPKFCSMKISQEVRDFAKNKKIIDGMNKMSEIFKKNNNKMSLKK

SEQ ID NO: 20824 - protein, 464 aa, Oryza sativa (japonica cultivar-group)
TRLKSPPKMTPPASTGKCTGAAAGEVEEPLLPEFSGGGHGASVSGAVFNVSTSIIGAGIMSIPAAMRVLGVLPALLLIATVAALSDASVEFMLRYTGWDSGPPSYAGIMGDAFGRAGAKALNVCIAFTTTGTLVVYLIIIGDVLSGSAGAGDEHAGVLQELFGAQWWTARELVILVTAIVVLLPLVLRRRVDSLKFTSAVSILLAVVFMFISLGIAVYALFTGTAKMPRMLPDFSRLSSPFELFTAVPIVVVAFTFHFNVHPIRTELSKTSDMKAAVRISLVLCAAIYAAVGFFGFLLFGDATMADVLANFDRSSGAGVPQALNDAARLSYALHLVLVFPLLHFSLRVNVDELLFPGRRPLATDTRRFVALTAVLMAVLYALAIAIPSIWTLFEYSGSTFAVCISLIFPGAIVLRDAHGIAKTKDKALAATMIALAVITSSIAIASNVMSSISGKVEGGHAAGR

SEQ ID NO: 20825 - protein, 139 aa, Brucella suis
MSIFPAQPSDKKAVEEGAAFMPRFDASGLITAIVTDARDGELLMVAHMNEEALRLTLETGIAHYWSRSRKTLWKKGETSGNLQSVVELRTDCDQDALWLKVHVAGDGPTCHTGRRSCFYRQVVSSGGKVALTMVSDHDQ

SEQ ID NO: 20826 - protein, 141 aa, Chlamydia muridarum Nigg
MEQTLSIIKPDSVGKAHIGEIVSIFEKAGLRIAAMKMVHLSVKEAEGFYAVHKERPFFQELVDFMISGPVVVMVLQGENAVARNRELMGATNPKEAAEGSIRALFGESIGVNAVHGSDSLENAAIEVSYFFAKTEIVNALA

SEQ ID NO: 20827 - protein, 231 aa, Zea mays
MASSSDPWMKEYNEASRLADDISSMIADRGSLPQSGPEIMRHTSAIRRKITILGTRLDSLESLLGRIPPKSITDKEMHKRQDMFSSLKSKAKQMATSFNMSNFANREDLLGQSKKADDMSRVAGLDNQGIVVLQRQIMKEQDEGLEKLEETVLSTKHIALAVNEELTLHTRLIDDLEDHVDVTNSRLQRVQKRLAILSKRTKGGCSCMCLLLSVVAIVILAVIVWLLVKYL

SEQ ID NO: 20828 - protein, 335 aa, Chlamydia muridarum Nigg
MRIVINGFGRIGRLVLRQILKRNAPIEVVAINDLVSGDLLTYLFKYDSTHGSFASQATFSDGCLVVGERKIRFLAEKDVQKLPWKDLDVDVVVESTGLFVNKDDAAKHLDSGAKRVLITAPAKGDVPTFVMGVNHQKFDPANDVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAVCEAVKHAASTSMRNIMHYTEEAVVSSDFIGCEYSSVFDAQAGVALNDRFFKLIAWYDNEIGYATRIVDLLEYIQGNSK

SEQ ID NO: 20829 - protein, 691 aa, Psychrobacter arcticus 273-4
MTISDIGSQASTTTSSKATAKADALKTPAHRSETDARFEEDARDLHRILPASRKVYIEGSRPDIQVPMREITLDPTPIQGVPESEWEQNPPFYVYDTSGVYTDPNTTIDLTKGLPKLREEWIKERGDTEQLSGLSSDYGQARARDISTANLRFAHIDKPRRAKAVDGKVGNVTQMHYARRGIITPEMEYIAIRETQKQHELTDMRQHEGETFGAHTPAIITPEFVRSEVAAGRAIIPNNINHPESEPMIIGRNFLVKINANIGNSALGSSIDEEVSKMTWATRWGADNIMDLSTGNHIHETREWLIRNSPVPIGTVPIYQALEKVDGVAEDLTWEIFRDTLIEQAEQGVDYFTIHAGVLLRYVPLTANRLTGIVSRGGSIMAQWCLAHHKESFLYTHFEDICEIMKQYDVAFSLGDGLRPGCLQDANDEAQFGELRTLGELTQVAWKHDVQVMIEGPGHVAMNRIKENMDLQLETCADAPFYTLGPLTTDIAPGYDHITSAIGAAMIGWFGTAMLCYVTPKEHLGLPNKKDVKDGIITYKIAAHAADLAKGHPGAQARDNALSKARFEFRWDDQFNLALDPDTAREFHDETLPKDAHKSAHFCSMCGPKFCSMKITQNVRDYAAGLKTLADTKNSVSPQSGALNDAEHLIKKVDTQLVEQVGSASAEEIHQGMAEMTEKYHKEGRQLYKEV

SEQ ID NO: 20830 - protein, 762 aa, Candida albicans SC5314
MASHSNSNSNSLFQNDKNNNSNRDIAIPTPSNSSSFRNTNTNPTPSIRSPSPSINSYNNNNNNNSAIPTTTTSRSITGMSNASINDSGDSNPQSYDEQISQLNNLNNKKSFDLKTISKHLINQEDSLKTQGGDITRRLYHQMENITGNNNHNNNNNNTDTTGNDLDDNVSIGGNSTFRDGPPPRLRTRSASFSSYLEETRRGSMASDINIPGGFRREFLINKAIQKNQQPPNFLTQNFMEFLSIYGHFAGEDFSDEEEEGDEGDEEYDNGHDGDEVFDEESSLLGNERRGGGSGGGQPFRQLPKKPHSHPQKQPPKGTASVFKTFLLLFKALVGSGVLFLPRAFYNGGMLFSMITLSLFGLLTFFCYIGLIESKTILRLSSFGELGYKTYGKPLKYCILVSILLSQIGFVTTYILFTAENMIAFLSQYVSTKNNLLSQEVLPNWLNRGNLILIQCILLIPLVLIRNLAKLSMVSLISSVFIVIGLLIIFWYSGVNLINNGVGPNITNFNSNSWTMLIGVAVTSFEGIGLILPIQSSMSQPEKFPLVLSISMAIITSIFVGIGTIGYFSFGDKIKSIIILNLPQDQFAVQSILVLYSIAVFLSGPLQLFPAIKIGESLIFRHSKKKSKRQQHQHGSTDESNTNNTDDNDGKLYHQSGKYNPQVKWLKNGFRAISVIFICSLAYLNADNIDKFVSFNGCFACIPLVYIYPPLIHLKSIQSKQQQQQQQTGRSKSDQLFIWLDYLLIVVGIATVIYSSYQIIFLN

SEQ ID NO: 20831 - protein, 376 aa, Xanthomonas campestris pv. campestris str. ATCC 33913
MSKRDYYEVLGVARGASDEELKKAYRRCAMKYHPDRNPGDAAAEATFKECKEAYEVLSDGNKRRAYDAHGHAAFEHGMGGGGGGPGGPDMGDIFGDIFGNIFGGGAAGPRAARRGADVGYVLELDLEEAVAGIERRIEIPTLIECEPCHGSGSEDGKVEVCATCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTTDQRELLKQFEATFTGEDARKHSPKSATFIDGVKGFWDRMTS

SEQ ID NO: 20832 - protein, 401 aa, Xanthomonas oryzae pv. oryzae KACC10331
MLSEPLIDFLTSGVARLGVWGMLAVLLVFTQLTIFAVTLYLHRSQAHRGVDFHPVIAHFFRFWTWFTTSMISREWVAIHRKHHAKVETEEDPHSPQSKGISQVFWRGVELYREARTQRADIEQYGKAAPTDWIERHLYTPHANAGPVALLVINSVLFGLPGIALWAVQMAWIPFWAAGVVNVLGHWWGYRNFESADTSTNLTPWALRIGGEELHTHHHAFPSSARFSMRRWELDIGWVVIRSVQAFGLAKVLRVAPSLDIRPNIAVLDADTLKPLLSHRFQAMTDYQRNVLKPALREEAAATGAKLRELLPRRLRKGLVDDGRWLKPEARAQLQTWVAQRPRMRTLVEYRARLTAVLEARSHDASERLRQLQQWCHEAEASGNAALQAYAARLKGDALSGA

SEQ ID NO: 20833 - protein, 151 aa, Dioscorea bulbifera
MEITKKMVAVSGMVLLVVMFGLLGDGVKAQQASNVRATYHYYNAAQNNWDLRAVSAFCATWDADKPLAWRQKYGWTAFCGPAGPTGQDACGKCLLVTNTKTNAQATVRIVDQCSNGGLDLDWSVFEQIDTDKSGYAQGHLIVNYEFVNCGD

SEQ ID NO: 20834 - protein, 342 aa, Xanthomonas oryzae pv. oryzae KACC10331
MTSLTNRRIVLASRPQGEPSADNFRIEDIAVPPTGHDQILVRNRFLSLDPYMRGRMDDGPSYVAPVAIDALMEGGTVGEVIESNHADYHPGDLLVLPGGWQTHSLLTPKTPLRKLPQDDGLPPSTALGVYGMPGFTAYAGLHEIGKPQSGETLVVAAASGPVGATVAQLARLQGLRVVAIAGGEEKVRYLRDTLRVDVALDHRADDFAEQLRAATPDGIDIYFENVGGKVFDAVLPQLNDFARIPVCGVIATYNSRGQVLPGPDRLPEFIGQLLRKRLTVRGFIQHDVIRLMPAFLREMGQWLREDKIQYREHVLHGLDSAPQGLVDVLRGKNFGKAVVALD

SEQ ID NO: 20835 - protein, 269 aa, Mesorhizobium sp. BNC1
MPNHPENREITGRTRVLGILAHPTEHVKAPPAINRIAAERGKDAVMVPFDVAPEELAKVVEALRQIKSLDASIVTVPHKQSIVALCDELTPQARAVNAVNILRFEPDGRLIGGQLDGIGFVEGLRSAGVDPAGMRVFLAGAGGAASAVAFALADAGISHITLSNRSRHKIENLRDRLRKFRSDLSVSLGSGDAGGHDLVINGTTLGMKPEDPLPLDVATLHAGMVVAEVIMEPEMTPLLRAAQAASCRIHHGRHMLQHQLQLMADFMGL

SEQ ID NO: 20836 - protein, 362 aa, Arabidopsis thaliana
MKNGNRKTTPETEKSHRRKLSEKAMSFHGRGTTPLSNPGELRRPKTLPELFSTGQSITVPETVSLPPRLTKLLLNVTVQGSLGAVQIIISPESTVSDLIDAAVRQYVKEARRPFLPESEPSRFDLHYSQFSLESIVRDEKLISLGSRNFFLCGRKETGGFIGCGLSSESCSKEAEKVAKTGIEIKPGKPFKVIQKDGFMVHASQVTLGDVEKVKKDETFAVYVKIGDDENGFMIGNLSQKFPQFSIDLYLGHEFEISHNSTSSVYLIDSELDEYMEQQIAALPQNEINPEEDDESDSDEMGLDEDDDSSDEEDVEAEAPLKVAPPSKKMPNGAFEIAKGGKKNKSSGGKKRCPFPCGPSCKK

SEQ ID NO: 20837 - protein, 471 aa, Xanthomonas oryzae pv. oryzae KACC10331
MSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGASLPHELIAGPHAGGIANLPAVVITFLVAGMLMAGTKESATLNAVLVVLKIIALGVFVAIALPTFKSANLQPFMPYGISKAMGPDGVERGVMAAAAIIFFAFYGFDAISTAAEETKNPGRDLSIGIVGSMIGCTLIYVLVALAAVGAMRFTVFGKSPEPLALILRELGHGKAALVIGAVAIIALPTVLLAFLYGQSRIFFVMSRDGLLPRGLSKVNARTGTPVAITLLTAVLVAALAGVARLDEIAALANAGTLAAFTAVAACLLVLRVREPGRARAFRTPLAWVVGPVAILGCLYLFWSLPSNTQGWFLLWNALGVVVYLAYGRRNSRLNSAG

SEQ ID NO: 20838 - protein, 417 aa, Oryza sativa
MSKAAAAASLPPPPPEVAHLVDQLQRHHLAPDASLLSSCAHSDLLQAREEVASERARYLEALAVYAEAIAMVEEYQHAISTGVANAGKKLNCSPQVYESLEHHLAVAEAAQRLRLPLLSQDGDVHEEEIEKLSTLSRSSFDSTMTSAAPSSSSISTSYNNYSSTASAATVAAAPGTGGSEPVEPGVGGVPDRFLGITSDYLYQVQQEQPAMTVDMVDYQRTLAREIEARLEAKCDALADLFAMDERDSSSISQISSARLPERVKLIIEEIEKEEALLLDDLASMDRKFAEHYNVLEQILAVLIQFVKDKKLEHQHQYDDLKKTWLIKRCRTMNAKLSYLEHHLLRDTYTKETVPALHRIRKYLVEATKEASNSYTEAVSRLREYQGVDPHFDKLEGMQWTIHQVEMDLKPHHDHADV

SEQ ID NO: 20839 - protein, 475 aa, Mesorhizobium sp. BNC1
MFKNYIAGEWVEAEGTENINPSDTSDVVGVYSRATRENVLDAISAAKAAFASWSRSGPLQRHSVLRKAADEIMARKDELGSLLAREEGKTLPEAIGEVVRASQIFDFFAGESLRLSGEIIPSVRPGIGVEITREPVGVIGIITPWNFPIAIPAWKIAPAICYGNAIVFKPADLVPASSWAIVDILQRAGLPAGVLNLVMGKGSVVGQAILESPDVAAVTFTGSTQTGKHVAAASIEHNRRFQLEMGGKNPMVVLDDADLSIAVEAATNSAFFSTGQRCTASSRLIVTEGIHDRFVEAMTQRLSSLVVDNALKPGTHIGPVVDESQLQQDLDYIEVGQKEGARLHFGGRRLERETNGFYLEPALFTEASNDMRIAREEIFGPVAAVIRVKDYEEALAVSNDTPYGLSAGIATQSLKFATHFKQNAEAGMVMVNLPTAGVDFHVPFGGRKRSSYGPREQGRYAAEFFTTVKTSYSLA

SEQ ID NO: 20840 - protein, 333 aa, Festuca pratensis
MAKHGAFAAALVVGLLAAIPAAVESIGVCYGVNGDRLPSASEVVQLYKSNGITGMRVYNVNDNTRPEGPERQQPRPHPRHRQHTAQCPRFQRLQRGHVGQLVKANVQSQQGLAIKYIAVGNEVPNQGGNTADILPAMKNIQAALVRAGLGGIKVSTAVHSGVTQGFPPSQGTFSAAHMPPIAQYLASIDSPLLANIYPYISFKGTPSIDIKYALFTAPGTVVTDGRNSYQNLFDALIDTMYSALESAGAGSVPIVVSESGWPSAGDLDATAANARTYNQNLINHVGKGDPKKPGAIEAYIFAMFNENLKGGLETEKHFGLFNADKSPAYSINF

SEQ ID NO: 20841 - protein, 321 aa, Capsicum chinense
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYIDPEYFIKGRLTEKSDVYSFGVVLFEVLCARSAIVQSLPREMVNLAEWAVESHNNGQLEQIIDPNLVAKIRPESLRKFGDTAVKCLALSSEDRPSMGDVLWKLEYALRLQESVI

SEQ ID NO: 20842 - protein, 535 aa, Spiroplasma citri
MEKIITIGTKINLKDDDLIKYGDYMAKVKAFNFINLPKKAKFILVTAINPTKAGEGKTTCSIGIADMLNHLGYQTTLALREPSLGPVFGLKGSATGGGECIMEPENEINLHYTGDFHAITTANNMVSSMIDNLLYWGNPLQIDPKQIVWQRCLDVNDRALRNIEIKISDKLHRLEHFQITAASEIMAILGLSKDFSDLRRRLDQAIVAYNFNNEPVYLHELKITGSLLALLKNALLPNLAQTKHGTPLLVHCGPFANISHGTNSLIATNLALKLSDFVVSEVGFGSDLGFEKFNDIINLNEEYTPDCTVLVATIRALKLHGGAVETTLATADLVTLKKGLTHLQHHIKIIQNYHLNFVVCLNQFATDTLEEIAMVTEWLKEQKIPFGINNTYHLGIKDDPTLVKTIIKEIEKPQQYQLLFNPTTTSLTEKIKIICTKIYQTTKIVFSPLAQTKINFYQQNPKYKHWPVCMAKNHQTIFGNKNPYDDQIIIRDLKINSGAEYFIAYLADIITMPGLNKIPNAASIEVANDEIINIK

SEQ ID NO: 20843 - protein, 321 aa, Capsicum chinense
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTNGVMHRDVKSSNILLDENFVPKITDFGISKKGTELDQTHLTTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDALWKLEYALRLQESVI

SEQ ID NO: 20844 - protein, 311 aa, Capsicum chinense
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGLSKTRPQLYQTTDVKGTFGYIDPEYFIKGRLTEKSDVYSFGVVLFEVLCARSAMVQSLPREMVNLAEWAVESHNNGQLEQIVDPNLADKIRPESLRKFGETAVKCLALSSEDRPSMGDALWKLECALRLQESVI

SEQ ID NO: 20845 - protein, 316 aa, Capsicum chinense
MGSKYSKATNSISDASNSFESYRFPLEDLEEATNNFDDKFFIGEGAFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDIKSINILLDENFVPKITDFGISKKGTELDQTHLSTVVKGTLGYIDPEYFIKGRLTEKFDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 20846 - protein, 294 aa, Sesbania rostrata
MEQYEKVEKIGEGTYGVVYKARDRVTNETIALKKIRLEQEDEGVPSTAIREISLLKEMQHRNIIRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPGILLGSRHYSTPVDIWSVGCIFAEMVNRRPLFPGDSEIDELFKIFRILGTPNEDTWPGVTSLPDFKSTFPKWPPKDLATVVPNLEQAGLNLLSSMLCLDPSKRITARSAVEHEYFKDIKFVP

SEQ ID NO: 20847 - protein, 417 aa, Solibacter usitatus Ellin6076
MTHTKSEELFRRAVEKIPGGVNSPVRAFRSVGGQPVFIARGQGSHLFDVDGNEYIDYVGSWGPLILGHRHPEILAALERALEIGTSFGAPTEQEIDLADAIIDAVPSVEMVRLVNSGTEATMSAIRVARGFTGRDLVVKFEGCYHGHVDSLLVKAGSGMATLGIADTQGVPKAFADTTIPLPYNSLDALEEAFRAHGDRIAAVIVEPVVGNMGCVPPLPGYLEGMRAITERYGALLIFDEVMTGFRVAFGGAQQLYGIKPDLTTLGKVIGGGLPVGAYGGRKDIMSKVAPAGPIYQAGTLSGNPLAVAAGLAMLRHLKRNPQVYTRLEECGARLAAAAPKGVTVNRVGSMFTFFFTDGPVTDWESAKRCDTSRFGEFFRGMLDRGVYLAPSQFEAAFVGAAHSDEDIAKTIEAAKTA

SEQ ID NO: 20848 - protein, 386 aa, Cucurbita maxima
MALNGKVATESAPSNLNEEMKGEYRPPFGGSDESKVPEDFIWSEKFEASELLPVLDVPTIDLEKFMSGDKSYVEEATRLVDEACRQHGIFFVVNHGVDIEMMGRVHDCMNEFFTMPLDVKQRAKRKVGESYGYTNSFFGRFASNLPWKETFSLRCVAAQNSSAAHDYVLDTLGPSFSHHGKAYQECGIALNELGTKIVELLGLSLGISREYFKNFFEDNDSILRLNYYPTCDKPEVVLGTGPHTDPTSVTILHQDPVSGLQVCSNDQWYSIPPNPEAFVINIGDTFTSLTNGIYKGCIHRAVVNSMNARKSLAFFLCPSHDKVVRAPEELVEKSPPRKYPDYKWPMLLEMTQKRYRPDCNTLEAFKTWVQEGKALDTGSTITAPSA

SEQ ID NO: 20849 - protein, 331 aa, Arabidopsis thaliana
MFTCINCTKMADRGEEDEEDEARGSTTPNTKEAVKSLTTQIKDMASKFSGSHKQSKPTPGSSSSNLRKFPDFDTASESVPYPYPGGSTSSTPAWDLPRSSYHQSGRPDSRFTSMYGGERESISAQSCDVVLEDDEPKEWMAQVEPGVHITFVSLPSGGNDLKRIRFSREVFDKWQAQRWWGENYDRIVELYNVQRFNRQALQTPGRSEDQSQRDSTYTRIDSARESRDWTQRDNNFRSPGGSVPHHFYGPPMDAARITTSSRDEPPSMSNASEMQGEWVEEDEPGVYITIRQLPDGTRELRRVRFSRERFGEVHAKTWWDQNRDRIQTQYL

SEQ ID NO: 20850 - protein, 715 aa, Escherichia coli
  misc_feature (140)..(140): Xaa can be any naturally occurring amino acid
  unsure (1)..(715): unsure at all Xaa locations
MKKVVTVCPYCASGCKINVVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 20851 - protein, 377 aa, Oryza sativa (japonica cultivar-group)
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVTHTVPIYEGYALPHAILRLDLAGRDLTDCLMKILTERGYSFTTTAEREIVRDIKEKLAYIALDYEQELETAKSSSSVEKSYELPDGQVITIGAERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKGEYDESGPSIVHRKCF

SEQ ID NO: 20852 - protein, 478 aa, Xanthomonas campestris pv. campestris str. ATCC 33913
MSEQFDVVVIGAGPAGYHAAIRAAQLGMKVACIDAAIGKDGKPALGGTCLRVGCIPSKALLDSSRQFWNMGHLFGDHGISFNDAKMDVPTMIGRKDKIVKQFTGGIAMLFKANKITPYYGFGQLQPGNIVKVTQHEGGEIELKGTNVILAAGSESIELPFAKFDGDTIVDNVGGLDFTAVPKRMAVIGAGVIGLELGSVWKRLGAEVTILEALPDFLALADAEVAKTALKEFKKQGLDIKLGAKVSKTEITGSGDAKQVVLSYTDAAGEQTLTVDKLLVAVGRKAATKNLLADGTGVKLTERGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFSGSADDLARICHAHPTLSEAIHDAAMAVSKRAIHKAN

SEQ ID NO: 20853 - protein, 426 aa, Psychrobacter arcticus 273-4
MADNQATLTVDGKDYQLPITEGTLGPSVIDVAAFQKAGYWTYDPGFMATAPVESKITFIDGGKGELLHRGYPIDQLANNAEYLEVAYALIHGDLPNAEQKADFYEKIRKHMGVHDQLRKFFEGFRRDAHPMAIMVGVVGALSAFYHENLDISNEEHREITAIRLIAKMPTLAAMSYKYSKGEPFMYPRNDFNYAENFLYMMFATPADVNYKTNDVITRAMDKIFTLHADHEQNASTSTVRLAGSTGANPYACIAAGIAALWGPSHGGANEAVLEMLDEIGSVENVPEFMEKVKSREVKLMGFGHRVYKNFDPRAQVMKETCDEVLGALGINDPKLELAMALEKIALEDPFFVERNLYPNVDFYSGIILKAIGIPTSMFTVIFSLARTSGWISHWLEMHSTPFKIGRPRQLYTGETHRDFVKVEDRK

SEQ ID NO: 20854 - protein, 129 aa, Bifidobacterium longum NCC2705
MSEKMEAVATSEAPAALGAYSQAVKANGFVFVSGQLGIDPATGELAGETAGEQAAQALKNIKHILDTAGTGIEHVCRATIYLKNVEDFKEVDARYAEAFIGSVKPARVAFGNNMIPKGALVEIDAIAVE

SEQ ID NO: 20855 - protein, 215 aa, Triticum aestivum
MEKAGHQHVIGIPVSSTAIGIEEPEFTSDGATYVHGDAKYSTSTRTGGKSGRPGDKFARGIREHVTLGPKLYETVRGKLSLGARILQAGGVEKVFRRWFAVEKGEKLLNASQCYLSTTAGPIAGMLFVSTEKVAFRSDRSLALTSPKGDTVRVPYKVAVPLRRVKAARPSENQHRPEQKYVQLVTDDGFEFWFMGFVSYQASLQHLEQAIAESHL

SEQ ID NO: 20856 - protein, 629 aa, Yarrowia lipolytica CLIB122
MLRLRTMRPTQTSVRAALGPTAAARNMSSSSPSSFEYSSYVKGTREIGHRKAPTTRLSVEGPIYVGFDGIRLLNLPHLNKGSGFPLNERREFRLSGLLPSAEATLEEQVDRAYQQFKKCGTPLAKNGFCTSLKFQNEVLYYALLLKHVKEVFPIIYTPTQGEAIEQYSRLFRRPEGCFLDITSPYDVEERLGAFGDHDDIDYIVVTDSEGILGIGDQGVGGIGISIAKLALMTLCAGVNPSRVIPVVLDTGTNNQELLHDPLYLGRRMPRVRGKQYDDFIDNFVQSARRLYPKAVIHFEDFGLANAHKILDKYRPEIPCFNDDIQGTGAVTLASITAALKVLGKNITDTRILVYGAGSAGMGIAEQVYDNLVAQGLDDKTARQNIFLMDRPGLLTTALTDEQMSDVQKPFAKDKANYEGVDTKTLEHVVAAVKPHILIGCSTQPGAFNEKVVKEMLKHTPRPIILPLSNPTRLHEAVPADLYKWTDGKALVATGSPFDPVNGKETSENNNCFVFPGIGLGAILSRSKLITNTMIAAAIECLAEQAPILKNHDEGVLPDVALIQIISARVATAVVLQAKAEGLATVEEELKPGTKEHVQIPDNFDECLAWVETQMWRPVYRPLIHVRDYD

SEQ ID NO: 20857 - protein, 588 aa, Candida albicans SC5314
MPEKELDYIRSTDAAGSTEKDGGIYIDAFDKQDNAPPKKGFAKFIDGFRRADAEELGIDPNLSEAEKIAIMTANSPLTRSLKNRHLQMIAIGGSIGTGLFVGSGSSLHTGGPAGLLIAYILIGTMIYCTVMSLGELAVTFPVSGAFVTYNSRFIDPSWGFAMAWNYAMQWLVVLPLELVAAAMTVKYWDAKTNSAAFVVIFYVLIVAINFFGVRGYGEAEFIFSAVKVLAVLGFIILGIVLCAGGGPQGGYIGGKNWYIEGAPFPNGAKGVITVFVNAAFAFAGTELCGLAAAETENPRKSLPKACKQVFWRITLFYVICLTLVGLLVPWNDERLLGSSSADASASPFVISIRNAGIKGLPSVMNVVIMIAVLSVGNSSVYGSSRTLAALAASNQAPKIFGYIDKQGRPLVGIIAQLLVGLLCFLAASDKQGEVFNWLLALSGLSSIFTWGSINVCLIRFRRALAAQGRDTGELVFTSQVGVIGAIWGAFLNTVVLCLQFWIAVWPLHSSPSAEAFFSAYLTVPVVIVFYVGHKLWTKNWQVYICAKDIDIDTGRRELDLDLVKQEVAEEKAYIASLPFYRRVYNAWC

SEQ ID NO: 20858 - protein, 314 aa, Capsicum chinense
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGISKKGTELDQTHLGTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 20859 - protein, 445 aa, Sesbania rostrata
MASRPIVPQQPRGDAALGAGKQQKKNGAADGRNRKALGDIGNLVTVRGVEVKPNRPITRSFCAQLLANAQAAAAAENNKKQACPNVAGPPPVVEGVAVAKRVAPKPGQKKVTTKPKPEEVIEISPDEEVHKDNNKKKEGDANTKKKSHTYSSVLTARSKAACGLTNKPKEIIDIDAADTANELAAVEYIEDIYKFYKMVENESRPHDYMDSQPEINERMRAILVDWLIDVHSKFDLSLETLYLTINIVDRFLAVKTVPRRELQLVGISAMLMASKYEEIWPPEVNDFVCLSDRAYTHEQILFMEKIILGKLEWTLTVPTPFVFLVRFIKASVPDEALENMAHFLSELGMMHYATLMYCSSMVAASAVYAARCTLNKSPVWNETLKQHTGYSEEQLMDCARLLVSLHSTVGNGKLKVVYRKYSDPERGSVAVLPPAKNLLSEGKSL

SEQ ID NO: 20860 - protein, 316 aa, Capsicum chinense
MGSKYSKATNSINDALNSSYLVPFESYRFPLVDLEEATNNFDSKGGFGKVYRGVLRDGTKVALKRHNRDSGQSIELFRTEFEILSRRSHPHLVSLIGFCDERNEMILIYKYMENGNLKRHLYGSDLPTMSMSWEQRLEICIGAARGLHYLHTNGVMHRDVKSSNILLDENFVPKITDFGISKKGTELDQTHLSTVVKGTLGYIDPEYFIKGRLTEKSDVYSFGVVLFEVLCARSAIVQSLPREMVDLAEWAVESHNNGQLEQIVDPNLADKIRPESLRKFGDTAVKCLALSSEDRPSMGDALWKLEYALRLQESVI

SEQ ID NO: 20861 - protein, 428 aa, Medicago sativa subsp. x varia
MKFSEENNVSNNPTNFEGGLDSRKVGQNRRALGVINQNLVVEGRPYPCVVNKRALSERNDVCEKKQADPVHRPITRRFAAKIANTKTTNAEGTTKRSNLAKSSSNGFGDFIFVDDEHKPVEDQPVPMALEQTEPMHSESDRMEEVEMEDIMEEPVMDIDTPDANDPLAVAEYIEDLYSYYRKVESTSCVSPNYMAQQFDINERMRAILVDWLIEVHDKFDLMHETLFLTVNLIDRFLEKQSVVRKKLQLVGLVAMLLACKYEEVSVPVVGDLILISDRAYTRKEVLEMEKVMVNALKFNISVPTAYVFMRRFLKAAQADRKLELLAFFLIELSLVEYAMLKFSPSQLAAAAVYTAQCTMYGVKQWSKTCEWHTNYSEDQLLECSSLMVDFHKKAGTGKLTGAHRKYCTSKFSYTAKCEPASFLLENEL

SEQ ID NO: 20862 - protein, 395 aa, Mycobacterium smegmatis str. MC2 155
MSITADVVIVGGGLEGTAAAWALSQRGVTDVVVAERNTVGSGMTGKSSGIVRCHYGVSSLAAMAAVGLDVFEKAEEIFGDDIGFRQTGYVVGVGEQNVDALRKSLAAQRQVGVQTEEIDASEVAKLWPWADLEPFAAFGWEARGGYGDAYQTAQAFAIAARAAGVRIRQGATVTELLMGADRVTGVRLADGTEVSAGTVVVATGAWTRPFLAPYGVDIPIRVIREQIVTISPGLDIGAVPVFSDLVSLQYVRPELGGEILFGNSDLGHGESADPDNYLNRATEEFVDITVEKVGTRFPGLTDASITGSYAGCYDVTPDWNPVISETDVDGLIVAAGFSGHGFKIAPAVGRLVADLVVDGHSSDPRIPETDFRLSRFAEDNLLKSPYPYVGAGEMR

SEQ ID NO: 20863 - protein, 359 aa, Capsicum chinense
  misc_feature (288)..(288): Xaa can be any naturally occurring amino acid
  unsure (1)..(359): unsure at all Xaa locations
NMSYRVPFAALLEATSNFDESLVIGIGGFGKVYKGVLYDGTKLAVKRGNPKSQQGLAEFRTEIEMLSQFRHRHLVSLMGYCDEKNEMILVYEYMENGTLKSHLYGSDLPSMSWKQRLEICIGSARGLHYLHTGYAKAVIHRDVKSANILLDESFMAKVADFGLSKTGPELDQTHVSTAVKGSFGYLDPEYFRRQQLTEKSDVYSFGVVLFEVLCARPVIDPSLPREMVNLAEWAMKWQKKGQLEQIIDPTLVGKIRPDSLRKFGETAEKCLADFGVDRPSMGDVLWNXEYALQLQEAVIQDDPEENSTLLIGELSPQVNDFSQVDAGASAALIGTPNLDDLSGVSMSRVFSQLVKSEGR

SEQ ID NO: 20864 - protein, 314 aa, Capsicum chinense
MGSKYSKATNSINDALNSSYLVPFESYRFPLVDLEEATNNFDGKGGFGKVYRGVLRDGTKVALKRHNRDSGQSIEPFRTEFEILSRRSHPHLVSLIGFCDERNEMILIYDYMENGNLKSHLYGSDLPTMSWEQRLEICIGAARGLHYLHTSAAIHRDVKSTNILLDENFVAKITDFGISKKGTDLDHTHVSTHVKGAFGYLDPEYFIKGRLTEKSDVYSFGVVLFEVLCARSAIVQSLPREMVNLAAWAVESHNNGQLEQIIDPNLVAKIRPESLGKFGETAVKCLAPSSEDRPSMGDVLWKLEYALRLQESVI

SEQ ID NO: 20865 - protein, 159 aa, Glycine max
MSGNSSNNNNISKRISVLSSHFARSSPIMASEKQAALAVTPSDADAPTIFDKIINKEIPSTVVYEDDKVLAFRDITPQAPTHILIIPKFKDGLSGLSKAEERHFEILGRLLYTAKLVAKQEGLDDGFRIVINDGPKGCQSVYHIHVHLLGGRQMNWPPG

SEQ ID NO: 20866 - protein, 1050 aa, Legionella pneumophila str. Lens
MLEKQSIHLPEGLRAAINKAYRMDELSLITELSEQAALDPQQMMAIKTSATKLVQSVRSERKKSTGIDSFLTEYALSSDEGIALMCLAEALLRVPDNATIDNLIKDKLAGGDWGAHRGQSESFFVNATTWALMLTGKVLTPEKAENTLTKALLKLVNRSSEAVVRKAVDKAMRIMSKQFVMGRTINEALARAKKKEDRGYRYSYDMLGEAALTSADAARYFEAYKEAIISIGEKADKHSDVYRRPGISIKLSALHPRYSEFQYERVIEELPPKLLALSRLAKDYDIALTIDAEESERLDLSLDVIEKVFTDESLQGWNGFGLAVQSYQKRAFYVLDWVAALARSKQRRIMVRLIKGAYWDSEIKKTQMQGFSEYPVFTRKVFTDVSFQACAKKILTMTDAIYPQFATHNAYSVAMILNLVGGYRDFEFQCLHGMGNELYEQIVPANCYGIPCRIYAPVGSHEDLLPYLVRRLLENGANSSFVNRIVDDKAPISELVEDPVTKSKSLLDKINKNIPLPEDIFLPVRKNSKGFDFTNRLERALLQQELEKIESKEWQASPMIAGRKLSRDLLQTVMSPQQPAYAIGSVQQATLDDVEVALNQAKLAFELWSKKPVEERASCLNRFADLLQANMAELMVLTCREAGKTWSDGIAEVREAIDFCRYYAKKAQELMSSPQHFNGYTGELNELSLHPRGTILCISPWNFPLAIFTGQVVAGLVTGNCVIAKPAEQTPLIAAYAVKLMHQAGIPEGVIQLIPGAGETIGAALVADKRIKAVLFTGSTDTANLINRTLATRGGEIIPLIAETGGQNAMIVDSSALLEQVVVDAVTSAFGSAGQRCSALRVLYVQEEVYPRTVELLKGAMAELVVGDPQWLSTDVGPVIDKEALSILKNHVENMRKHHEILYQCTVDDEALSGYFMPPTAIAIDSISALEKEVFGPILHVIQFKRKDLDKVINQINQTGYGLTLGIHSRINETVDYIRQRVHAGNCYVNRNMIGAVVGLQPFGGEGLSGTGPKAGGPNYLIRLCHERTYTVDTTAAGGNASLMSIPEEG

SEQ ID NO: 20867 - protein, 483 aa, Psychrobacter arcticus 273-4
MKDSYDLVVIGGGPGGYEAAIRAGQLGMSVACIEKRVYKGEPALGGTCLNVGCIPSKALLDSSHRYEATKHDLAEHGISTGDVAIDIEQMIARKEGIVKQLTGGIAALLKGNGVDWLQGWGTLVDGKGNDKKVKFTALADDSETTITAKNVILAAGSVPIDIPVAKTDGDRIVDSTGALDFTAVPKRLGVIGAGVIGLELGSVWRRLGAEVVVYEALPSFLAAADKDIAKEAGKMLKKQGLDIRVDTKVTNAEVKGDQVIVTSEAKGESSEESFDKLIVCVGRRAYSEKLLGEDSGIQLTERGLIDVNDQCKTNLDGVYAIGDLVRGPMLAHKAMEEGMMAVERIHGDKAQVNYDTIINVIYTHPEIAWVGLTEQEAEAAGYEVKTGSFNLAANGRALAQSEAQGSIKVVADAKTDRLLGMHAISAGAGDIVHQGMIAMEFVSSIEDLQLMTFAHPTISEAVHEAALSADGRAIHAIQRKKRK

SEQ ID NO: 20868 - protein, 143 aa, Glycine max
PPKRGPQLKFPPNFPPTIPARGKGGKGLGKGAVKRPRKVLRPPIQGLRTPPIRRLPRRGRVKRTSGLISEEPRGVLKIFLDPLIPDPVPPPEHARRKPVPPMDVVYALKSQGSPLYAFWRLKNRIFRFNACVAASPIGSFEFA

SEQ ID NO: 20869 - protein, 369 aa, Candida albicans SC5314
MSAPLDASKLEITKTTKPSEPLPKEELVFGKSFTDHILEVEWTAEKGWGVPTIKPYHNFSLDPATCVLHYSFELFEGLKAYRDSNGKIRTFRPDKNMERMNRSAKRAALPTFDGEEFIKLVDQFLLIEERFVPTGYGYSLYLRPTLIGTSIGLGVSAPTKALLYLIASPVGPYFSGGFKPVSLEATDYAVRAWPKGVGSYKLGANYVSCIEPQMEAAKRGHSQNLWLFGEEGYITEVGAMNVFFAFKNADGTKELVTPPLDGMILPGVTRDSTLELAKSKLPSDWTVNERKLTIHEVKERAAKGELVEAFGTGTAAIVSPIDNIEFQGEQIKVPVSAGSSGEIALKINDWIKAIQYGDESFKNWSRVAQ

SEQ ID NO: 20870 - protein, 377 aa, Eucommia ulmoides
MAESDDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDMKEKLAYITLDYEQELETSKTSSTVEKSYELPDGQVITIGAERFRCPEVLFQPSMIGMEAAGIHETTYNSIMKCDVDIRKDLYGNIVLSGGSTMFPGIAERMTKEITALAPSSMKIKVVAPPERKYSVWIGGSILASLSTFQQMWISKGEYDESGPSIVHRKCF

SEQ ID NO: 20871 - protein, 387 aa, Oryza sativa (japonica cultivar-group)
MASSSSSSSLCDNHLLQDDLIPWPSMPFAPAPNTFGLNHQWSQPPMLSSSTDQLSSYELESLQSVESQLAAAAPPTLSPHLQAHQLSTVLMMQELGFQWSSCAAPADQHSIASSTNNNSNVMMNEEELRPRPDQSLISNPRSCSATTLLPPPHLHLDGAVLPSINVSRLQKLAAGDEPLQICCKRQAAAAAVVGHSSIRDEHVPCPYAGPPAHLIQGPSNTLQMKRNTNAAAQGRGGRHGSSTEHRSSTALPPSSKKPRLESHSSSMLPSFKVRKEKLGDRIAALQQLVSPFGKTDTASVLMEAIGYIKFLQDQVETLSGPYLRSSKNSKKLACRAAQQQRKGTSNGGDAAAKLDLRSRGLCLVPLSCTSYVTNENGVWPPPNFRGN

SEQ ID NO: 20872 - protein, 347 aa, Arabidopsis thaliana
MWSYVWLPLVALSLFKDSIIMAKAATILLPSQTGFDISRSPVCSAPDPNLNYRPVIGILSHPGDGASGRLSNATDASSIAASYVKLAESGGARVIPLIFNEPEEILFQKLELVNGVILTGGWAKEGLYFEIVKKIFNKVLERNDAGEHFPIYAICLGFELLTMIISQNRDIFEKMDARNSASSLQFVENVNIQGTIFQRFPPELLKKLGTDCLVMQNHRFGISPQSFEGNIALSNFFKIVTTCVDDNGKVYVSTVQSTKYPVTGFQWHPEKNAFEWGSSKIPHSEDAIQVTQHAANHLVSEARKSLNRPESKKVLSNLIYNYKPTYCGYAGIGYDEVYIFTQQRSLL

SEQ ID NO: 20873 - protein, 463 aa, Arabidopsis thaliana
MGNHQAVKKLWVINNFSFLDSDRVYSDIFVVGGCKWCLLALPEGNNNYIYDYFSLYLCVPDSEYLPSGWRRRAKVSFTMVNQVTGELSQQQEGVYWFDEKNTTQGFGSMFRLLVFQSSYKGFLVNGEVDIVAEVDVVEVIGKLDVSEESESIDSNGFDVLASQVESVNSLFGKYPCFASKLCPKTPRLKKNVVQSLNEILCKSTKELSNGDLAEAYSALRFVTKAGFKLDWLEKKLKETGDNLECERWQKVSQENLDLIKDKVMLESKMQHIEEKLAFEEEESKRLKIKLAATQECFCALQNVDPDVVTIKRLHAELVAENEKSKRGYMAPVRGCNDRDIKFSPKFVVYALRVSLFETVSGKKGIGLYDSSKASHWLGEFSNNNLVLDDQAGIRVWGTNFMGVVGSSLVKEFLDDGNFVIKNTWDNDTAGFLWQSFDFLTDTLLPGMALGWKFHRGINRYLVA

SEQ ID NO: 20874 - protein, 1049 aa, Cryptococcus neoformans var. neoformans JEC21
MDYGHPEGYQPPFQPVYQFVPQGYKDSDALDGIIIDDHWIDPNIDDEDDVWSEESWIPYSSHAVPNLRDSAVSPTSQSGNQQVVIAPLTNWYPTPSDLRQHYCDLHQSECLHQQMPVETNSTERSNTTLEDDLTQGTDLKHIDWSGVGLAFTLLLIILFAIHASWSGDDEEEGENKGKDSPGSRSHSKDKNESSKKKGETKKEQKESRSDKDNEKKEAGRKNGDEKDNDKDKKKSSSRISSKNDAAEGNDDKGSLKGKGEGEKKKDGSSSKSKKPNDDKKSSEKSDKVDGDKKSDPKKDDKAEGLEKKDVKKKSSSSDDKKEDKRGSGGEKKEERNKKEERNKEDENKASRGEKKEDKNSNSREKKDDKKAAGDKKEDKKATGEKKDEKKAAGASRNKDDKKSATGEKRDEKRAVGAEKKDDKKVAAADKDDKKAAGGNRKDDKEATGAEKKAAGAEKKDDKKAGDTKAERKVEKKEVEGERKKDDKKVGEKKHDEKVAEGDKKNDKSQSGRKKHDEKVGEKKHDEKVAGGDKKDDESQSGRKKPSSGDKEGGDKRLDHKKTDKKNNEEKDDKKAGEKKSGSKEGDKKPGDKKGDKKAENRNEEAGKKPANEKEAVNKPGEKKEMDKNPKDNKEMDEKLAGDKKNDGKSEKKGKGSVLEERGGEGKGDKKESKKSGNDKRKHEKKYEEDKEREGTKEEGKKDKSEQKDDPKKDGKGSLTSGSSKTKNEKDDERSWFSSHILIGLLLLLPLLAMTGRSRMPIIYDPAANRPSILTGSGLGDILASPVMAASKGLKRATTSPRASSSGARWVVNEQPEPKAHIHINNVNSQGNGNPINIREPSSEPAVEITVEESSLAAEQLLNRPHSPPVLEEERIWEPINFRFTGPANPDRLWNMIFACFIVALPLIVDQVMDYPERRYSQPDYLPPASQLILLSASFLICAVIGDWHFGWSSTIAPFAEVSISGAQRGLTPLIVGVVETGESLIWSLEDVMFGDGRVLLGMGLAALGVVLFSQRQPSLDVPKTDYASSTVQAMYFLGALLIGMFVWNA

SEQ ID NO: 20875 - protein, 555 aa, Psychrobacter arcticus 273-4
MNDTKDNKVYSSARHSKYWQQLQTLAESPWSLAALFAQDNTRTQHFSMQAGALYMDYSKQCIDDAVLENLLNLANSCELAARIQSLLQGAMVNTSEERAALHTALRLPATASLQLDTQDVVADVHQSLLQVERLSERVRSGTWRGFSGQAITDVVNIGVGGSDLGPLMATTALDEWADTCVEVHFVSNMDGTQLDNLLKHLNPETTLFIISSKSFGTVDTLSNAKTALSWLLATAKLRAGTEDSVRRRHFIGISANGQKMSAWGIHPEHQLQLWEWVGGRFSLWSAIGLAIAIRIGMSGFKELLAGAHSMDDHFAQADFAKNVPVLLGLIAVWNSTFLQVNAHTVLPYDGRLSYLPSYLTQLEMESNGKSVTQHGDRIDYDTCPILWGEIGSNAQHAFYQLLHQGTQQVSCDFIACVRRYSDEAKNTPLQQQHELSLANCLAQSRVLAFGNAAIAESDGQVACDADKYKYYRGNQPSTTLLLDELTPHSLGALIALYEHKVYVMASIWDINPFDQWGVEMGKQMAESVHDAMQQERGAQFDTSTNQLLKHIKELS

SEQ ID NO: 20876 - protein, 308 aa, Brucella suis 1330
MILCCGEALIDMLPRETTGGETAFQPFAGGSVFNTAIALGRLGVPTGFFSGISSDFFGDVLRDTLARSNVDYSFAAISNRPTTLAFVRLVDGQARYAFYDENTAGRMLSRNDMPYVDETISAMLFGCISLISEPCGSVYETLLAREAPNRVMFLDPNIRANLITVRETHLTRMKRMIALADIVKLSDEDLDWFGEKGSHDEIAAEWLKLGPKLVVITKGAHGAVVYTNHATVPVPGVKVDVVDTVGAGDTVNAGILASLHSQGLLTKDALANLSEDQIHSAVALGVRAAAVTVSRAGANPPWAHEMRD

SEQ ID NO: 20877 - protein, 459 aa, Triticum aestivum
MAGKKRKSSEKQPKGSRLPLGADADAVADAGKRRRSGAAKRHQAEEEESVPSSISAKILREALKQQQEEGLADSRHAAAAAAPAVSAAPSTSFPVPAADGGEDDDEDVDEFDGFDALSEYDGGVPEIDEEDEKALAAFMSKDTSSKRSLGDIILQKIREKDATVSTEGRPAVKLDSRIIELYKEVGQLLSRYTSGKIPKAFKRIPSLECWADVLQLTEPQNWSPNAVYQATRLFSSNMNAKNAVRFYEAILLPRLRHDIKQNKRLHFALYQSMKKSLYKPAAFFKGILLPLCQEGNCTLREAVIIGSIIQKVTIPPLHASAALMKLADLEYCGTTSYFIKLFLDKKYALPYRVLDAVFAHFMRFLDDERSMPVIWHQSLLAFVERYKNELEKKDKEQLSRLLDNQKHYLVTPEIRRELRSSANRGEKPTDMSICSPVSVITKPIEEDRWNVPEVPMEED

SEQ ID NO: 20878 - protein, 1277 aa, Arabidopsis thaliana
MLKTLIIKAKWIGSGMLATLLPCFPLEWDETVSSASLRKLVIYCQGGCADLLNSKSISFDTPSLLYLVYSVFVAEDYPKVNLTNLVEAKFNLMLLDEQIEQIREPNDEDDVFLRLGNVLKLFAGIRNVQKLYLSANILEVLSLCCESFPVFNNLKILRIRSAEDRGWQAMPVLLRNCPHLETLVLEGLIHYVTGECGNACDCKSREGIVSSLLSCPVKKVQIKGFKGTMRESSMIWHFMTSFPCLKLCVVQRMDLFSSLPNELLYHILSFLSTKEAALTSVLSKRWRNLFAFVPYLEFDDSVFLHPEERKREKEGILQSFMDFVDRVLDLHGDSLIKTFSLKCKTGVDSDHVDRWICNVLARGVSDLDLFIDFRDLYSLPHEVGVSRTLVVLRVGSESDLYWWQKFLCLPMLKTLVLDSCWLCIGQFQILLLACPALEELDMTNTRWKDSNVTVSSSILKELTIDLHGCCSVVNLKSLSFDAPSLVYFYYCDSLAEDYPQVNLKNLVEAQINLLLTQAQIEQVRALNNEMLVADDVFPGLGNAWKLITGLRNVQQLYLSPDTLEVLSRCCEGMPVFNNLKVLSIWSDMNRGWQAMPVLLRNCPHLETLIIEGLLHYATDKCGDVCDCISRDYKDHSLTSCPVKKLQIYEFRGTIRELEMIKHFLKIFPCLKEMDIYAHENSHTLFKDPTIFERVGKVMNFYNMLSSCSVQLLVRGPLVLRLALDTVASESNTFILAISNSSSAGQAGKSISNLATQNSTESRTRVFSIEFPLALFRMKKDRVIEFKIRNKINEIAPPLGEKRSQSSLLCASQKHFCTSESFLSLGVCIKEAAFASVLSKRWQNLFTIVQKLEFDDSVKNQGSLMDFVNGVLALPVTTRISKFSLRFDSFLKRKLETGLVIGPHVVNRCLCNVLKRGVLDLKLEIYGEDGYLLPSEVFTCKTIVDLKLTSCIFAESYVIDVIPENAFLPGLESLFLKSIWFSDLRGCAFQTLLSACPVLKTLTIYDVQWEKWKWSRTVSSATLERLIIQRTEFTYFNGSDFKSITFDTPSLTYLKYIDFVPEEYPVVNLDSIVEAKLHLILTGNQDYPVRYLGREDDPITSNPTNLIKGLRNVEILHLSTATAQMLCFFPRETLPEFVNLHHLTIGPTYYECFNWRLLPILLKKTPNLKTLMIKGPLHLYYRDFNDDEEEEEPEYYCECSSGCNCLLSCHMEVLEISHYRGTTKELEKLKHFLGKLSCLEHVKLGVWASSDKEKLSITTDLLMLPRASVNCKIQINFS

SEQ ID NO: 20879 - protein, 538 aa, Viburnum furcatum
MATITTLASSVPLFRPYSFPGGSSRKPKKDNLSIKPPATSSLKVNAKLASADDTSSNFNKDNWLASADELSRSFPPGFLFGGGSASYQYEGAVKEGGRTPSIWDTFAHEFPDKIADGSNGDVAVDFYHRYKDDVKLMKKIGVNGFRFSISWTRILPSGKLCGGVNKEGVAFYNSLINELLANGIEPFVTIFHWDLPQGLENEYDGFLSGQIVNDYRDYAEVCFQEFGDRVKFWTTLNEPWTFCYNGYVNGSFAPGRCSTCTAGNSGTEPYLVAHNLLLSHAAVAQLYKNKYQASQKGQIGIVLVCFWMVPYSDCPYDCEAAQRALDFMLGWFLHPLTYGDYPESMRHLVGERLPQFTEMQAMMMKGSIDFLGLNYYTSIYAANNESPNPHDISYTTDSRVNLFQKRDGILIGPATGTPAFCFCPEGIRDLLVYTKEKYNNPIIYITECGLAEANINTVDQGVKDVERVEFYYEHLKFLRSAIKKGVNVKGFFTWSLLDDWEWNSGFNVRFGIVYIDHEDGLKRYLKYSALWFKKLFGK

SEQ ID NO: 20880 - protein, 301 aa, Arabidopsis thaliana
MKLNEEYVKFLGEGAYSFVDLFKYTKSDGSSFHAAVKSSDDENSLLKEFHILSELKGCPRIIQCFGNDLEEGFDDKGNRVYKLLLEYASEGSLSDFMNNCVDRKLPDLMIRDFTRMILQGLVSIHSHGYVHCDLKPENVLVFPCGDSYEVKISDFGLSLQVGEVPDHWKIEYPFVGTLNYMPPESLHDGVANKTLDLWSLGCLVLEMYVCKKPWIGFIPEDFVYILSNGNPPEIPESLPCDARAFIQKCFSRNPKERGTASELLSHRFLRQEKSKLKMISPFNLLKFKKFLNKLLRLKNFL

SEQ ID NO: 20881 - protein, 198 aa, Lolium multiflorum
PFKVKSGSCGTVVRNAELKVVDPDTGASLGRNQPGEICVRGKQIMLGYLNDPESTKNTIDKDGWLHTGDIGLVDDDDEIFIVDRLKEIIKYKGFQVAPAELEALLLTNLEVKDAAVVGVKDDLCGEVPVAFIKRIEGSEITENEIKQFVSKEVVFYKRINKVYFTDSIPKNPSGKILRKDLRARLAAGIPTEVAAPRS

SEQ ID NO: 20882 - protein, 501 aa, Nostoc punctiforme PCC 73102
MKTHLPQIHNPNGVILAMHLNELETTENLKEVEEAWLTLEKSILYYQGRPVGTVAAYDASVEALNYDQCFVRDFVSSALIFLIKGRTDIVRNFLEETLKLQPKEKALDAYKPGRGLIPASFKVVSENGQEYLEADFGEHAIARVTPVDSCLWWIILLRAYVVATEDFSLAYQPEFQNGIRLIMEICLANRFDMYPTLLVPDGACMIDRRLGIYGHPLELQVLFYTALRASRELLVCQGNSDIVAAIDNRLPLLCAHIRQHYWIDINRLNEIYRFKSEEYGKGAVNLFNIYVDSVPYYELDKWLPKKGGYLAGNVGPSQLDTRFFSLGNLMAIISDLATEEQAQAIMTLIEDRWDDLVGDMPMKICFPALEHEEYRIVTGCDPKNIPWSYHNAGSWPVLMWMLAAAAVKTNKISLAQKAIQTAQGRLSTDQWPEYYDGKKGRLIGKQARKYQTWTITGFLLAKELMANPTYLPLISFGKLPAEQVSRACEFEIASVDPYMPR

SEQ ID NO: 20883 - protein, 352 aa, Xanthomonas campestris pv. campestris str. ATCC 33913
MLPVHRVLRHLGLASARRTGGGARMSAAKNQVVCFGEALIDMLALPPAGPDEARTFAQYAGGAPANVAVAVARLGGAAHFVGMLGRDMFGDFLLESLQQAGVVTDGIVRTDEAKTALAFVALDAAGERSFSFYRPPAADLLFRAEHFAADGFAQAAVLHVCSNSMTEPAIARCTLDGMRRARADGAIVSLDLNLRPMLWPQDVDPAPLLWEALALADVVKLSREELDYLAGTLDSDASAVTQKLWQGHARWLLVTDGGGPVHWQTRVDSGQVPAFHVQVRDSTAAGDAFVGGLLFQLAARASTLEQLCADPAAIAEVIRFAAAVGALAVTRKGAFAAMPSVDEVHSLIQEQS

SEQ ID NO: 20884 - protein, 148 aa, Pisum sativum
MASKRILKELKDLQKDPPTSCSAGPVAEDMFHWQATIVGPADSPYAGGVFLVTIHFPPDYPFKPPKVAFRTKVFHPNINSNGSICLDILKEQWSPALTISKVLLSICSLLTDPNPDDPLVPEIAHMYKTDRTKYEATARSWTQKYAMG

SEQ ID NO: 20885 - protein, 517 aa, Sorghum bicolor
MDVPLPLLLGSLAVSVVVWCLLLRRGGDGKGKGKRPMPPGPRGWPVLGNLPQLGSHPHHTMCALAKKYGPLFRLRFGSAEVVVAASARVAAQFLRTHDANFSNRPPNSGAEHVAYNYQDMAFAPYGSRWRALRKLCALHLFSAKALDDLRSIREGEVALLVRELSRFQHQHAGVPLFQVANVCATNTLARATVGRRVFAVDGGEEAREFKDMVVELMQLAGVFNVGDFVPALARLDLQGVVGKMKRLHRRYDDMMNGIIRERKAAEEGKDLLSVLLARTREQQSIADGEDSRITETEIKALLLNLFTAGTDTTSSTVEWALAELIRHPDVLKKAQEELDAVVGRNRLVSELDLPRLTYLTAVIKETFRMHPSTPLSLPRIAAEECEVDGFRIPAGTTLLVNVWAIARDPEAWPEPLQFRPDRFLPGGSHAGVDVKGSDFELIPFGAGRRICAGLSWGLRMVTLMTATLVHALDWDLADGMTADKLDMEEAYGLTLQRAVPLKVRPAPRLLPSAYAAE

SEQ ID NO: 20886 - protein, 528 aa, Zea mays
MATLPLLLHLLWEASPWARAGAATAAVVLVWLAAWTLEWAWWTPRRLDRALRAQGLKGTRYRLLTGDVRENARLNREARTKPLPLGSHDIIPRVLPMFHNAVKENGTNSFTWFGPIPRVIIPDPELMREVLSNKFGHFGKPLFSRVGKLLANGLANHEGEKWAKHRRILNPAFHHEKIKRMLPVFATCCADMINRWENSMSSKEPSEMDVWPEFQNLTGDVISRTAFGSNYQEGRNIFQLQGEQAERLIQSFQTIFIPGYWLLPTKNNRRMKEIDREIRKILHGIIRKRERAFKNGEGTNDDLLGLLFESNMRESNGKAKLGMTTEDIIEECKLFYFAGMETTSVLLTWTLILLSMHPEWQEQAREEVLNHFGMGTPDFDNLNRLKIVTMILYEVLRLYPPVVFLSRRTYKEMELGGIKYPSGVSLLLPIIFIHHDPNIWGKDASEFNPQRFEDGISNATKHQAAFFPFGWGPRICIGQNFALLEAKMALSTILQRFSFELSSSYTHAPYTVITLHPQHGAQIRLKKL

SEQ ID NO: 20887 - protein, 363 aa, Oryza sativa
  misc_feature (332)..(332): Xaa can be any naturally occurring amino acid
  unsure (1)..(363): unsure at all Xaa locations
MGIYLSTPKTDKFSEDGENDKLKLGLSSMQGWRANKEDAHSALLNLDNETSFLGVFDGHGGRVVAKFCAKYLRSQVLRSEAYSAGDLGTAVHRAFFRMDEMMRGQRGWRELSALGDKINKIGGMIEGLIWSPRGSDSNNGQDDWSFEEGPHSDFAGPTCGCTACVALIRNNQLVVANAGDSRCVISRAGQAYNLSRDHKPELEAERDRIVKAGGFIHMGRINGSLNLTRAIGDMEFKQNKFLPPEKQIVTANPDINVVELCDDDDFLVLACDGIWDCMSSQQLVDFIHEHIQKESSLSAVCERVLDRCLAPSTIGGEGCDNMTMVLVQFKKXPITQNKKADVGEQSVKGVEEAEINAAEENGS

SEQ ID NO: 20888 - protein, 302 aa, Aspergillus flavus
  misc_feature (1)..(1): Xaa can be any naturally occurring amino acid
  unsure (1)..(302): unsure at all Xaa locations
XSAVKAARYGKDNVRVYKVHKDEKTGVQTVYEMTVCVLLEGEIETSYTKADNSVIVATDSIKNTIYITAKQNPVTPPELFGSILGTHFIEKYNHIHAAHVNIVCHRWTRMDIDGKPHPHSFIRDSEEKRNVQVDVVEGKGIDIKSSLSGLTVLKSTNSQFWGFLRDEYTTLKETWDRILSTDVDATWQWKNFSGLQEVRSHVPKFDATWATAREVTLKTFAEDNSASVQATMYKMAEQILARQQLIETVEYSLPNKHYFEIDLSWHKGLQNTGKNAEVFAPQSDPNGLIKCTVGRSSLKSKL

SEQ ID NO: 20889 - protein, 534 aa, Oryza sativa (japonica cultivar-group)
MASQSKKRRIAGGGDGEDRISELPDDLLGHILSFLPNNLAARTAVLSRRWRYIFGYVHTISFEEEEGEREDDWITMYFQAEEKKSMSWKLLDRMNAALLCRRRCAGRHVPLRSFHFACDSYHVWDRVIVDAWVTYVVCHSSQELHLDLRFWIGPICAGGERDRLSTIVDSEPPVFPGRHYELPRSLYSCVALQTLCLSYCDLNLLESIDLSLLKTMRLTGIHGSRSRIQRLISSCPRLADLTLEALRQLKTLSLLDKRLRSFALRCCHNVDNVAIDASELTTIAYRGAVSDDPSYTLSMHGSLAITSCTVDFCSEELITSEEEFDSSTHLHLKFDRLGSCIDSDLFPAAGFRTFTNLRRLELTGHVPDCGVAIAMRRILEMTPNLESLTLFLKPEKCNPTNCDSESESDGSSDSGYISHSDDDDDDTDGDDYGSNIGYNSHSEEDGDDSEEDSSPGIASFSAIRCLRRRVKEINLVHYEGDDGQATVARLLLRNALVLQCVCVVLTRGRIGMQMRKKRKIKRWMMSRSAKAVFL

SEQ ID NO: 20890 - protein, 441 aa, Medicago truncatula
MGFLRRLFGAKKPIPPSDGSGKKSDKDNKRRWSFGKQSSKTKSLPQPPPSAFNQFDSSTPLERNKHAIAVAAATAAVAEAALAAAHAAAEVVRLTSSGVAGSSNKTRGQLRLPEETAAVKIQSAFRGYLARRALRALKALVKLQALVRGHIVRKKTADMLRRMQTLVRLQTKARASRAHLSSDNLHSFKSSLSHYPVPEEYEQPHHVYSTKFGGSSILKRCSSNSNFRKIESEKPRFGSNWLDHWMQENSISQTKNASSKNRHPDEHKSDKILEVDTWKPQLNKNENNVNSMSNESPSKHSTKAQNQSLSVKFHKAKEEVAASRTADNSPQTFSASSRNGSGVRRNTPFTPTRSECSWSFLGGYSGYPNYMANTESSRAKVRSQSAPRQRHEFEEYSSTRRPFQGLWDVGSTNSDNDSDSRSNKVSPALSRFNRIGSSNLR

SEQ ID NO: 20891 - protein, 342 aa, Oryza sativa (japonica cultivar-group)
MAAEAEQQHQLLSTAVHDTMPGKYVRPESQRPRLDLVVSDARIPVVDLASPDRAAVVSAVGDACRTHGFFQVVNHGIDAALIASVMEVGREFFRLPAEEKAKLYSDDPAKKIRLSTSFNVRKETVHNWRDYLRLHCYPLHQFVPDWPSNPPSFKEIIGTYCTEVRELGFRLYEAISESLGLEGGYMRETLGEQEQHMAVNYYPQCPEPELTYGLPAHTDPNALTILLMDDQVAGLQVLNDGKWIAVNPQPGALVINIGDQLQALSNGKYRSVWHRAVVNSDRERMSVASFLCPCNSVELGPAKKLITDDSPAVYRNYTYDEYYKKFWSRNLDQEHCLELFRT

SEQ ID NO: 20892 - protein, 586 aa, Medicago sativa
MCGILAVLGCSDDSQAKRVRILELSRRLKHRGPDWSGLHQHGDNYLAHQRLAIVDPASGDQPLFNEDKSIIVTVNGEIYNHEDLRKQLPNHKFRTQCDCDVIAHLYEEYGENFVDMLDGIFSFVLLDTRDNSFIVARDAIGVTSLYIGWGLDGSVWIASELKGLNDECEHFEVFPPGHLYSSKDREFRRWYNPPWFNEAVIPTTPYDPLVLRNAFEKAVIKRLMTDVPFGVLLSGGLDSSLVAAVTARYLAGTKAAKQWGAKLHSFCVGLKGAPDLKAGREVADFLGTVHHEFQFTIQDGIDAIEDVIYHTETYDVTTIRAATPMFLMSRKIKSSGVKWVISGEGSDEIFGGYLYFHKAPNKEEFHQETCRKIKALHRYDCLRANKSTYAWGLEARVPFLDKEFIKVAMDIDPEYKMIKHEEGRIEKWILRKAFDDEENPYLPKHILYRQKEQFSDGVGYGWIDGIKDHAAKHVTDRMMLNASHIFPFNTPLTKEAYYYRMIFERFFPQNSARLTVPGGASVACSTEKAIEWDASWSSNLDPSGRAAFGVHNSAYENQVNSVAKTVEPEKIIPKMEISNLGVAIQS

SEQ ID NO: 20893 - protein, 1517 aa, Aspergillus nidulans FGSC A4
MADNAHLTQLPTVTGEEPSDSTMVSGTSSDTDASSEGQWGEQGTEPVSRRGAMEDYEEMRRELTRLSLQRTKSTTKDAHRLRSRASQHQDPEKALQEEDLEKEGESEYGGFDLTDFLMGGHLERRTTAGDPAKKVGVVFKNLTVKGVQTGASFVRTLPDAVIGTFGPDLYNIICRFVPQLRFGKKPPVRDLIHDFTGTVREGEMMLVLGRPGAGCSTFLKAIANDRGAFAAVEGDVSYGGLSAAEQDRHYRGEVNYNQEDDQHFPNLTVWQTLKFSLINKTKKNDKESIPIIIDALLKMFGITHTKNTLVGNEYVRGVSGGERKRVSIAETLATKSSVVCWDNSTRGLDASTALDYAKSLRIMTDVSKRTTLVTLYQAGESIYELMDKVLVIDSGRMLFQGPAHYARQYFVNLGFYCPEQSTTADFLTSLCDPNARQFQEGREASTPKTPEELEAAFRQSEYYKLIQNEVQAYEDQLHDTNCADTQRFQKTVQSSKSKTVSKKSPYTVSIARQVAACVRREFWLLWGDKTSLYTKYFIIISNAFIVSSLFYGEAMNTNGAFPRGGALFFSILFLGWLQLTELMPAVSGRAIVARHKDYAFYRPSAVAIARVVVDFPAILCMCIPFTIVVYFLAGLDATASKFWIYFLFVYTTTFCITSMYRMFAALSPTIDDAVRFSGIALNVLVLFVGYVIPKQGLIDGSIWFGWLFYVNPLSYSYESVLSNEFSDRVMACDPSMLVPQGPGVSPEYQGCALTGSKLGSTDVAGSDYLSTTFQFTRHHLWRNFGVVIAFTVLYLLVTVIATETLSFVGGGDGALVFKRSSNAKQIKAATEKPNDEENGQGDAVTQSGGNNEAAFNRISSSERVFTWDNVEFTVPYGNGTRKLLNGVSGYAKPGLMIALMGASGAGKTTLLNTLAQRQTTGVISGDMFVDGRPLSTDFQRGTGFCEQMDLHDATATIREALEFSALLRQDRNIPREEKIAYVKQIIDLLELEEIQDAIIGSLNVEQKKRVTIGVELAAKPSLLLFLDEPTSGLDSQAAFSIVRFLKKLSQAGQAIVCTIHQPSSMLIQQFDMILALNPGGNTFYFGPVGKDGKDVIKYFADRGAVCPPAKNVAEFILETAAKPIKRDGKTVDWNEEWRTSEQSRQVKEEIERIYKERRDATANEDQSAQYEFAAPTWLQCYLLTRRVFTQYWRDPSYYYGKLFTSVIIGIFNGFTFWMLDNSIASMQNRMFSLFLIILLPPIFLNSTLPKFYMNRALWEAREYPSRIYGWVAFCTANVVAEIPAAIISATVYFLLWYFAVGFPVTASASGYVFLMTMLFFLFMASWGQWICAFAPSFTVISNVLPFFFVMTGLFNGVVRPYDDYPVFWKYWMYYVNPVTWWIRGAISAIFPSVEITCAATEATHFNPPPGSTCSDYASNFVNNIAGAGYLANPDATSDCQYCPYENGTQYMSTLNVRPDDKWHSFGIFLAFVIINWVLVYFFIYTVRVRKWSFGMGSLFGGIGAVLSGIKNVFAKKN

SEQ ID NO: 20894 - protein, 102 aa, Chlamydia muridarum Nigg
MVQIVSQDNFADSIASGLVLVDFFAEWCGPCKMLTPVLEALAAELPYVTILKLDIDASPRPAEQFGVSSIPTLILFKDGKEVERSVGLKDKDSLVKLISKHQ

SEQ ID NO: 20895 - protein, 456 aa, Chlamydia muridarum Nigg
MNLWTKIFQPPRHIKEISDPELVKKQYKYWRVRIFYSMFFGYVFFYFTRKSFTFAMPTLIADLGFDKAQLGIIGSTLYITYGISKFVSGVMSDQSNPRYFMATGLIITGLSNIFFGLSSTVPLFVLFWGINGWFQGWGWPPCARLLTHWYSKSERGTWWSVWSTSHNIGGALIPVLTGIAIDYAGWRGAMFIPGIICIIMGFILIDRLRDTPQSLGLPAIEKFKKEDLSHPHEETTADILEEEAERELSTKEILFTYVLSNKWLWFLSFASFFIYVVRMAVNDWSALYLIETKNYSTVKANLCVSLFEIGGLFGMLLAGWLSDTISKGKRGPMNVVFSLGLLFSILGLWGTHDRSIWWADGAFLFIIGFFLFGPQMMIGLAAAELSHKKAAGTASGFTGWFAYFGAAFAGYPLGKVAQDWGWHGFFVALLACALIALLFFLPTWNASEQSLRKHSH

SEQ ID NO: 20896 - protein, 448 aa, Bacillus sp.
MASIQFPKDFVWGTATASYQIEGAYNEDGRGMSIWDTFSRTPGKVVNGDTGDIACDSYHRYEEDIALLKNLGVKAYRFSIAWPRIYPDGDGELNQKGLDYYAKVIDGLLAAGIEPCVTLYHWDLPQALQDKGGWDNRDTIRAFVRYAETAFKAFGGKVKQWITFNETWCVSFLSNYIGAHAPGNTDLQLAVNVAHNCMVAHGEAVKAFRALGISGEIGTTHNLYWFEPYTTKPEDVAAAHRNRAYNNEWFMDPTFKGQYPQFMVDWFKGKGVEVPIQPGDMETIAQPIDFIGVNFYSGGFGRYKEGEGLFDCEEVQVGFDKTFMDWNVYAEGLYKVLSWVHEEYGDVPIYITENGACYEDELTQEGRVHDAKRADYFKKHFIQCHRLIESGVPLKGYFAWSLLDNFEWAEGYVKRFGIVYTDYKTLKRYPKDSYRFIQSVIENDGFEA

SEQ ID NO: 20897 - protein, 219 aa, Triticum aestivum
RSPGRPTRPPTRPRTRGVKFGHVTFFWNGNRSGYFNPNLERYEEIPSDTGIPFNVQPRMKAVEVAEKARDAILSGKFDQVRVNIPNADMVGHTGDLEATIVGCKAADEAVKIILDAIEQVGGIFVVTADHGNAEDMVKRDKSGKPIRDKDGNVQPLTSHTLNPVPIAIGGPGLAPGATFREDLPDAGLANVAATLINLHGFEAPHHYEPTLIQVSPVPF

SEQ ID NO: 20898 - protein, 267 aa, Nostoc punctiforme PCC 73102
MIKNKTFNSAGKLTALLFLITLFLTPCVIVNAGERGVLMKFGEVQNQILGEGLHLIIPVVNTVKKLSIRVQKQEISAEASSKDLQNVFADVALNWHIIPQEANVIFQEIGDEQAVVMRIINPAVEEVLKAVIAKYTAEEIITKRGEVKGAVDDALSTRLGNYHVAVDDISLVHVHFSERFGEAVEAKQIAEQEAKRAEFIALRATKEAEAKVNLAKGEAEAHRLLRDGLTPEILQRQAIEKWNGKLPLIVNKEAPKLLNLSEFLKFD

SEQ ID NO: 20899 - protein, 679 aa, Thiobacillus denitrificans ATCC 25259
MNEGLLFALVAAGLALLYGIISIKWILALPSGNDRMREIAAAVQEGASAYLNRQYTTIGIVGVILLIAIFLSLGWQTAVGFALGAVLSGLTGYIGMNVSVRANVRTAQAATNGLNAALNVAFKGGAITGLLVVGLGLLGVAGYYAVLTLVLGESTEAATHALVGLAFGGSLISIFARLGGGIFTKGADVGADLVGKVEAGIPEDDPRNPAVIADNVGDNVGDCAGMAADLFETYAVTIIATMLLGGLLITGSPEAVIYPLVLGGFSIIASVIGTFFVKAREGGKIMNALYRGLIVSGVLAAIAFYPITTWMMGEGVTIGGELVTSLNLYFASLIGLALTAAMVWITEYYTATEFSPVRHIAQASTTGHGTNVIAGLGVSMKSTAAPVLAVCAAIWGAYELAGLYGIAIAATSMLSMAGIIVALDAYGPITDNAGGIAEMAGLPDSIRDITDPLDAVGNTTKAVTKGYAIGSAGLAALVLFADYTHALSTHGGPALSFDLSNHMVIIGLFIGGMVPYLFGAMGMEAVGRAAGSVVVEVRRQFKSIPGIMEGTGKPEYGTCVDMLTKAAIKEMIVPSLLPVAVPIIVGLALGPQALGGVLVGTIITGIFVAISMTTGGGAWDNAKKYIEEGNHGGKGSEAHKAAVTGDTVGDPYKDTAGPAVNPLIKIINIVALLIVPLIM

SEQ ID NO: 20900 - protein, 411 aa, Lupinus luteus
MNALAATNRNFKLASRLLRLDSKLEKSLLIPFREIKVECSIPKDDGTLATYVGFRIQHDNARGPMKGGIRYHPEVNTDEVNALAQLMTWKTAVANIPYGGAKGGIGCDPAELSNSELERLTRVFTQKIHDLIGVQIDVPAPDMGTGPQTMAWILDEYSKFHGHSPAVVTGKPIELGGSLGRDAATGRGVLFATETLLNEHGKSISGQRFVIQGFGNVGSWAAQLISEKGGIVVAVSDITGAIKNSKGLDIPSLIKHSKEHKGVKGFHGGDPIDPKSIFSEDCDVLVPAALGGVINRENANDIKAKFIVEAANHPTDPEADEILKKKGVVILPDIFANSGGVTVSYFEWVQNIQGFMWDEEKVNNELKRYMTKGFKDVKEMCKTHDCDLRMGAFTLAVNRVARATVLRGWEA

SEQ ID NO: 20901 - protein, 304 aa, Arabidopsis thaliana
  misc_feature (262)..(262): Xaa can be any naturally occurring amino acid
  unsure (1)..(304): unsure at all Xaa locations
MALLRLPGISLQILGHKSNQKNPNPNVAFTNHSLSLSTPSLCRLHRHATFPDSIPAKSRNLTSYFSTTTQEPVLESSSSSSSAPEVVEEEISKTRLIAQNVPWTSTPEDIRSLFEKYGSVIDIEMSMHKKERNRGLVFIEMASPEEAATALKSLESCEYEGRRLKVDYAKTKKKKTYAPRETPSPVPTFNLFVANLAFEARAKHLKEFFDADTGNVVSTEVIFHENPRRSSGYGFVSFKTKKQAEAALIEFQGKDFLGRPIXLAKSKQFVKLQAKEGLQPPEEEAEEEPSQSETMTQEHETPAA

SEQ ID NO: 20902 - protein, 342 aa, Solanum lycopersicum
MADLLSNWSSTLEAVPKSHCIPEHERPSDPVEIGDSIPVIDLGKANGEERSVVVKDLLKAFEEYGFFQIINHGVPVDLMDEAMKVYKEFFSLPAEEKENYAKDAANNTNRGAATLYSSSAKHYDSEEHRYWRDVLEHSCNLDGEDKKTWPDNPPRYREVIGAYGDELRRVSKVILGMLSEGLGLEAGFFDKELGQRMLVNHYPACPNPSLTLGVGGHCDPNLITIIQQEVYGLQILKDDKWIGVQPIRNAFVVNSGLPITVYSNGKLTSVAHRVVTNTTESRTSIGTFICPHEIVEPAKALVGPENPPQFKPFHWGIDFMPHYLSKKSVYHASLEPFKTEAN

SEQ ID NO: 20903 - protein, 503 aa, Zea mays
MLMSHSQQMANSRKPPGLRLLGGAGSLRTYQTLVLVLTFLAYTCFHMTRKIPSIVKSALDPQTKVGFSHWGRLHASRNALTTGWLPFNTADGSALLGEIDVAFLAAYSVGMFFAGHIGDRMDLRVFLTVGMAGTAVFTTLFGAGYWLNVHSFYYFLVIQMVSGLFQSVGWPSVVAVVGNWFGKSKRGLIMGIWNAHTSVGNIAGSLLAAFLLKFGWGWSFAVPSLIMALVGLMVYVFLPVSPEAMEIDSDGGELNCEKDAVKEPLLEPGQEVRHSAVGFLEAWRIPGVAPFALCLFFSKLVAYTFLYWLPFYISHTRIGGEYLSDATAGSLSTIFDVGGVLGGVLAGHISDRLNARAITAASFTYCAIPALFLYRTYGSMSMAWNVSLMFVTGMFVNGPYALITTAVSADLGTHSSLNGNSRALATVTAIIDGTGSVGAAIGPLVTGYVSSRSWSAVFTMLMAAALLAGLLLSKLVCAELQGKTHSSVSKDAGGEHGAYSDEV

SEQ ID NO: 20904 - protein, 524 aa, Deinococcus radiodurans R1
MPMNTPLTPLTLVRRGLKLYPDHTAVIEPGGPRFTYREWGRRIYQLARAIQAAGYGGQHVAVLSPNTHGGLLTYAGVPWAGSVLVPLNTRLTPEEYEFQLRHAEVRLLLVDESLHDRVREVAAGLGIEVWVMGDARGAGTAFEAKLAAQDDSPLPLPVQDENGTITLNFTSGTTSDPKGVMMTHRSTMLNAIETIYYFKADQDTVYLHTLPDFHANGWGGVWSPFGVGATHVTLPTVRADAAYDAIEQHGVTHLCAAPTVLSMLTDPAHARPLSRQIRVATAGSPPHARIIADMNALGFHVTQVYGLTETSPLITVAELSAQQEELPTPRRAALIAKQGVEMILAGEVEVLDPELRPVPGDGETLGEIMVRGNLVMKGYYRNEEATAKALEGGWFHTGDVAVVHPDGRIEIRDRNKDVIISGGENISSVEVEGVLYAHPAVREAVVVAMPHEKWGEVPCAFIALHQGQEVTPEDLTAHVREHLAGFKVPKHYEFRDDLPKTASGKFQKFILRAELWQGKARGVN

SEQ ID NO: 20905 - protein, 379 aa, Daucus carota
MKLTVKTLKGSHFEIRAQPNDTVMAIKKNIEDLQGKDNYPCGQQLLIHNGKVLKDESTLAESKISEDGFLVVMLGKSKTMSSTGTPAAQSSSAPAPTPAPAVAPAPAPAAAPASAVIPNTTVPEAPLSPAFAPSDTYGEAASNVVAGSNLEQTIQHIMDMGGGMWDTNMVSRALRAAYNNPERAVDYLYSGIPEMAEAAVPVSHFQGDQINAGNNAISDNGVAGAAPGAPNSLPLNMFPQETLSGVTGAGLGSLEFLRNNPQFQTLRSMVQRNPQILQPMLLELGKQNPQLLRQIQEHHEEFLQLINEPVEASEGDMFDQPEQDVPQEITVTAADQEAIERLEAMGFDRGLVIEAFLACDRNEELAVNYLLENAGDFED

SEQ ID NO: 20906 - protein, 257 aa, Shewanella sp. MR-7
MKSIYKLSLVALAVIGLSACNQEEKATNASTNVELTTEAQKEAYSVGASIGRYMSGHIKEQEELGLPVDRTLIVTGFTNGLNDQLKLTEEEMQTILQGLDKKLNDKRQEQATAIAAKNIEEGKKFLEENKAKPGVVTTESGLQYEVLTPGSGDKPAAEDTVEVDYVGTLLDGTEFDSSYKRGQTAKFPLNRVIPGWTEGVQLMPVGAKYKFVIPSNLAYGERDTGTIPPNSTLIFEVELKSIEKAQAAPAAAEPAKK

SEQ ID NO: 20907 - protein, 101 aa, Arabidopsis thaliana
  misc_feature (83)..(83): Xaa can be any naturally occurring amino acid
  unsure (1)..(101): unsure at all Xaa locations
MASSMLSSATMVASPAQATMVAPFNGLKSSGGFPGTRKGNNDITFITSNGGRGNWMPGWASIGKEKVETFFYLSDLTDFQLAXGGDFLIRNQGVPWGGIQV

SEQ ID NO: 20908 - protein, 566 aa, Solibacter usitatus Ellin6076
MSGELTGEALQKLRHDLRTPINHILGYTDMLVEDAAEIGISAFVEPLRKIRAGGRTLLELIQSSLGEGMLAVNAEAMAAFESRFRSRAQTLLISARELEEEFQRAASEDARTDIQRVVAALERLIAMSSGTGESEDAAPPETERVALPDGRGSLGLESGGRILIAEDNPANRDILRRRLEKDGHVVTETQDGREALEQLERGDFDLLLLDILMPRLDGFETLAYIRRNERFHDLPVIMISALDEIQSVVRCIEMGAEDYLPKPIDPVLLRARIGASLEKKRLRDRERQKTAELELALHRLKETQDQLVVQEKMASLGALTAGVAHEIKNPLNFVTNFAVLSVDMMKEVLELIAPVRAQMAPKDGEYLDDLLSDLTGNLDRIRDHGKRADSIVRGMLAHSRGGSGQREEIDLNVLVAEAVNLAYHGLRAQDPAFNITLESEYDGNIPPVHVVPQDLSRVILNIANNGCYAAHQRKLKAGDGYRPTLRTSTAQTAGTVEIRIRDNGTGIPAAVLQKIFNPFFTTKPTGQGTGLGLSLSYQIVVEQLKGTVKVRSKENEFTEFQISLPK

SEQ ID NO: 20909 - protein, 792 aa, Clostridium acetobutylicum ATCC 824
MKVPVKWLKDYVDFDINAKELGDRLTLSGSKVEEIITSGDEITNVVTGKILKIDPHPDAEKLVICSVDVGKNEPIQIVTGAQNMKENDIVPVALHGSTLPGGVKIKKGKLRGVVSNGMMCAKEELGIADEEHVHGLMILDENTPIGKDIKEVLGLDNPVIDFEITSNRPDCLSVIGIARETAATINTKYRNVKIDFSETKGRNIKEELEVEVKDKLCRRYMARVIKNVKIEDSPAWMQERLMLAGVRPINNIVDITNFVMLEVGQPMHAFDKKMITSNKIVIERAKDGEKFTTLDSEERSLDSNVLMIKDGDKNCAIAGIMGGLDSEVAENTHEIIFESANFDGTNIRVSSQKLALRTEASGRYEKDLDPNLAEIALNRACTLIQELNAGEIVEGVIDIYPVKSEPNIVEVDYNWINNFLGIKISKEEMKEYLDRLELTTEIKGDKLEVFSPTFRCDINIKEDVAEEVARIYGYNKVPSTTVKSQSIRTGKSKIQQIKDVVTDILISSGLNESINYSFVSPKIFDKILVPEDSELRNVVKIRNPLGEDFSVMRTTTLHSMMESLARNYSHNNELAKLFEIGKVYIPSENEGEIPKERNVITIGMYGNVDYFDLKGVVENLVEILGVNKISYARESENPTFHPGKTAVIKIKNTVLGTLGEVHPDVCENYEVEERCYVAEIDLDLLLENVSLSRKYKALPKFPTVTRDISVLVDEDILVQEIENVIKRQGGTILESLNLFDVYKGKQVPQGKKSVSYALTYRDENKTLTDKDVEKIQNKVIKTLEHVLGAELR

SEQ ID NO: 20910 - protein, 158 aa, Arabidopsis thaliana
MRKTTKVIVFNWHLKKKKKKKGAMTMFRSISMVMLLVALVTFISMVSSAASSPEADFVKKTISSHKIVIFSKSYCPYCNKAKSVFRELDQVPYVVELDEREDGWSIQTALGEIVGRRTVPQVFINGKHLGGSDDTVDAYESGELAKLLGVSGNKEAEL

SEQ ID NO: 20911 - protein, 510 aa, Xanthomonas axonopodis pv. citri str. 306
MMNALASAKSLNNDPHSIFKPRYDNFIGGQWVAPHSGQYFDNTTPINGKVFTSIARSTAPDIEAALDAAHAAKDAWGKTSTTERSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMELIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDAFMEKALSRVAAIKQGNPLDPNTMVGAQASSEQLEKILSYIDIGKQEGAEVLIGGERNTLDGDLAEGFYVKPTVFKGHNKMRVFQEEIFGPVVSVTTFKDEADALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 20912 - protein, 577 aa, Pisum sativum
MEHRRRDQKSIRTPVNTGELLKTQKLATADSQAVSLCMANAVFFGLFFSVAYFLLHRWREKIRTSTPLHVVTASETAAIVSLVASAVYLLGFFGVGSRASFPDDLSDEEILAKDDSRKSGPCPAALSETDTNADAKPAPAIITIAQPPKVYDVAEPVNLSAEDEEIVNSVVSGSIPSYSLESRLADCRKAAAIRRSAVQTISGKSLEGLPLEGFDYDSILGQCCEMPIGFVQIPVGVAGPLLLDGIEYTVPMATTEGCLVASTNRGCKAIHACGGASSVLLRDGMTRAPVVRFSSAKRAAQLKFYLEDPLNFDELSLSFNKSSRFARLQSIQPAIAGKNLYIRFRCSTGDAMGMNMVSKGVQNVLDFLQNDFFDMEVIGISGNFCSDKKAAAVNWIEGRGKSVVCEAVIKEEVVQKVLKTNVEALVELNMLKNLTGSAIAGALGGFNAHASNIVSAIFLATGQDPAQNVESSHCITMMEAVNDGKDLHISVTMPSIEVGTVGGGTQLASQSACLNLLGVKGASKDSPGANSRLLATIVAGSVLAGELSLMSAIAAGQLVKSHMKYNRSSRDISKVVS

SEQ ID NO: 20913 - protein, 550 aa, Oceanobacter sp. RED65
MLTSLPEYQALSQHYSDVQQTSMRQWFEQNPNRFTEYTLQAAGITLDYSKNRVACETMQKLADLARARFIPEAIEAMFKGDLVNPSEGRPALHTALRNFSDGPVMVDGKDVMPEVRKTLTRMKEFCWRIRNQHWRGFSNKPFTDVVSIGIGGSFLGPKLASQALKPYWGKKINCHYLANIDGSNLTEVLQGLNPETTLFIVQSKSFGTQETLKNAIECRQWFLDNGGQESDLPRHFTAVTANVEKAKAFGINEKNIFPMWDWVGGRYSLWSAIGLPLMLTIGHENFKQVLQGAHEMDVHFRTAPLEQNMPVIMAMLGVWYINFFNAQSHAILPYDHYLRGLPAHIQQLDMESNGKSVDIHGSKLNYQAGPIIWGGVGSNGQHAYHQLLHQGTQFVPCDFIMPLQTHNPVDSFHELLISNCLSQSQALMQGKTLEEAKEELRKEGKSEREIAVLAPQKVIPGNRPSNTIFFDKANPKIVGALIALYEHKVFVQGKIWDINSFDQWGVELGKQLGNQVHAAIQAEGDTNIDNHFDASTLGLIKAFRSMKHKL

SEQ ID NO: 20914 - protein, 842 aa, Pseudomonas aeruginosa UCBPP-PA14
MNNKNLALKAPLSGPVMPLNRVPDPVFSSGTLGEGIAIDPLNDCLHAPCAGLVSHLARTRHALSLRADNGAELLLHVGLDTVQLQGEGFEALVEEGARVIEGQPLLRFDLDRVARGSRSLITVMILTNGDGFQVRPLTTNPVEVGAPLLQLSPEKAEQRPANPAPGEGSAQRQVRGRARVAHHGGLHARPAALLRKTAQGFSSQAELHFAGQVASVDSLVGIMGLGVAEQDEVEVICRGEDSEAALGALLAALASATAGAPKEAPRAIAPGEAARPAAVAGTLAGVCASPGLASGPLARLGAISLPADDGRHRPEEQHLALDQALQRVRDDVQGSLQQARLGGDENEAAIFSAHLALLEDPGLLDAADMLIDQGVGAAHAWHRAIQAQCEILQALGNLLLAERANDLRDLEKRVLRVLLGDTAPLRVPAGAIVAAREITPSDLAPLVDAGAAGLCMAEGGATSHVAILARSKGLPCLVALGAGLLELEEGRQVVLDAGQGRLELSPDARRLEQVALQVAQREEQRRRQQADAQREALTRDGRRIEIGANVASPREAAEAFANGADGVGLLRTEFLFLERRAAPDEEEQRNAYQEVLDAMGQRKVIIRTIDVGGDKHLDYLPLPVEENPALGLRGIRLGQARPELLDQQLRALLRVEPLERCRILLPMVSEVDELRAIRGRLGELATQLGIERLPELGVMIEVPSAALLADQLAEHADFLSIGTNDLSQYALAMDRCHAGLADRIDALHPALLRLIAQTCAGAARHGRWVGVCGALASDPLATPVLVGLGVEELSVGPNLVGEIKTRVRQLDAAECRRHAQALLDLGSARAVRDACLQHWPLA

SEQ ID NO: 20915 - protein, 320 aa, Oryza sativa (indica cultivar-group)
MTRRFWSSHHGSTKLCHCHYSGNFSRYLIAIAISVGLPDSVGGVLSGPVSNVATRWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDKHAVGGCGDITVWLGDLNYRLQGISSIPARKLIEENRQSKLRGKDQLLQEAEKGEVFNGYCEGTLLFKPTYKYNIGSSNYDTSYKIRVPSCTDRILFKVDHTSGLDAVLNSYEALDCIRSSDHKPVRAHLCLKVHGDSA

SEQ ID NO: 20916 - protein, 352 aa, Bacillus licheniformis ATCC 14580
MKVFNIASIPGDGVGKEVVPAAQRVLKAVSDVHGGLSFRFTEFPYSCEYYLEHGEMMPDDGLEQLKEFDSIFLGAVGNSKLVPDHISLWGLLIKIRREFEQVINIRPAKYLQGIKSPLANPKDFDLLVVRENSEGEYSSIGGRIFRDEDEIAIQNAVFSRKGAERAMRFAFELAAKRKKHVTSATKSNGIVYSMPFWDEVFENTAKDYPDITADSQHIDALSAFFVTRPEKLDVIVASNLFGDILTDIGAAIMGSIGVAPAANINVNGKYPSMFEPVHGSAPDIIGKGIANPIGQIWTAKMMLDHFGEEELGARLLDVIEDVLKSGYLTPDIGGSSTTDDVTEEIIKRVRTI

SEQ ID NO: 20917 - protein, 401 aa, Xanthomonas axonopodis pv. citri str. 306
MLSDPIIDVLTSGVAGLGVWGMLAVLLVFTQLTIFAVTLYLHRSQAHRGVDFHPVIAHFFRFWTWLTTSMITREWVAIHRKHHAKVETEEDPHSPQTKGIAQVFWRGVELYREARTQRADIEQYGKGAPSDWIERHLYTPHANAGPIALLVINAVLFGLPGIALWAIQMAWIPFWAAGVVNGLGHWWGYRNFESADTSTNLTPWALWIGGEELHNNHHAFPSSARFSMRRWELDIGWVAIRGLQALGLAKVLRVAPSLDIRPNIAVPDADTLKALLSHRFQAMTDYQRNVFKPALREEAAATGAKLRELLPRRLRKGLVDDGRWLKPDARAQLQAWVAQRPRMRTLVEYRARLTALLEARSHDASERLRQLQQWCHEAEASGNAALQAYAARLKGYALSGA

SEQ ID NO: 20918 - protein, 226 aa, Xanthomonas campestris pv. campestris str. ATCC 33913
MESLLEGFRHFRKEVYPRQSARFHELAAGQKPHTLFITCADSRVMPELIFSAQPGELFVYRNIGNVVPPYSQHVSGVVAAIEYAIAVLGVRHIVVCGHTDCGAMKAVLKPESLEDVPSVAAWLKHTDAARHVTAHHGHDPASQEALSCMTEENVVSQLDHLRTQPVVAARLAAGTLRIHGWIYDIAHGEIRAFDAEKGGFRPLLGETTPEATPRPRLQQAVRAELV

SEQ ID NO: 20919 - protein, 222 aa, Prochlorococcus marinus str. MIT 9313
MQPLSPAFIDQLCFDDIGLIPAISQDWLDGAVLMMAWMNRTALEQTLKSGQVHYWSRSRQELWHKGATSGHTQILKGIRYDCDADVLLLSIEQTGLVSCHTGARSCFFAEVNQHSQGDSLTLPPPMDACSELFRVIDQRHTTPEANSYTNKLLEGGDNRILKKIGEESAEFVMACKDDDEKAIANEAADLLFHLQVALAHHGVNWRDVLEVLANRRGAPRRN

SEQ ID NO: 20920 - protein, 632 aa, Bradyrhizobium japonicum USDA 110
MNIRSNPQQTVPAVTTGPLSSSRKIFASPDAAPDLRVPLREIILSEGAGEPNLPVYDTSGPYTDPSVTIDVNAGLARSRKQWVLERGGVEEYEGRQVKPEDNGNLSTDKAARAFSAYHKPLRGLDGHKITQLEFARAGIITKEMIYVAARENLGRKEQLERAEAALADGESFGAEVPAFITPEFVRSEIARGRAIIPCNINHSELEPMIIGRNFLTKINANIGNSAVTSSVEEEVEKMVWAIRWGADTVMDLSTGRNIHTTREWILRNAPVPIGTVPIYQALEKCNGDPVKLTWELYKDTLIEQCEQGVDYFTIHAGVRLSYIHLTANRVTGIVSRGGSIMAKWCLAHHKESFLYTHFDEICDLMRKYDVSFSLGDGLRPGSIADANDRAQFAELETLGELTKIAWDKGCQVMIEGPGHVPMHKIKINMDKQLRECGEAPFYTLGPLTTDIAPGYDHITSGIGAAMIGWFGCAMLCYVTPKEHLGLPDRNDVKVGVITYKIAAHASDLAKGHPAAQLRDDALSRARFDFRWSDQFNLGLDPDTAKNFHDETLPKEAHKVAHFCSMCGPKFCSMKITQDVRDYAATLNDPNSIGMSLSGTAEDGMKQMSAKFKEMGSSVYLDAEKVKESNRVL

SEQ ID NO: 20921 - protein, 642 aa, Leptospira interrogans serovar Copenhageni str. Fiocruz L1-130
MQSVRLTSVSLKTKVFDFQGNLEKIKRVLKLEKKSDLILFPELCISGYGCEDAFYFPRIWKKSWNSLIQLLPHTENKIIVVGLPIFQNPYLFNCAAVLCNGVVAGIVPKSNLASTGVHYENRWFTRGEESQENFIAPDGSTIPFGSLIFETDHFSFGVEICEDSWVLQKPSIPLAEAGTDLILSPGASHFAFGKQRIRRQIFQESSRRESNVYLFSNLCGNESGRLIFEGGSMIVQNGKLLSESERLFFGDFSLCSNEIDFEASQADRAKNFRPSGNRFSKTKSTEENKIYLGIEFPKRAPKVNKSLLEISVSKEEESYLDFTKAVALGLFDYLMYSNTKGYTLSLSGGADSSACALLVTAMKKIAKLELGENFFKSKGIPEESILCTLYQSTSNNSDRTKFLAKSLAKEIQSIHGDLTIDSEIQSISEKISKLTGISLRWDKHNLTLQNIQARVRSPIIWMLANLNGHLLLSTGNRSEASVGYTTMDGDSSGSIAPLTGVSKEFILKWLRFVSEGKDPILPAYPSIKEIVNSPPSAELKPPEDKQEDEKDLMPYPLLQKIEELFIVRGAGYSEIIQLLSEDSEIQNLPPRFLEESVKKYISLFHKNQWKRERLPPSFHLDDYGLDPKSSFRFPILSEDIEL

SEQ ID NO: 20922 - protein, 579 aa, Triticum aestivum
MGKSPAKWLKSVLFGKKTSRSGSAKAKDLSKTGSNRGYVAAGKEPGFSESSPVISEPVLVTPRNNDAVPEAGKGENSSSQGEAVVQHEVNHDLDKQSTVGSDVLSNDPERLKEEQAAVKAQAAFRGYLARRAFRALKGIIRLQALIRGHLVRRQAASTLRATWLIVKFQAIVRGRNVRLSSDAIQFSWKLAEQKSVGTKPDAWREKLASNAFARKLLASPILVEALHFQYDERDPNSAFNWLERWTISRVWKPVYQTKRNAIADAKPQTKRASYAMETESGKLKRNARKSSAMSVEPTPPTNMPLETEKTRRNPRKFTSTPADSVPDSQLTELEKVKRSLRKVTNSMAEASKVSSPATETPDHPEIQFEKPQRTAQEVPVYPEIQEPHHDDLLENAKVDIFVPDLKPEVEVTPYAVTTEEKLNEPTVVATTAEVMPLQDIDNEENALVNDAEQRSREEPLSAESLKGGNRRSSFSTKPEYPENGSKNSPAVPSYMSATKSAKAKLRGQISPRLSADSAEKTVHTRRHSLPSPANGKQNSHSPRTQRPIHPGTKEGAKVDKSMLSSRDAAERPMKAEWRR

SEQ ID NO: 20923 - protein, 392 aa, Prochlorococcus marinus str. NATL1A
MTDKSQISIRALSIKPSLTLEISAKAKALKAEGKNICSLSAGEPDFDTPEFIVDATLKALKDGKTRYGPAAGDPELREAIAQKQSDINKVPTKTDNVLVTNGGKQAIYNLFQVVLNPGDEVLIPTPYWLSYPEITLLAGAKPIKIKSSTKDKFKIDINSLEEHVTAKTRLLIINSPSNPTGCVLTEQEMKTISDFLRRHPRILLMSDEIYEFLISPNQVHHSFAKIAPDLKNRIFTVNGFAKAWAMTGWRIGYLTGNAEVIKKAIALQSQSTSNVCSFAQKGAIAALQGSKDCVHEMANIYNKRRLLITERLKKIKHISFVPPNGAFYVFPEINLEEIDSISFCKLALEKVGLAIVPGIAFGDDKCIRISYAASNKMIEDGVNRLERLLNDF

SEQ ID NO: 20924 - protein, 442 aa, Coccidioides immitis RS
MALRIAARRLGSRAARRPYAFESFVQCRFASTAGASNLPQDVKKQIFGEGCYLWDMENRRYLDFTAGIAVTSLGHSDPGVTKAINEQARTLLHASNLYHNNWTGSLSKLLVAQTHSSGAMRGATQAFISNSGTEANEAAIKFARKVGHSLDPSGAKYEFVSFHNSFHGRTFGALSATPNPKYQAPFAPMVPGFRYGKYNDIEQLPRLITEKTCGVIVEPIQGEGGVHCATPEFLTALRARCDEVGAILIFDEIQCGLSRTGSLWAHSHPSLVPTNGAQQPAHPDILTTAKALGNGFPIGATLISDNVGKHIKTGDHGTTFGGNPLACRVAHHVFTRLASRELQDTVLKRSEVFVAGLKALREKYPDAISEIRGRGLILGMQLTGDYASRVGDIVTAARERGLLVITAGEGCLRFVPPLVISEEEIQEGLQILGNAMEKVFQK

SEQ ID NO: 20925 - protein, 459 aa, Escherichia coli O157:H7
MNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 20926 - protein, 130 aa, Vitis riparia
MAYQQDPCANPTRQTGKTGGQTDQYGNPVHQTEALGAYGAGTGTGMHGGEHQQQPHQQPGVLHRSGSSSSEDDGQGGRRKKGMKEKIKERIPGMGRKDEQKQTSATSTPGQGQQQKGMMEKIKEKLPGAH

SEQ ID NO: 20927 - protein, 465 aa, Chlamydia muridarum Nigg
MNEAFDCVVIGAGPGGYVAAITAAQAGLKTALIEEREAGGTCLNRGCIPSKALLASAEIVAQIRHADQFGIHINGFSIDYPAMVQRKDTVVRSIRDGLNGLIRSNKITVFSGRGSLISSTEVKILGETPSVIKAQSIILATGSEPRAFPGVPFSQQSPRILCSTGVLNLKEIPQKMAIIGGGVIGCEFASLFHTLGSEVSVIEASQQILALNNPDISKTMFDKFTRHGIRFMLGASVSSIEDMGDRVRLTINGNIEEYDYVLVSIGRRLNTENIGLDKAGVICDERGVIPTDSTMRTNVPNIYAIGDITGKWQLAHVASHQGIVAARNIAGHKDEIDYSAVPSVIFTFPEVASVGLSPTSAQQQGIPVKVTKFPFRAIGKAVAMGESDGFAAIISHETSQQILGAYVIGPHASSLISEITLAIRNELTLPCIYETIHAHPTLAEVWAESALLAVDTPLHMPPTRK

SEQ ID NO: 20928 - protein, 115 aa, Zea mays
RLRRGPRVSAPVDSALQLKTIPTFFEFKQEKHLVATVGKFSVIWNFQQVKDSNHECYRDQQGLKSCYCYKVVLKDESIVDSRFMHEKFATSDSPEAPLVVATPMKVSSFSIANRR

SEQ ID NO: 20929 - protein, 459 aa, Escherichia coli O6
MNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMLTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 20930 - protein, 719 aa, Nicotiana tabacum
MADVTSMGEITAIAARIGVDLSQIDLDSIHLPPGEDCGIPSDDDDLMEEDPLEFDAGFGNILVVDNLPVVPKEKFEKLEGVVRKIYSQLGVIKEDGLWMPVDPETHKTLGYCFIEYNTPQEAELSKEKTHGYKLDRSHIFAVNMFDDIERFLKVPDEWAPPEIKPYVPGENLQQWLTDEKARDQFVIRAGNDTEVLWNDARQLKPELVYKRSFWTESFVQWSPLGTYLATVHRQGGAIWGGATTSNRLMRYAHPQVKLIDFSLAERYLVTYSSHEPSNPRDSHAVVLNISDVRTGKVMRDFQGSADEFAVGGTGGVTGVSWPVFRWSGGKQDKYFARIGKNVISVYETETFSLIDKKSIKVENVMDFSWSPADPILALFVPECGNQPARVSLVQIPSKEELRQKNLFSVSDCKMYWQSNGDYLAVKVDRYTKTKKSTYTGFELFRIKERDIPIEVLELDNTNDKIPAFGWGPEGSPICCYPSVTTPRPDIRFYSVPVWALTPGLVSKLTTLKGKQANALYWSPGGRFLILTGLKGFNGQLEFFDVDELETMASAEHFMATDVEWDPTGRYVATSVTSVHEMENGFNIWSFNGKLLYRILKDHFFQYLWRPRPPSFLSKEKEEEIAKNLKRYSKKYEAEDQDVSLQLSEQDREKRKKLKEEWEAWINEWKRLHEEEKMERQKLRDGEASDEEEEYEAKEVEVEEIINVTEEIIPFEESQQ

SEQ ID NO: 20931 - protein, 81 aa, Triticum aestivum
MGCDDKCGCAVPCPGGTGCRCTSARSGAAAGEHTTCGCGEHCGCNPCACGREGTPSGRANRRANCSCGAACNCASCGSATA

SEQ ID NO: 20932 - protein, 156 aa, Glycine max
DWVPGPPSSQLLGPPPHEKSVRRRQKAEVDNGASTPEKIMKEGNGNGSNGFSSTGKTLAMRPKSASRAALFPESESGWLDSIPVGLGESIFTDGFSGVRKSSSASSLREQEKNNSAAAWPPAIWGLKPDLQAAISKPIFDGLPIPISGRRSKAALD

SEQ ID NO: 20933 - protein, 340 aa, Thiobacillus denitrificans ATCC 25259
MNLDELQAVARAIVAPQKGVLAADESGPTIKKRFDTIAVESTEKSRRRYREIMFTAESIERYIGGVILYDETLRQSTRDGTPFPQLLAGRGIIPGIKVDQGAKPLALCPGEKVTEGLDGLRERLVEYHGLGAQFAKWRAVIDIDAHDLPSPFGIHANAHALARYAALCQEVGLVPIVEPEVLMDGAHDVERCEAVTARALEAVFAELDAHGVGLEGVLLKPNMVVAGKKSTRQAGVQEVAEATLRCLRRHVPAAVPGIVFLSGGQSAEEATAHLSAMNAMGPHPWQVSFSYGRALQAPVLAAWRGHEANAAAAQAALLERARLNGLARDGAYGPEMESAG

SEQ ID NO: 20934 - protein, 547 aa, Xanthomonas axonopodis pv. citri str. 306
MAERVRTGYNLHDGQRDTSREVLQSVADAIRRAATRHSTELVLDYGLPATTLPDAIGRLDALQKLTLLHTGLQSLPDSLGQLHQLRHLQIAGALGLKTLPPSLTRLSNLRTLQLTMIPLDELPVGIGRMQGLRSLTLGGGHYARLPASIVELSGLTELRMPHSSHFRELPENIGLMQGLRSLEVASNSELEQLPGSLTQLHRLEKLTLSSNRRLAHLPEDIGQLRGLTELSLKNCAALRQLPDSVGDLAQLQLLDLRGTGLQTLPQSLARLPAQCDIKVPDHLAGQLLQIRDPERAAREPQRAAQRLAERRRRAPVPAAQQAGASWNRMPEFARVLRTVDADLGERFDKWTQGLAQTARISGASITPADMPLLDQVVTEAIRSPEFRSSFGQFLSDHTLKTLNMDGMTQVGGFGPAVRGDVKTAFAEMLKHKLMHTQDHQTALGLLQDALQNPDLGLSREMLLRSRNELTGRVEMWPPLKAYISMHDVEGQAAQDAAITWTMAQFEEAQQGGIGDAEAKQESERAQANANRFIEQRARVLLREWDIR

SEQ ID NO: 20935 - protein, 331 aa, Pseudomonas aeruginosa UCBPP-PA14
MINRQIVLSELPRTALAVRHFQGREVRCPVPADGELLLRVLYIPLDAASRAWMQGATYRPGLVAGEVMAGLGLAEVVESRSASFQPGDLVCAETGWQTFAVVPAAGLIRLPRLEPLTHLLSVYGVAGLTAYFGLLECARPVQGETLAVSAAAGAVGSIVGQIARIRGCRTVGIAGGASKCAWLVRELGFDAALDYKTGTLADDLRRTCPDGIDAYFDNTGGAILDACLPNMAEHGRVACCGAISQYDLDRPAAGPAGIPGLLIIKRLTLRGFLLGDFLESRERALSDLKAWVDSGQIKVYEDVLYGLESLPAALVGLLNGENFGKRIVKVA

SEQ ID NO: 20936 - protein, 148 aa, Triticum aestivum
  misc_feature (133)..(134): Xaa can be any naturally occurring amino acid
  misc_feature (136)..(138): Xaa can be any naturally occurring amino acid
  unsure (1)..(148): unsure at all Xaa locations
MAAEEGEKKMITLKSSDGEEFQVEEAVAMESQTIRHMIEDDCADNGIPLPNVDSKILSKIIEYCKKHVQANASSSTSTAAAAPTEDLKSFDADFVKVDQATLFDLILAANYLNIKGLLDLTCQTVADMIKGKXXEXXXKTFDIKNDFT

SEQ ID NO: 20937 - protein, 176 aa, Prochlorococcus marinus str. MIT 9313
MPSFLNLVDWGERVIVKVLTMITVVVIIAALIQLIVNVGNELFVDSQQSWLGDDLIKVLGDLLTVLIALEVLQNVTSYLRRHVVQIELVLVTALTAVARKVIVLPPGSDDKPQLLAGLGIASIALAGAYWLVKRATIDPALSARSRTKPTKLSQGEDQFVPHDADGEGPNAADLPR

SEQ ID NO: 20938 - protein, 274 aa, Prunus persica
DEGPQVPTIDLKEIDSENENVRERCREELKKAAVDWGVMHLVNHGISDELMDRVRKAGKAFFDLPIEQKEKYANDQASGKIQGYGSKLANNASGQLEWEDYFFHLVYPEDKRDLSIWPQTPADYIEATAEYAKELRALATKVLRVLSLGLGLEEGRLEKEVGGLEELLLQMKINYYPLCPQPELALGVEAHTDVSALTFILHNMVPGLQLFYEGKWVTAKCVPNSIIMHIGDTIEILSNGKYKSILHRGMVNKEKVRISWAVFCEPPKEKIILK

SEQ ID NO: 20939 - protein, 876 aa, Yarrowia lipolytica CLIB122
MTDIKPVDLDTKEYDIDTADVREITLHTEEWIAQKLLIPPSDVDGTYPRSVTVISQAFENMSEAEAIAIVKKAWDQHSSDANLTAEHKDVLQHLIEMIGEGKEGEDESVPPEDLEELKYQACLFHHWSPYQQVRSVTTPFDDQDEECETFRCYVIGIIWVGIAAFVNQFFSPRQPPIQLTVAVIQLLLYPSGRLWQFIFPDWGFKVRGVRYSLNPGPWTQKEQLLATLMASVANVPPYIDYNIFVQYLPKFYNQPFALNFGYMVMMMLTTQFMGFGMVGFLRKLAVYPAKAMWPTLLPTLAVNKALLAPNRKEKINGWTMTRYTFFLLVSAIAFIQFWVPNYLFQAISTFNWMTWIAPNNVVLAAITGGASGLGFNPISSFDWNQFTAAVFPVMFMPISSLVLGVSGMFVAGFIILAVWYTNTQYAGYLPINSADVFDNTGLPFNVSRILTNNEFDEAKYRAYSPPYYAAANLVVYGAFFAVYPMSFFYTVIMEWEIMKVSLRDLYDGFKHWKRSNYYGFDDYFSRTMSKYAEVPQWWYMVILLITFGMSIALIEHWNTKATVWMLVVVMLINFVCLFPFTIVMSYTGIQFTLNVLVELIVGYALPGKGIAMMILKAFSVQIQIQCQNFLTDQKVGHYGKLPPRSMFRVQMLATIVAGLVTLGVMQFQLNDVEHMCDVKYQTSHEKFTCPSETVFFSASVIWAVVGPKKIFDSQYPILRWCFLIGFGIALLFVFLQKFVPRMLKKRYPDRASEITKWEARFKEVNPSIICYGFLNYAPYNLTYVWSGVYLAFFFNVYIRKRFPGWWEKYTYVFCSAMNTGIALSAIIIFFALQYTNVNLTWWGNTVSFAGVDGAGGAGIVPIPDKGFFGPDSAHYP

SEQ ID NO: 20940 - protein, 315 aa, Haemophilus ducreyi 35000HP
MNQLDALREMTVVVADTGDIEAIRQYQPQDATTNPSLILSASALSQYAPLIDDAIRYAKSKSGNKAQQLVDAEDKLAVNIGLEILKIVPGRISTEVDARFSYDTEKTIAKARKLIGLYNEAGVANNRILIKIAATWQGIRAAEILEKEGINCNLTLLFSQAQARACAEAGVYLISPFVGRILDWYKANEKKEYAAAEDPGVISVTAIYNYYKQYNYKTIVMGASFRNVGEITEIAGCDRLTIAPPLLKALAESNETLVRKLDYQGEILDRPAPLSEAEFYWQHNQDPMAVDKLAEGIRKFAIDQEKLEEMLSAKL

SEQ ID NO: 20941 - protein, 459 aa, Salmonella paratyphi
MNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDSFRQLAREYPNLVHEARGKGMLMAIEFVDNETGYRFASEMFRQRVLVAGTLNNAKTIRIEPPLTLTIELCEQVLKSARNALAAMQVSVEEV

SEQ ID NO: 20942 - protein, 424 aa, Chlamydophila caviae GPIC [sequence omitted]

SEQ ID NO: 20943 - protein, 459 aa, Salmonella typhi
MNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHEARGKGMLMAIEFVDNETGYRFASEMFRQRVLVAGTLNNAKTIRIEPPLTLTIELCEQVLKSARNALAAMQVSVEEV

SEQ ID NO: 20944 - protein, 459 aa, Salmonella typhimurium
MNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHDARGKGMLMAIEFVDNETGYRFASEMFRQRVLVAGTLNNAKTIRIEPPLTLTIELCEQVLKSARNALAAMQVSVEEV

SEQ ID NO: 20945 - protein, 571 aa, delta proteobacterium MLMS-1
SGSRMKTVYELGEQLGMEKEEVLPQGHYVAKLDYRKILERSKNKPDGKYVDVTAITPTPLGEGKSTCAMGLVQGLGKRNKSVIGAIRQPSGGPTMNIKGSAAGGGLAQCIPLTPFSLGLTGDINAIMNSHNLGMVALTSRMQHEANYTDEQLAKRNLKRLDIHPKKVEFGWIIDFCAQALRNITIGQGGKMDGFNMQSKFSIAVSSEIMAILSVARDLKDMRQRIGKIVVAYDKQDRPITTADLEVDGAMTAWMVEALNPNLMQTLEGQPVVVHAGPFANIAIGQSSVIADRVALKLADYNVTESGFGADIGFEKFWNLKCRFSGLKPHCAVVVATIRALKCHGGAPIPVPGKPMPEEYGKENVGWVEEGCKNLLHHIETVKKAGINPVVCINAFYTDSDNEIKAVRRLCEAAGARVALSRHWEQGGDGALEFADAVVEACEEENDFRFLYELETPLEKRIELIAKEVYGADGVSYTPDAKAKLKRMEADPDMKEMGTCMVKTHLSLSHDPSLKGVPKGWTLPVQDILTYKGAGFVVPVAGTISLMPGTASDPAYRRIDVDTDTGKVKGVF

SEQ ID NO: 20946 - protein, 757 aa, Oryza sativa
  misc_feature (133)..(133): Xaa can be any naturally occurring amino acid
  misc_feature (138)..(138): Xaa can be any naturally occurring amino acid
  unsure (1)..(757): unsure at all Xaa locations
MRGAVLVAVAAAIGNYLQGWDNATIAGAVLYIKREFALETQPAVEGLVVAMSLIGATIITTFSGPVSDLVGRRPMLIASSLLYFAGGLIMLWSPNVYVLLLARLVDGFGVGLAVTLVPVYISETSPPEIRGRXNTLPXFTGSGGMFMSYCMIFAMTLSPSPNWRIMLGVLFVPSLLYLFVTVFYLPESPRWLVSKGRMKEARVVLEMLRGREDVSGEMALLVEGLGTGGDTEIEDYVVGPSEGDAGENEQARDTVTLYGPEQGLSWVAQPVAGGRGSMLGSSLGLQASRHGSMYEQMKDPVVALLGSVHERLPESGGGATGSMRGSTLFPNLGSMLSVNDRPGGSSWDEENVQPGDDDLDEEEEEYLSDDGKDDDDGGGLQAPLLSRQSTDVETKNEPASGQVAMQRHSSIGGGGGVETASTMGIGGGWQLAWKWTENVGPDGVKRGAVKRMYLHEESEAAPGGDSGAAGDAQSTAYVHAAALVSRSMLYTKDVLIGQSPTEPAFANPPEAVAAAASTGPAWRELLEPGVRHALFCGVTIQILQQFSGINGVLYYTPQILDQAGVSVLLASLGLSGDSTSILISGLTTLLMLPSIGVAMRLMDASGRRALLLWTLPVLVASLAVLVVANVVPMAATAHAALSTGSVIVYFCCFVMGFGPIPNILCAEIFPTRVRGLCIAICSLTFWLGDIAVTYSLPVMLSSVGLAGVFSFYAAVCCVALVFVALKVPETKGLPLEVIIEFFNVGAKAGTLPDEEFH

SEQ ID NO: 20947 - protein, 1097 aa, Arabidopsis thaliana
MTEPERLGGISLSFPVNEEDTVTTTSPKTLPRRLRRRLLEPKSPVSAAEIDSKLREADLRRQQYYESLSSKARPKMRSPRSGSIEELSQRLESKLNAAEQKRLSILEKELARLAKMDEARQAAKNGLEQRVEKERDELESKVEERVLKAEKNRMLLFKAMAQRRAAKRQRAAQSLMKKAIQETRYKESVRAAIYQKRAAAESKRMGILEAERRRANARLTRVFGAASSVRSQKEAERRKMKDRLEERLQRAKKLKAQYMRRRRGMDSCSSSRSETMRKNQVHLVRMLVRCWRRFAKYKKSTFVLARAYHELGINEKSIESVPFEQFAIQMNSVSVIQTVKALLDRLEIRLTLSKASNVENINHLLKHIFPPVRRGKSPSPMSKGEQNSPNSKMGYQKLKKIARYPARIFLCAYMIKQHPGAIFRGRGEHEIALVESATCLIREFELLVKVILEGPESTLPGNVSFVAQRPKKFRSQLEAFDKAWCSYLEGFVVWKINDAKLLEKDLARTQESELSEVSKHTSSPKIIDSGLNQKTVKASSPTNRALFSETDGARESKAPADSHLPSSSSPSPGSSNLSPSLNSGSEAISTPNVVANSFDAALASENEVIVNEIVHDNSSSFADSLDPNTGDTSNLQVRVKETMEKAFWDGVMESMKQSQPDFSWVIKLMKEVRDELCEISPKDWRQEIVQTIDTDVLSQLLASGNVDMGYLGNILEFSLGILLKLSAPANEEEIRVTHHKLMTELGEIVPTDGHSNSSYAVLMVKGLRFVLQQIQILKKEISKSRLKLLEPLLKGPAGLEYLKKSFSSRHGSPDQASSSLPLTKRWLLSVRGEAEREWKEHKDALSAVINNHSGSSGLPSTTMRTGGNVSSVSKVNTPSSPFPGIELSECKGETVDLLVRIGLLKMVSEIGGLTLETVPETFQLNLSRLRDVQSQIQKITLVSISVLILQQTLVSENSSSIDMEAITRTCINRLYEMLDAKPDAGLSEIMETLSELLDSNDAETKKQVIANMLVKSLQAGDAVFTHVSQTIYLAIRAAVLAGNNTKRKQLVETMLRKIGAASLSDKVIEVSDILVLVATVSRSVHGLWYEELLKKPN

SEQ ID NO: 20948 - protein, 320 aa, Pseudomonas aeruginosa UCBPP-PA14
MTIRQTPINSGFGAKTQASEVMAGQDLSGKTAIVTGGYSGLGLETTKALAYAGARVIVTARRPDVAREALLGLDEVEVQALDLAELACVRRFAEAFSASRRRADIVINNAGVMACPETRVGPGWEAQFATNHLGHYALVNLLWPSLADDARVVAVSSAGHHYSAIRWDDVQFERGYDKWLAYAQSKTANALFAIQLDALGRERGVRAFAVHPGSIATPLQRHVPRAEMIALGWMDEAGNPASPDTLKTPQQGAATQLWAATSPLLAGMGGLYCEDCDIAGVAPDDSRTLAGVREHAIDPEQARRLWRLSATLTGIDAFAS

SEQ ID NO: 20949 - protein, 410 aa, Rickettsia rickettsii
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLAAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAVVLKETCKEVLKELGQLDNNLLQIAIELEAIALKDEYFIERKLYPNVDFYSGIIYKAMGIPSQMFTVLFAIARTVGWMAQWKEMHEDPEQKISRPR

SEQ ID NO: 20950 - protein, 293 aa, Clostridium acetobutylicum ATCC 824
MSIFKGSAVALITPFTQDGVNFDELKKLLEWHIKNKTDAIVICGTTGEASTMSLNERKETIKYTVETVNKRIPVIAGTGSNNTKSSVEMSIWAEKIGVDGVLVITPYYNKTTQKGLIEHFKSINDNINIPIILYNVPGRTGLNILPETLYAMRDLKNICAIKEASGNISQIAKIKALCRDRFDIYSGNDDQIVPILSLGGSGVISVLANIIPQTVHDMCFSYFQGKTTDALNLQLDTLSLTNSLFIETNPIPIKTAMNLLNFNAGPLRLPLCSMDEKNLNTLKTDLKGYGLIK

SEQ ID NO: 20951 - protein, 411 aa, Rickettsia sp.
DSEFAELKIRGKIFKLPILKASIGEDVIDISRVSAEADCFTYDPGFMSTASCRSTITYIDGDKGILRYRGYDIKDLAEKSDFLEVAYLLIYGELPSSEQYNNFTKKVAVHSLVNERLHYLFQTFCSSSHPMAIMLAAVGSLSAFYPDLLNFKEADYELTAIRMIAKIPTIAAMSYKYSIGQPFIYPDNALDFTENFLHMMFATPCEKYKVNPIIKNALNKIFILHADHEQNASTSTVRIAGSSGANPFACVSTGIASLWGPAHGGANEAVINMLKEIGSSENIPKYIAKAKDKNDPFRLMGFGHRVYKNYDLRAAVLKETCKEVLKELGQLDGNPLLQIAIELEAIALKDEYFIERKLYPNVDFYSGIIYKAMGIPSQMFTVLFAIARTVGWMAQWKEMHEDPEQKISRPR

SEQ ID NO: 20952 - protein, 104 aa, Zea mays
  misc_feature (35)..(35): Xaa can be any naturally occurring amino acid
  misc_feature (49)..(49): Xaa can be any naturally occurring amino acid
  misc_feature (79)..(79): Xaa can be any naturally occurring amino acid
  misc_feature (91)..(91): Xaa can be any naturally occurring amino acid
  unsure (1)..(104): unsure at all Xaa locations
MSESGKGGKGLVKAGAKRHRKVLRDNIKSITKPAXIRRLHRRGGVKRIXELIYEETRGVLKIFLQNVIGDAVTYTEHAXRKTVTAMYVVYXLEWQGRTLYGFRG

SEQ ID NO: 20953 - protein, 395 aa, Clostridium acetobutylicum ATCC 824
MYFIGGIKMESSKISKGANSIQISGIRKFYNKVIKVQGAISLTLGQPDFPVPDKVKRAMVRAIEDNKTVYTSNAGIDELRNEISKYLKRFNINYSKDEICITAGGTEGILDIFQALLNKGDKVLVPDPSFPAYASCTKLLEGEVITYGLYGSEFSIDFNELENKIKNEKPKFMVLSYPSNPTGTVISKEDNEKLHKIIKDNDIIAVTDEMYSALCYEDDYYSVSQYEDIREKVIVVSGFSKTFSMTGLRIGYVCAESSFMSSILKVHQYTTTCAPSISQYGALEGLKNCDEDVQYMKNEFKKRRDYVYKRLKDMGFEVRLPKGAFYIFPDISRFGMTSEQFCEKLLNEAKVAIVPGSAFGEKGEGFARISYAYSKKELEECMNRIEKWVEVQNNL

SEQ ID NO: 20954 - protein, 392 aa, Oceanobacter sp. RED65
MDLKLSNRVQSIKPSPTLAVTNRAAELRAAGKDIIGLGAGEPDFDTPEHIKDAAKQAMDNGFTKYTAVDGTPDLKKAIIAKFKNDNGLNYEANQILVSCGGKQSFFNLSLALLNPGDEVVIPAPYWVSYPDMVKIAEGVPVIIETDASARFKITPEQLDNAITDKTKLVVLNSPSNPSGMAYTKAEFEALGDVLRKYPNVLIATDDMYEHILWTEEDFNNIVTVNPDLYERTIVLNGVSKAYSMTGWRIGYAAGPQPLIASMKKIQSQSTSSPTSIAQVAAQAALEGNQQCVKDMVTVFKKRHDFMVDALNEIDGIECLNGDGTFYLFPSFKGAQAKLNCETDTDLAEKLLEAGVALVPGSAFGTPGHMRISFATSDSNLEQSIERLKKALG

SEQ ID NO: 20955 - protein, 411 aa, Rickettsia sp.
DSEFAELKIRGKIFKLPILKASIGEDVIDISRVSAEADCFTYDPGFMSTASCQSTITYIDGDKGILRHRGYDIKDLAEKSDFLEVAYLLIYGELPNGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEVVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 20956 - protein, 424 aa, Oceanobacter sp. RED65
MAARSNTPDFAYLRPKRCHFAFKATEELSVQHQAIMNTYGRLPVTFSHAKGAYVYDDKGNSYLDALSGIAVCGLGHAHPAVTQAICEQADNLVHVSNLYGINRQNELAEKLTKISGMDNVFFSNSGAEANEAAIKIARKYGNEKGVELPTILVAENAFHGRTMATLTATGNKNAQAGFGPLLDGFERVPYNDLEAAKKAIEKNPNIVAVLIEPVQGEGGVTAGLDDYLTGLRKLCDQNDLLYMLDEIQTGNGRTGQYFAYQHYNWKPDVVTTAKGLGNGVPIGACLAKGKAAEVLQPGSHGSTYGGNPLACSAGCAVIDTITSANLCERVQALGERIRHQLQSHLDNQQVTEYRGKGLMIGIVLNTDEACGAIMKMALDEGLLLNVTAGNVVRLLPPFILTDEQADTVAEKTANVIKAFLAEKQ

SEQ ID NO: 20957 - protein, 108 aa, Oceanobacter sp. RED65
MSDIMDQIKEQIESNDVLLYMKGNPNQPQCGFSARAVQALMECGKRFAYVDVLSNPDIRSNLPIYANWPTFPQLWVKGELVGGCDIITEMGANGELKQIIDQAVPDEA

SEQ ID NO: 20958 - protein, 453 aa, Prochlorococcus marinus str. MIT 9313
MEHPFDLIVLGAGSGGLAAAKRAASHGAKVAIVEGDRVGGTCVIRGCVPKKLLVYGSLYREQLEVAPSFGVELSDAQINAGVLLANVRQEVDRLNTLHIDLLAKNGVELVTGWGSFTSPNSVAVSRNGAIDASQELHGDHILIAVGGRPHRPDIPGAELGWVSDDMFMQSSFPDRVVVVGAGFIACEFACILHGLGVEVIQLVRGDHLLRGFDRELSTAVQDGMQEKGIDLRFGENPAALKGQPGDLVLSTQSGERFSCGGVLLATGRRPFLQGLNLDAAGVVLEGRRISVDANQSTNIPHIFAVGDVTDRINLTPVAIDEGRAFADSVFGQKPRQVNHDLVASAVFSQPELATVGLTEEQSIDRYGKDQVKVYRARFRSMAQALPKRGPRCLLKLIVARNTDRILGCHMVGEHAAEIIQMAAIALGMGATKADFDRTMALHPTVSEEFVTMT

SEQ ID NO: 20959 - protein, 501 aa, Aspergillus oryzae
MELLPKLVILLLAALGIASVSIRRFLNRRQFARRCGCQPVARSFSKDPFLGLDTIPGTIRAIRQHRVLGRSCEIFRAYGNTFTVKELHQSAIVTIEPENIQAVLSLNFKDYTLRHRLELFMPLLGRGIFNTDGQHWASSRALIRPSFAREQVANLSLLERLMQDLFVLLPRDSTTVDLQELFFRYTIDSATDLLFGQSVGALKKSQSGLAFADALQYALKAIPVRDMLGPLNAVYRDRKTDECNRICRDFVQQYVEEAVYAAGPKKEEKESRTTETKRRYILSHELASRTSDKQRMVDELINVLLAGRDTTGSLLGNLFFMLAKNPVIWAKLRAEVAVLQNRPPTYEELRGLRYVQCCVNESLRLHPVVPTNKRKAMRDTVLPRGGGNDGLSPVFVPAGTLVGYNIYAMHRRTDFYGPDAKEFRPERWEDGKLQPRWGYLPFNGGPRICLGQRYALTEASYVLVRMAQEFRGLESRDPGSWEEGLVLTVCPRNGTKVGLIP

SEQ ID NO: 20960 - protein, 458 aa, Xanthomonas axonopodis pv. citri str. 306
MSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLGLNLVTVKLFGEMEFWFALIKIIAIAALIVTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSRAAIPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQR

SEQ ID NO: 20961 - protein, 479 aa, Prochlorococcus marinus str. MIT 9313
MALHRSNPRSNDLEEHAIGETVDALVSPLPRTTFPQEYRPALTTFNLLKEELLLDGNSKQNLATFCQTYESQQVAELMALAVDKNLIDKDEYPQTAEIERRCVSMMADLWHAPGEAVGCSTIGSSEAAMLGGLAAKWRWREHRKAAGQSIDRPNMVCGSVQICWTKFARYWDVELREVEMTSGELCMSPERMLEQVDENTIVVVPTLGVTYHGLYEDVQAVSQALDELQQRKGLDIPIHVDAASGGFLAPFCAPDLAPWDFRLPRVKSINSSGHKFGLAPLGVGWVLWRESRDLPEGLVFHVSYLGGDMPTFQINFSRPAGQVISQYYDFVRLGRDGYQAIHGASYANAQYVAQELKKLGPFELINDGNPAGGIPTVVWTLRADQELGFNLYDLSDRLRLRGWQVPAYPFTGELAHQAFQRILVKRDFSREMADLLLTDIRNAITHFESHPVKISLNANEAASTNHLGRSMVECRDAHG

SEQ ID NO: 20962 - protein, 505 aa, Brassica napus
  misc_feature (27)..(27): Xaa can be any naturally occurring amino acid
  unsure (1)..(505): unsure at all Xaa locations
VDPRVRKQMVKDIVKAMKLGVDPLPVXSGLGGAYYFRNKKGDSVAIVKPTDEEPFAPNNPKGFVGKALGQPGLKSSVRVGETGFREVAAYLLDYNRFANVPPTALVKITHSVFNVNDGVKGNKAREKKLVSSKIASFQKFVAHDFDASDHGTSSFPVASVHRIGILDVRIFNTDRHGGNLLVKKVGTFGEVELIPIDHGLCLPETLEDPYFEWIHWPQASIPFSDEEIEYIQKLDPVKDCEMLRRELPMIREACLRVLVLCTVFLKEAASYGLCLAEIGEMMTREFRGGEEEPSELEVVCIEAKRSVTERDVFSPRSDVVIGEAEFQFDLDCDELESVYGSKLQLTDDNFTKNPFSNGRSSLGKLEESIKEEEEEDEDEVEDITENAVPMITLKDSFFSSAAFHEKSTSLSKLSTSMKNTHLSDTGRKNNTKPLTRGKSENTSSGHKSANEQLQVSASFVKVADMKEDEWVLFLERFQELLGPAFAKRKTATLSKRQRLGTSCQF

SEQ ID NO: 20963 - protein, 211 aa, Oryza sativa (japonica cultivar-group)
MGWAARFLTAVSFLAAGVLFAPDALLGGSGRSGAGVAAARLAHVLCFATAWGAALWVTFIGGIVMFKYLPRHQFGSLQGKMFPAYFMLISVCSAISVAAFAYLHPWKTASTIERYQLGFLISALGFDLSNLLVFTPMTTEMMMRRHKIEKDLGIGSEVGFSKNAEVARTNPTLAAMNKKFGMIHGLSSLANIMAFGSLAMHSWYLASKLQI

SEQ ID NO: 20964 - protein, 107 aa, Haemophilus ducreyi 35000HP
METIDKIKQQINENPILLYMKGSPKFPSCGFSARAVEAIIQCQVPFGYVDILTNPDIRSELPKFANWPTFPQLWVEGELIGGCDIILEMFQKGELHTLLKETATKHG

SEQ ID NO: 20965 - protein, 478 aa, Arabidopsis thaliana
MKIELVFIPLPGIGHLRPTVKLAKQLIGSENRLSITIIIIPSRFDAGDASACIASLTTLSQDDRLHYESISVAKQPPTSDPDPVPAQVYIEKQKTKVRDAVAARIVDPTRKLAGFVVDMFCSSMIDVANEFGVPCYMVYTSNATFLGTMLHVQQMYDQKKYDVSELENSVTELEFPSLTRPYPVKCLPHILTSKEWLPLSLAQARCFRKMKGILVNTVAELEPHALKMFNINGDDLPQVYPVGPVLHLENGNDDDEKQSEILRWLDEQPSKSVVFLCFGSLGGFTEEQTRETAVALDRSGQRFLWCLRHASPNIKTDRPRDYTNLEEVLPEGFLERTLDRGKVIGWAPQVAVLEKPAIGGFVTHCGWNSILESLWFGVPMVTWPLYAEQKVNAFEMVEELGLAVEIRKYLKGDLFAGEMETVTAEDIERAIRRVMEQDSDVRNNVKEMAEKCHFALMDGGSSKAALEKFIQDVIENMD

SEQ ID NO: 20966 - protein, 335 aa, Aspergillus nidulans FGSC A4
MGLPVVDFSSWHNVKDERSRQRVAQQLVDACQRVGFVRIINHSLPEGALDEAFEWMKRLFALPEEDKMKAPHPAGWAVHRGYSWPGLEKVTQIMSTDGDGDVKKKLREVPDVKEVYDIGSEDDTSQPNQWLPNAILPGFRDFMVQFYSECDRVGKEILRAIAVGLDLEDAEYLTRKHSGNSNQLRLLHYLPVPAEDLEKDRVTRCAAHTDWSSITMLFQDDCGGLEVEDISRPGTFVPAQPVKDSIIMNIGDLLQRWSNDRLRSTNHRVSLPTLSDRIGGPDRMTRERFSIPYFMSPDDEVLVECIPSCMNDETPAKYEPITRGDYNKMRMSMMY

SEQ ID NO: 20967 - protein, 256 aa, Glycine max
HGVIDPIEELGHLASSFGICFHVDLCLGGFVLPFARELGYHIPPFDFSVKGVSSISVDVHKYGLAPKGTSVVLYRNHEIRKHQFVAVTEWSGGLYVSPTIAGSRPGSLIAGAWAAMISLGKEGYLKNTKEIMEGSRRIQKGIEEIAELFIVGKPDMTIVAFGSAVLDIFEVNDVMSSKGWHLNALQRPNSIHICVTLQHVPIVEDFLNDLKESVKTVKANPGPISGGLAPIYGAAGKMPDRGMVQELLVDYMDGTC

SEQ ID NO: 20968 - protein, 411 aa, Rickettsia sp.
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFGSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 20969 - protein, 411 aa, Rickettsia sp.
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFVIARTVGWMAQWKEMHEDPEQKISRPR

SEQ ID NO: 20970 - protein, 477 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGAATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 20971 - protein, 411 aa, Rickettsia typhi
NLEFAELKIRGKMFKLPILKASIGKDVIDISRVSAEADCFTYDPGFMSTASCQSTITYIDGDKGILWHRGYDIKDLAEKSDFLEVAYLMIYGELPSSEQYHNFTTKIAHHALVNERLHYLFQTFCSSSHPMAIMLAAVGSLSAFYPDLLNFNETDYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSENIPKYVAKAKDKNDPFRLMGFGHRVYKSYDPRAAVLKETCKEVLNELGQLENNPLLQIAIELEALALKDEYFIERKLYPNVDFYSGIIYKAMGIPSQMFTVLFAIARTVGWMAQWKEMHEDPEQKISRPR

SEQ ID NO: 20972 - protein, 434 aa, Brassica oleracea
MAEKSFKYIILGGGVSAGYAAKEFANQGVKPGELAVISKEAVAPYERPALSKGYLFPEGAARLPGFHCCVGSGGEKLLPESYKQKGIELILSTEIVKADLAAKTLVSAAGDVFKYETLIIATGSTVLRLTDFGVKGADSTNILYLREIDDADKVVEAIKAKKGGKAVVVGGGYIGLELSSALRINDFDVTMVFPEPWCMPRLFTADIAAFYETYYTNKGVKIIKGTVASGFTAHPNGEVNEVQLKDGRSLEADIVIVGVGAKPLTSLFKGQVEEDKGGIKTDAFFKTSVPDVYAVGDVATFPLKMYGDMRRVEHVDHSRKSAEQAVKAIKAAEGGGTVEEYDYLPFFYSRSFDLSWQFYGDNVGDSVLFGDSNPSNPKPRFGAYWIQDGKVVGAFMEGGCGDENKALAKVAKARPVAESLDELAKQGISFAAKI

SEQ ID NO: 20973 - protein, 411 aa, Rickettsia honei
GSEFAELKIRGKIFKLPILKASVGEDVIDISMVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNALDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 20974 - protein, 480 aa, Zea mays
  misc_feature (69)..(69): Xaa can be any naturally occurring amino acid
  misc_feature (85)..(85): Xaa can be any naturally occurring amino acid
  unsure (1)..(480): unsure at all Xaa locations
MEVFYYLVFGALAAIVAALELAKSGKDRVATSPAFNSFKNNYILVYSLMMSGDWLQGPYVYYLYSQYGXFDKGDIGRLFIAGFGXSPWLFGTIVGSLADKQGRKRACVTYCITYILSCITKHSPQYKVLMIGRVLGGIATSLLFSAFESWLVAEHNKKGFDPQWLSITFSKAIFLGNGLVAIVAGLFANFLADNNGVFWAPCWLQFDARSLAFVAIRNGHVILSSWRLQNYGDSSDSKDLITQFKGAAKAIASDEKIALLGAIQSLFEGSMYTFVFLWTPALSPNDEDIPHGFIFATFMLSSMLGSSIASRLLARKLKVEGYMQIVFSISAVTLVLPVVTNILVPTSSVKGGSISIGGSLQLLGFCTFEACVGIFWPSIMKMRSQYIPEEARSTIMNFFRIPLNLFVCQNDEFLPIPPNLFVYVVLYNVNAFPITVMFGMCSIFLFMAAILQRRLMVVSDLHKSSTKAQEMIGEDEPLNP

SEQ ID NO: 20975 - protein, 300 aa, Prochlorococcus marinus str. MIT 9313
MSWKVADIPDQKGRVALVTGANSGLGLETAKALLNKGARVIMACRSLPTGEDVRQVILERNDSTKLDLIELDLADLASVRRAAEQVESQYSRVDLLINNAGVMATPKTLSKQGLELQFAVNHLGHMALTLKLLPLLAKQHGARVVTVTSGAQYMGRIAWDDLQGIKQYDRWAAYSQSKLANVMFALELDKRMRQTASGIASLLAHPGLARTNLQPKSVAANKSWQEGLAYRLMDPMFQSAAMGSLPQLHAATAPTAQGGEQYGPRFNFRGYPKLCSVAPLALREEDRQRLWSISEKLLEI

SEQ ID NO: 20976 - protein, 286 aa, Xanthomonas axonopodis pv. citri str. 306
MTHTDIPTPLADWIVAQAVAGHPPEQALQPLLDQGWNEQDAIDAVEALVRAHIQQHAQANGLPMPVRVPALQQDTDASLLALGDREVRVLVSLLLPRVVVLGGFLSDGECDALIALARPRLARSRTVDNANGEHMVHAARTSDSMCLRVGQDALCQRIEARIARLFDWPVDHGEGLQVLRYATGAEYRPHYDYFDPDAAGTPILLQAGGQRVASLVMYLNTPERGGATRFPDAHLDVAAVKGNAVFFSYDRPHPMTRSLHAGAPVLAGEKWVATKWLRERAVRMPT

SEQ ID NO: 20977 - protein, 500 aa, Brassica oleracea
  misc_feature (262)..(262): Xaa can be any naturally occurring amino acid
  unsure (1)..(500): unsure at all Xaa locations
MGRKMLADGELDKAVAAEEATETHYDFDLFVIGAGSGGVRAARFSANNGAKVGICELPFHPISSEEIGGVGGTCVIRGCVPKKILVYGATYGGELEDARNYGWEINENVDFTWKKLLQKKTDEILRLNNIYKRLLANAAVKLYEGEGRIVGPNEVEVRQIDGTKISYTAKHILIATGSRAQKPNIPGHELAITSDEALSLEEFPKRAVVLGGGYIAVEFASIWRGMGGTVDLFVRKELPVRGFDDEMRALVARNLEGRGVNXHPQTSLTQLIKTDDGIKVISSHGEEFMADVVHLLLARNPNTKRLNLEAVGVELDQAGAVKVDEYSRTNIPSIWAVGDATNRINLTPVALMEATCFANTVFGGKPTKADYSNVACAVFCIPPLAVVGLSEEEAVEKATGDILVFTSGFNPMKNTISGRQEKSLMKLIVDEQTDKVIGASMCGPDAAEIMQGIAIALKCEATKAQFDSTVGIHPSSAEEFVTMRTVTRRIAYKAKPKTSL

SEQ ID NO: 20978 - protein, 372 aa, Thiobacillus denitrificans ATCC 25259
MSKRDYYEVLGVAKNASDEEIKKAYRKLAMKHHPDRNPGDHAAEDKFKEAKQAYEILSDSDKRAAYDQFGHAGVDPQSGMGGGGFGGGGFSDAFSDIFGDIFGGGGGNRRDRVYRGADLRYNLEIGLEEAARGTETKIRIPTLEECGTCHGSGAKPGTQPTTCSACGGHGQVRVQQGFFSVQQTCPRCGGTGKMVSDPCPSCHGEGRVKKHKTLSVKIPAGVDSGDRIRLAGEGEAGVNGGPSGDLYVVIHLKDHPVFKRDGDDLHCEMPISFATAALGGEVEIPTLDGHAKIKIPAETQSGKVFRLRGKGIKGVRSHAPGDLLCHMLVETPVNLSERQRELLREFEALSPGRNNNPRAQSFMDKVKSFFGT

SEQ ID NO: 20979 - protein, 1034 aa, Nostoc punctiforme PCC 73102
MIFGSLYPDIPIPKQPLTEFVLQRAINLADKPALIEGLTNRIITYKQLVESIRKIACSLAARGFSKGDVLAIYSPNIPEYAIAFHAVATLGGIITTVNPSYTAEELAYQLNDAGAKHLITIPDLVGQALEAIGHSKVEEVFVFGEAAGATRFSVLLEGEGEIPKVQINPQEDLVALLYSSGTTGMPKGVMHTHHSFVANFHQFQNCEPVSKADAIIGVLPFFHAYGLVMLNYSLACGATVVTMPRFDLEAFVSLIEKHKITRIHIVPPILLALAKQPIVDKYDLSSLRVLTSGAAPLSHQLIEECEQRLTNCVVKQAYGTTETFVTTYTPDERDKIKPGSVGQCLPHVECQIVNVDTQQPLGFNQSGELWVRGPQIMKGYLNNPDATASTINRDGWYHTGDIVYIDEDDYFYIVDRIKELIKCNGYSIAPAELEAVLLSHPAVADACVVKSPHPSSGEVPKAFVVLKAAATAQEIMEFVAGQVAPHKMIRRLEFVDKIPKSPSGKILRRILAQQELTNIKAASSDEQPLEQRLEFLEQLDDGSLGQRQELLIAYIREQFVKVLGINTSQNLDIEKPLHELRLDSLMNIDLKNRIDTELGVDIPIDMLLGNSNINQLVNLLLQQLTAKNTIISKKSSAELATDLNSEVVLDSTIFPEYPSESFVTEPAAILLTGATGFLGAFLLQELLLKTQADVYCLVRSTDARSGKMRIQNNLESYGIWHEDFAERIIPILGDLSQLMLGLSLQDFQKMSSIIDTIYHNAAWINYVYPYSALKPTNILGTQEILRLASRVKIKPVHYISTIAVFESPAYWGKVVTESDQLDHSEGMKLAYSQSKWVAEKLVMLASDRGIPVSIYRSPFISGHSQTGAWYKDDVICRTIKGCIQIGSMTDITDTLDLAPVDYLSQSIVYLSQQKDSLGKAFHLNNPQSISWRELTDFIRSLGYQIEHIAYHDWQTQLNNSVRSQENPLYHLLPFYQKHYQQSTDPKISCLATQNALTVSSIRCPPVNEQLLNTYFSYFLRSGWLGVSLPSNKLA

SEQ ID NO: 20980 - protein, 487 aa, Ralstonia eutropha JMP134
MSPSPTLYRNYVDGRFVESAKGFPNISPVNGAVIGTVCEAGADLVDRAVRAARAALAGPWGRTTPAERARVLQAVADGIEKRFDAFVAAEVADTGRPEHQARTLDIRRGVQNFRTFAELAGQAGGECFEMRAADGDVFSYTVRKPHGVVAIISPWNLPMLLMTWKVAPALACGNAVVIKPSEETPGSATLLAEVMHEAGVPPGVFNLVHGFGGGSAGEFLSRHPDIDAITFTGESRTGSTIMKAVADGVKEVSFELGGKNAAVVFADCDFDQAVAGVTRSSFTNTGQVCLCSERVYVERPIFERFVAAMKARAEAMRIGYPDEDGVEMGSLISHGHRDKVLSYFALAREEGATVVAGGGVPQFGDARDNGAYVQPTIWTGLPDSARCVQEEVFGPVCHIAPFDSDDEVVARVNDSRYGLAASVWTRDLGRAHRVTRQFDVGIVWVNTWFLRDLRTPFGGTRLSGIGREGGRHSLDFYSSTTTICVNP

SEQ ID NO: 20981 - protein, 159 aa, Triticum aestivum
MSSSFSNTLARSYGSMLAVDLKNRSKPEFSTCLPSCRIRHEAHTEKPISPEKEASTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 20982 - protein, 304 aa, Actinobacillus pleuropneumoniae serovar 1 str. 4074
MIELNGEPFGQMRQTYGGDTLNTATYLARVSTPEQIQVCYVSALGTDKLSQGMLAYWQADGIDTQWVLKDEQRSPGLYLIQLDKKGERTFLYWRNQSAARYLLQHSNFPQVLSELDSVDMIYLSGISLAILPENDRKLLITSLAKLKQAGVEIAFDSNFRPKLWESLEQAQACYRELLPLVDVALVTFDDEAMLWQDEDEQQTIARLSAYGIAKIIVKQGSRGAVVCEHLQQTFVPTIPVEHVVDTTSAGDSFNAGFLAGYLQGKPLAVCCRQGNQLAGIVIQHKGAIIDKSATAHLFAQFNAM

SEQ ID NO: 20983 - protein, 180 aa, Brassica napus
RPTRPSRSWSASKQLQALANNLNTPKPNDVAASNGLAVPVYTMTSVLLFVMWVLVAAIPCQDRGLQVNFSVPRHYQWAVPVMSLHDKIVEESKRRDRKNCCGLLKEIDRIEKSSRVMNELVDSIQFPLSEEKESEVKQRVEELVEVHEGLKKGLDPFERKVREVFHRIVRSRTESLDSLC

SEQ ID NO: 20984 - protein, 634 aa, Medicago truncatula
MVLVDHPNVLKSHCSFVSDHNLWVVMPFMSGGSCLHILKAAHPDGFEEVVIATVLREVLKGLEYLHHHGHIHRDVKAGNVLIDSRGAVKLGDFGVSACLFDSGDRQRSRNTFVGTPCWMAPEVMEQLHGYNFKADIWSFGITALELAHGHAPFSKYPPLKVLLMTLQNAPPGLDYERDKKFSKSFKQMIACCLVKDPSKRPSASKLLKHSFFKQARSSDYITRTLLEGLPALGDRMEILKRKEDMLAQKKMPDGQMEELSQNEYKRGISGWNFNLEDMKAQASLINDFDDAMSDISHVSSACSLTNLDAQDKQLPSSSHSRSQTADMEESDEMHNQLASVPEVDSTINDVKTRIEKSDDDSSITSSSHEPQTSSCLDDHVDHSLGDMENVGRAAEVVVATHPPLHRRGCSSSILPEVTLPPIRAESEKLQNLSTNVSSANAILVTHTGDDVLTELPSRASKTSANSDDTDDKAKVPVVQQRGRFKVTSENVDPEKATPSPVLQKSHSMQVGCLEVMSQHNATPLHSPLPLLSPISDATPSNISCCSLFPVLHSVLQTNILQRETILTLMKQITVGESAADNTNAPAQIAAMEKSLLESAHEREKELLHEITDLQWRLICTQEELQKLKTDNAQV

SEQ ID NO: 20985 - protein, 203 aa, Prunus armeniaca
MASTTLRKKEILTDILVRLPAKTLVRFLCACKSWSDLINSSSFITTQLNRNVTKHLHVSLLCLHYPDLKRPFEFYENYEDYPDLKRELEWSLFSNETFEHCSKLNHPLGIKKDYRVYGSSNGLVCISDDKLDTKSPIHIWNPSVRKFRTLPMSTNVKFRYIALQFGFHPGVNDYKVVRMLRVHKDDAFAVEVYSLSTDSWKKG

SEQ ID NO: 20986 - protein, 332 aa, Medicago truncatula
MEERAFHSHCLREGEKREMSRETMYVKHCMGVNGLEKIILRENRGFSAEVYLYGGQVTSWKNERGEELLFVSSKANFTPPRSLRGGIPICFPQFSNFGTLEHHGFARNKLWILDPNPPPFPTNSNSRAFVDLVLKNSEDDTKNWPHRYEFRLRIALGPTGDLMLTSRIRNTNKDGKSFTFTFAYHTYLYVTDISEVRIEGLETLDYLDSLKNRERFTEQGDAITFEGEVDKVYLSTPTKIAIIDHERKRTFEIRKDGLPDAVVWNPWDKKSKIISDLGDDEYKHMLCVQPACVEKAITLKPGEEWKGRQEISAVPSSYCSGQLDPRKVLFHH

SEQ ID NO: 20987 - protein, 186 aa, Arabidopsis thaliana
  misc_feature (108)..(108): Xaa can be any naturally occurring amino acid
  misc_feature (126)..(126): Xaa can be any naturally occurring amino acid
  misc_feature (167)..(167): Xaa can be any naturally occurring amino acid
  misc_feature (174)..(174): Xaa can be any naturally occurring amino acid
  misc_feature (176)..(176): Xaa can be any naturally occurring amino acid
  unsure (1)..(186): unsure at all Xaa locations
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYXREHGNSPGITMMDGYWTXMWEAFPCSGLHRLPVKVLKEVEEVKEGGPPMPLIRAIGLDXTRKASGXGXIAYKPPRFTG

SEQ ID NO: 20988 - protein, 424 aa, Chlamydia muridarum Nigg
MFDVVISDIEAREILDSRGYPTLYVKVITNTGIFGEACVPSGASTGIKEALELRDQDPKRYQGKGVLQAVANVEKVLLPALQGFSVFDQITADAIMIDADGTSNKEKLGANAILGVSLALAKAAAATLERPLYRYLGGAFSHVLPCPMMNLINGGMHATNGLQFQEFMIRPISAPSLTEAVRMGAEVFHTLKKILQNRQLSTGVGDEGGFAPQLASNSEALDLLLAAIEKAGFIPGEDISLALDCAASSFYNTQDKTYDGKSAADQVAVLTELCDRYPIDSIEDGLAEEDFEGWKLLSETLGDRIQLVGDDLFVTNSALIAEGIAQGLANAVLIKPNQIGTLTETAEAIRLATTQGYATILSHRSGETEDTTIADLAVAFNTGQIKTGSLSRSERIAKYNRLIAIEEEIGPEAVFQDSNPFSKA

SEQ ID NO: 20989 - protein, 143 aa, Idiomarina loihiensis L2TR
MALERTLSIIKPDAVAKNLIGAIYNRFESAGLRIVGAKMMHLSKEQAEGFYAEHKERPFFGALVEFMTSGPIVVQVLEGEDAVRKNRDIMGATNPAEALAGTIRADYAETIDENAVHGSDATESAAREISYFFSDEEVCQRTR

SEQ ID NO: 20990 - protein, 400 aa, Roseovarius nubinhibens ISM
MSILSDTLARVKPSPTVAVTTLANELKAAGKDVIGLGAGEPDFDTPEHIRAAGKRAIDEGKTRYTAPDGIAELKQAICDKFKRDNGLDYTPKQVSVGTGGKQILYNALMATLNPGDEVVIPAPYWVSYPDMVLLAGGTPVVAEASLESRFKLTPDQLEAAITPKTKWFIFNSPSNPTGAGYSRDELKALTDVLLRHPHVWVMTDDMYEHLAYDGFEFCTPAEVEPALYDRTLTCNGVSKAYCMTGWRIGYAAGPEPLISAMRKIQSQSTSNPCTISQWAAVEALNGSHEFIAANNEVFKRRRNMVVERLNAIEGITCPTPEGAFYVYPSIAGLIGKVTPGGTKIADDETFAKALLEDKGVAVVFGAAFGLSPNFRVSYATSDAALAEACDRIEAFCKGLS

SEQ ID NO: 20991 - protein, 525 aa, Pseudomonas aeruginosa UCBPP-PA14
MSQDIHAHRILILDFGSQYTQLIARRVREIGVYCEIHPFDMSNEAIIAFAPRGIILAGGPESVHEADSPRAPQAVFDLKVPLFGICYGMQTMAEQMGGKVQGSDVREFGYARVDVVGKARLLDGIEDHVDDDGVLGLDVWMSHGDKVTEMPAGFHILASTPSCPIAAMADDARAYYGVQFHPEVTHTKQGLRILSRFVLDICGCAALWTPSNIVDDAIATVRAQVGSSKVLLGLSGGVDSSVVAALLHKAIGDQLTCVFVDNGLLRLHEGDQVMAMFAENMGVKVIRANAEDKFLGRLAGVADPEEKRKIIGRTFIEVFDEEATKLQDVKFLAQGTIYPDVIESAGAKTGKAHVIKSHHNVGGLPEDMQFELVEPLRELFKDEVRKIGLELGLPYDMVYRHPFPGPGLGVRILGEVKKEYADLLRQADHIFIEELRAFDWYHKTSQAFVVFQPVKSVGVVGDGRRYAWVVALRAVETIDFMTARWAHLPYELLEKVSNRIINEIAGISRVTYDVSSKPPATIEWE

SEQ ID NO: 20992 - protein, 323 aa, Escherichia coli CFT073
MNLEKINELTAQDMAGVNAAILEQLNSDVQLINQLGYYIVSGGGKRIRPMIAVLAARAVGYEGNAHVTIAALIEFIHTATLLHDDVVDESDMRRGKATANAAFGNAASVLVGDFIYTRAFQMMTSLGSLKVLEVMSEAVNVIAEGEVLQLMNVNDPDITEENYMRVIYSKTARLFEAAAQCSGILAGCTPEEEKGLQDYGRYLGTAFQLIDDLLDYNADGEQLGKNVGDDLNEGKPTLPLLHAMHHGTPEQAQMIRTAIEQGNGRHLLEPVLEAMNACGSLEWTRQRAEEEADKAIAALQVLPDTPWREALVSLAHIAVQRDR

SEQ ID NO: 20993 - protein, 519 aa, Arabidopsis thaliana
  misc_feature (338)..(338): Xaa can be any naturally occurring amino acid
  unsure (1)..(519): unsure at all Xaa locations
MASISTPFPISLHPKTVRSKPLKFRVLTRPIKASGSETPDLTVATRTGSKDLPIRNIPGNYGLPIVGPIKDRWDYFYDQGAEEFFKSRIRKYNSTVYRVNMPPGAFIAENPQVVALLDGKSFPVLFDVDKVEKKDLFTGTYMPSTELTGGYRILSYLDPSEPKHEKLKNLLFFLLKSSRNRIFPEFQATYSELFDSLEKELSLKGKADFGGSSDGTAFNFLARAFYGTNPADTKLKADAPGLITKWVLFNLHPLLSIGLPRVIEEPLIHTFSLPPALVKSDYQRLYEFFLESAGEILVEADKLGISREEATHNLLFATCFNTWGGMKILFPNMVKRIXGRAGHQVHNRLAEEIRSVIKSNGGELTMGAIEKMELTKSVVYECLRFEPPVTAQYGRAKKDLVIESHDAAFKVKAGEMLYGYQPLATRDPKIFDRADEFVPERFVGEEGEKLLRHVLWSNGPETETPTVGNKQCAGKDFVVLVARLFVIEIFRRYDSFDIEVGTSPLGSSVNFSSLRKASF

SEQ ID NO: 20994 - protein, 587 aa, Oryza sativa
MAKIEGTMRTTGSAGWRQEIEAAQDQCSVELDGWSMVLVEVAANRELNVGAGRATSSMASCGRSVATAIRRRWQWMTATMGSLFLAMTTSSSPFHTPLYAWTASNPLIPLIFPQTTSAYAGHTDIDSKKKQPGTTHSAIVAPSSSSAVDVSDSNSGSSAMAKKQRREAAARRRREQQQQGREQRHHHHHRRRPLLLQPRDERCVSCTTFNILAPIYKRMDSENCRESQYRAYWFSRNEKIIDRLLADCSSIICLQEVWLGNDELVDMYEKRLGDANYSLFKLARTNNRGDGLLTAVNKNYFHVLNYRELLFNDFGDRVAQLLHVESAMPFWQNRSSSCIQQQSLIVNTHLLFPHDHSLSIVRLKQGFVSSYDTAHQYSDSEEDAHKWVSHRNHRGNICGVDFIWLLNPNKSRKPLKTSWNEAVFGIIKYLLLQVASLSEENAFALLKADSPDDQITYSSFCQALCQLGMVHPDRLNSEEIKDLWSEADHDGDDIVDYKEFQRCIWSPTCCSQEEEDDTEIDISDGSLVTFEANDEAFGFTVKEAVLFPPEVEKGMWPENYSLSDHAPLTVVFSPVRMPCSPRTPRTP

SEQ ID NO: 20995 - protein, 451 aa, Candida glabrata CBS 138
MFKVKTLERRNLKQLSLGGGCLGGSAHAGSEELRHECNGNKLIVEDMALAVGSDEHIEPHSGSGSASASSMSGLSIHDHAGDAAKPATLAVDGHSGCNYDLRDLVQLGKLGSGNSGTVMKVLHVPSSRVIAKKTIVIEQNNAIVKQQIYRELTIMRSVAEHRNIVEFYGAHNLSSDSINGSNDVVILMEYMNCGSLDTITRTYKSLQRRGILAANRSYPVQEWFSKPVIISRIAYSVLNGLSYLYENYKIIHRDIKPSNVLINSKGRIKLCDFGVSRKLNNSIADTFVGTSTYMSPERIQGNKYTTKGDVWSLGLMLIELLTGEFPLGGHNDTPDGILDLLQRIVNEPAPKLPSSVIKVLPPDMVNFIDLCCVKVEKDRGSLQELLKHPFIVRFRTKESTDAFKLWTKDIRRWMQEERNYKKETSEHSMLLKKQHNTNDTRHSRHMTSSLK

SEQ ID NO: 20996 - protein, 330 aa, Ashbya gossypii ATCC 10895
MTLRATKARQQRVSPHIGHTFSFGNLVGDPFAISTLSISTIAWLITLGGGIATKKMPHFSWWGIAFQFVMMVCFVVIYLWDLVDYYRGFLAAGVGVAFVYSTNSCSQLIYQEEPQQAAGSAGFMMLSIVNMIWMFYFGADNAAPANRWIDSFSIRGIRASQVESSLALARSQKAVASPQPAATAFYGGLEGHSQKYVSSTALNGFENTDPHTSTAFALGPEGPTQRNLDTHGTSTYVTDTTNGNTETTMGDTLGLYSDMGDELVNFPYTAKALYAYEADASDAYEISFQQGEILRVGDIEGRWWKAKKANGETGIIPSNYVELVDDPAAL

SEQ ID NO: 20997 - protein, 440 aa, Ashbya gossypii ATCC 10895
MSSSVQSGVLTLLHTACGAGVLAMPYAFRAFGLLAGGAILACCGASAMVGLVLQSHVAQYVPPRQASFFSLAQISNPELSVVFDCAIAVKCFGVGVSYLVVLGDLMPQLAGTVTAAPWLLDRNVQITFWTAAVIAPLCCMRHLHSLKYASMVAVAAVAYLGALVAARAAWPSPELERLRGPVSLGLPPGTSGGAMLSSFPIFVFAYTCHHNMFSIVNELRDNSLGACLRVVVAAIALAVALYATIGGAGYLTFGDHITGNIIAQYPPAPATTLGRAAIAVLVMLAFPLQCHPARASINHIWHYCIPSHTVAPSEASALIRGGSPPADAAEGPGNEPAAVPLGPPRFAAITAALLIASYAVAVSVTSLARVLAVVGATGSTAISFILPGLFGYQLIGSESRADQLPPRTRFLRLLSLLLAAWGLVVMCAGLSAALLFDPTH

SEQ ID NO: 20998 - protein, 370 aa, Silicibacter pomeroyi DSS-3
MRTRAAVAVEAGKPLEVMEVNLEGPKAGEVLVEIKATGICHTDEFTLSGADPEGLFPAILGHEGAGVVLEVGEGVTSLKPGDHVIPLYTPECRQCEYCLSGKTNLCQAIRTTQGKGLMPDGTTRFSMLDGTPILHYMGCSTFSNHTVLPEIALAKVRPDAPFDKICYIGCGVTTGIGAVINTAKAEIGCRAVVFGLGGIGLNVIQGLRLAGADQIVGVDLNPDKVAMATRFGMTDFVNPAEVEGDMVAHLVELTRGGADYSFDATGNVGVMRTALECAHKGWGESIIIGVAPAGAEISTRPFQLVTGRVWKGTAFGGAKGRTDVPRIVDWYMDGKIEIDPMITHTLSLDEINKGFDLMHAGESIRSVVVY

SEQ ID NO: 20999 - protein, 210 aa, Haemophilus ducreyi 35000HP
MTEPTIKLNYHKTRFLTSAPDIRHLPEDNGIEIAFAGRSNAGKSTALNALTNQKSLARTSKTPGRTQLINLFEVEPQCKLVDLPGYGYAAVPEQMKLQWQKALGEYLQKRDCLAGIVILMDIRHPLKDLDQQMIEWAVSAQLPVLLLLTKADKLSQVARNKTAKMVNEAILPFQGDIQVEIYSALNKIGVDKLSNKLDSWFAPIFQQEGK

SEQ ID NO: 21000 - protein, 214 aa, Carica papaya
EMMHTMSLIHDDLPCMDNDDLRRGKPTNHKVFGEDVAVLAGDALLSFSFEHLAVATVGVDPSRIVRAIKELAKSIGTEGLVAGQVVDICSEGMTDVGLEHLEFIHVHKTAALLEAAVVLGAILGGGTDEEIEKLRKFARYIGLLFQVVDDILDVTKSSQELGKTAGKDLVAEKVTYPKLMGIEKSRELAEKLNKDAQEQLRDFDEEKAAPLMAL

SEQ ID NO: 21001 - protein, 425 aa, Silicibacter pomeroyi DSS-3
MKNAEIARRRDAAIARGVGMQTQIYVERAAGSEVWDVEGNRYIDFAAGIAVVNTGHCHPRVMQAVRAQAEAFTHTCHQVLPYESYIRLAERLNDRVPGDFDKKTVFVTTGAEAVENAIKIARAATGRPAVIAFGGAFHGRTFMGMSLTGKVMPYKTGFGAMMPDVYHVPFPVELHGTTTDEALAGIAKLFKTDLDPGRVAAIIIEPVQGEGGFYPAPAALMRGLRALCDSHGILLIADEVQTGFARTGHLFAMEGYDIAPDLTTMAKGLAGGLPLAAVTGRAEVMDAAAPGGLGGTYGGNPLGIAAAHAVLDVIDEEDLCHRANELGSRLKQRLTQVRERVPEIVDVRGPGFMIAAEFNTADGGAPNPDFANAVRAQALSRGLVLLTCGVFGNVIRFLAPLTIPEDVFAEALEILETSILAVKGG

SEQ ID NO: 21002 - protein, 486 aa, Silicibacter pomeroyi DSS-3
MTTLALNDPGLLETRAYVNGVWIEGGARFAVQDPATGDLIAEVADLGAADTAAAIDAAHAAGPGWAALTGKERGAILRRWHDLMIQNADDLATILTAEMGKPWAEARGEILYGASFLEWFAEEAKRVYGETIPGHQRDKRIVVLKQPVGVVGSITPWNFPNAMIARKVAPALAVGCTFVARPAELTPLSALAMAVLAERAGVPAGVFNVIPSQDAAGVGAELCANPKVAKITFTGSTRVGRLLMQQCAPTIKKMSLELGGNAPFIVFDDADLDAAVDGAMIAKFRNNGQTCVCANRIYVQARVYDAFADKLAAKAAQLRVGNGFDTGVTTGPLINSAAVSKVEAHIADALAGGAEVVLGGTRAPLGGTFFAPTVLRDVTRDMLVCREETFGPLAALVRFESEDEVIDMANDSEFGLAAYFYSRDLARVWRMAEALESGMVGVNTGLISTEVAPFGGIKQSGLGREGSRHGIEDYLELKYLCLGGIG

SEQ ID NO: 21003 - protein, 213 aa, Zea mays
  misc_feature (189)..(189): Xaa can be any naturally occurring amino acid
  unsure (1)..(213): unsure at all Xaa locations
MAHHRRRLLHSPSIHLPPHPAAALLFSPLSLTETFPREDTKAPGSRKPIHSIPHKARHKRTKAAMIRTKGEAGTGNVVEAVRHVRSVMGDVRALRSMDDDEVFAYAKRIAAPYDLVMQTKQLGRLPVVQFAAGGVATPADAALMMQLGCDGVFVGSGIFKSGDPARRARAIVQAVTHYSDPTILADVSXGLGEAMVGINLNDPKVERYAARSE

SEQ ID NO: 21004 - protein, 517 aa, Oryza sativa (japonica cultivar-group)
MGPPQQARGGGIDIEACARPIAVDHRIKLPYYFRIAGNLLRQAKIYRDENNLVDLYVILLRYSSLVCETIPKHRDYHTFKLREVDFFRLAPHNQSKLIEVLSELESLKPVVQRQITEHNRARGGAIESNSINGTIAVNNITKQHMTNPYTYQPFVGSNNGSFERPVPGGNHQMAPLMSAQPDRLTRKQLANLPFPKEETLARHSILGPNGLHGQWTGPVTAIKVQYPSNLDIIKSDVSSLFPSVLNQDGQNGPSTISTDSTQIENDDMKSVLSLDDGRWSKLAEECASVPSVSLEEELSQLSIKQPSPPPVLAELERRPIAPSEVADPTPGLAVSETGRYQNLHVPVKLMECFLRVAEANTKRSLETCGVLAGTLKKRTFYVTALIIPKQKSTSDSCEATNEDELFDVQDKGSLFTLGWIHTHPTQSCFLSSIDLHNHYSYQVMLPEAIAIVMAPTDTRRKHGIFHLSDPGGMGVIHDCPERGFHPHKAPLDGSPIYEHCSHVYMNPDVKFDVIDLR

SEQ ID NO: 21005 - protein, 378 aa, Prunus armeniaca
MASAALRKKEILTDILVRLPAKTLVRFLCACKSWSDLINSSSFITTQLNRNVTKHLHVSLLCLHYPDLKRPFEFYENYEDYPDLKRELEWSLFSNETFEHCSKLNHPLGIKKDYRVYGSSNGLVCISDDKLDTKSPIHIWNPSVRKFRTLPMSTNVKFRYIALQFGFHPGVNDYKVVRMLRVHKDDAFAVEVYSLSTDSWKMVEEHPLWLKCTWQNHRGTFYNGVAYHIIEKFPLFSVMSFDSGSEKFEEFIAPDAIRYWSLLYIEVYKDQICLLYYLRLFHCEEEGMSQIEFWVLQEKRWKEMRPFLYPFDYYNVVGFSIDNELLMERSGYGNALYLCNYESKQGRETGIELAISRNDPEQLLFVFTYIESLILLNC

SEQ ID NO: 21006 - protein, 301 aa, Prunus armeniaca
MTFTLRKKEILIDILVRLPAKSLIRFLSTCKSWSDLIGSSIFVSTHLCRNVTKHTHVYLLCLHHPNFERLVDPNDPYLKKEFQWSLFPKETFEECYKLSHPLGMTEHYGIYGSSNGLVCISDEILNFDSPIHIWNPSVRKFRALPMSTNINIKFSCVALQFGFHPGVNDYKAVRMMRTNKSALAVEVYSLKRDSWKMIEAIPPWLKCTLEHHRGTFFSGVAYHIIQKGPMLSIMSFDSGSEKFEEIIAPDAICSLWGLYIDVYKEQICLLFICYGCEEEGMEKADLWVLQEKRWKQLSPFI

SEQ ID NO: 21007 - protein, 556 aa, Brucella suis 1330
MYRYDEFDRDFVAARVAQFKDQVARRLSGELTEDQFKPLRLMNGLYLQLHAYMLRVAIPYGTLSSRQLRKLGSIARTYDRGFGHFTTRQNIQYNWPALKDVPQILAELAEVEMHSIQTSGNCIRNVTADHFAGAAADEVTDPRPLAEILRQWSSLHPEFSYLPRKFKIAIVGSEHDRAAIQVHDIGLQLKKNEAGELGLAVYVGGGQGRTPMVAKKIRDFLPIEDMLTYVTAIVRVYNLHGRRDNKFKARIKILVHETGIEQLTREIDAEWEEIRHGELKLPQRDIDVIESYFRMPDLPQRPEGWEILAVAQKADAEFASWVARNVTAHKHPDYAVVTISLKPVGGIPGDASAEQMELVADVAQTCSFDEIRVSHEQNLVLPHVAKADLPAVYDRLQSGGLVTPNAGLITDIIACPGLDYCALANARSIPVAQRISERFADLDRQLEIGDLKIKISGCINACGHHHVGHIGILGVEKKGEELYQITLGGSADENSAIGEITGRGFSSEEVVDAIETIVDTYLGLRESAEETFLAAYRRVGMEPFKRALYGEIRSAA

SEQ ID NO: 21008 - protein, 383 aa, Arabidopsis thaliana
MRKIQRITQFSDDNNRSQREHIPLDLIVEIVSSLPAKSIVRFRSVSKLWSSIITTPDFTSSVVTRSLSSRPCVLLIFQKHDKLFFFASPVHQKKTCPNVENFQYTIPNNGKLQRCESVHGLIYLETSTNVMFIRNPITKSFFTLPKLDSKEGRPLTGFLGYDPINGKYKVLCILKERNKIGILTLGAQESWRILSKGFLSHYKVTGYAKCIDGVIYYEGSFGDGLRQELAIMSFDLRSEKFSLIKHPKKSSIATCWSSYEGRLALVSSIASGVSLWILEDADNHKQWIYKHFPSHREFIKERWKLKGVTRTGEFIYTSYRAYVLNVEGRVLYQWFRILYVDPKRNSMRVVMHGGIAVDDIRRLDEVGYDLMKDLTVIPNHIQI

SEQ ID NO: 21009 - protein, 201 aa, Dechloromonas aromatica RCB
MSKQALRVGIGGPVGSGKTALTLALCQALREQIDMAVVTNDIYTAEDAKFLVNHSALAPERIIGVETGGCPHTAIREDASINLEAIDRLQRAFPAVELILVESGGDNLAATFSPELSDLTIYVIDVAAGEKIPRKGGPGITKSDLLVINKIDLAPMVGASLEVMAHDAKVQRGERPFVFTNLKTGHGLETIIEFIREKGML

SEQ ID NO: 21010 - protein, 466 aa, Zymomonas mobilis subsp. mobilis
MADHFDLIVLGGGPGGYVAAIRAAQLNLKVALVERVHLGGICLNWGCIPTKSLLRSAEVYHEMQNAEAYGLTSFKPDFDLDKIIARSREVAARLASGVKTLLRKNKVEVISGVGQLTGNQQMRVETTEGEEKILEAKDIIIATGARARQLPNVHSDGKHIWTYHHALKPPAMPKKLLVIGSGAIGIEFASLYADFGAEVSIVEHAPQILPMEDAEVSAYVAKAFKKRGIRILTQSALQNLTPDDEGVTAEIAGADGKVTKERFSHAIVAIGVVANVENIGLDKLGIKLDRGFIAVDGFGRTNVDHVWAIGDVAGAPCLAHKASHQGVIAAEDIAGCDHVHPLNTQNIPGCTYARPQVASVGLTEEKARQQGYNVKIGNFPFIANGKAIAQGATDGFVKTVFDADSGALLGAHMVGAEVTEMIHGYTVARTLETTEAEIMETIFPHPTLSEAMHESVLAAYGRALHF

SEQ ID NO: 21011 - protein, 442 aa, Burkholderia xenovorans LB400
MSQSLAPALEPGASAAAHDDLLYRKVSLRIIPFLFLCYVVSFLDRINIGFAQLQMKHDLGFSDAMYGLGAAVFYVGYVLCEVPSNMLLARFGARRTFTRIMLLWGIASVGMMLVSKPAHFYALRFMLGVFEAGFFPGIVLYLTYWYPARRRAAVLSIFFAGVAVAGVLGGLVSGWIMRDMGGVLGLFGWQWMFVIEGAPAIVLGLLAAFYLVDGPQHATWLTAAEKAQLIAQRDEDRRPSSAAHSSRSFVQALRNPRVYLFAFIYFSLTCASLTLNFWMPLMIRDFGVHDVLAISLYTVIPNAIGAVGLILIARHSDRRGERRRHFAVCTIGGGVALSLLTLHLSSFPAMLAILSLAAVLIFAALPIFWTVPSGYLSGTAAAAGIALISSIGITSGIVSPWVIGLIKTHTGSMDNALYLLTALLFVSGVALLLGVPKDVKHV

SEQ ID NO: 21012 - protein, 466 aa, Candida glabrata CBS 138
MQTGNEENAVPSWYSVPGKEVHSDKAHEHRVALSDVTGLANSNFMHEKLHSNRCSGEPSSTARNSLEINLNHAVESDQENMVSIYASNTLDTPNSNDVSSLLEDQQLESIRRVTQHMSNTSNGDDSDSTTVANKDSHQGDNSNNTSDDALRNEYSEPPVNDDIRRTLMKAYQTYKLAYLDDSDEDNYDPVMVVELASGIFDYMKQLEIKYRPDPYYMDLQSELKPSYRSTLLDWIVQVDERFQLLPETLFLTINIIDRFLSKAAIKLNKFQLVGAVSMFIAAKYEEINCPTMKDFLYMLDNAYTKEEMIDAERFILNTLDFSIGWPGPMSFLRRISKADDYDYNIRTLAKYLLETTIMDARLIGTPPSWLASGAYFLSKTILSYGNEERDAEERSVYETGWTLKHVFYSGYTQEQVFPLSSLILENCRHAQERHSAIWTKYSDRRYHRSSVMVDKWIEVAESKMNS

SEQ ID NO: 21013 - protein, 335 aa, Escherichia coli CFT073
MNNWKRIMSHVELQPGFDFQQAGKEVLAIERECLAELDQYINQNFTLACEKMFWCKGKVVVMGMGKSGHIGRKMAATFASTGTPSFFVHPGEAAHGDLGMVTPQDVVIAISNSGESSEITALIPVLKRLHVPLICITGCPESSMARAADVHLCVKVAKEACPLGLAPTSSTTATLVMGDALAVALLKARGFTAEDFALSHPGGALGRKLLLRVNDIMHTGDEIPHVKKTASLRDALLEVTRKNLGMTVICDDNMMIEGIFTDGDLRRVFDMGVDVRRLSIADVMTPGGIRVRPGILAVEALNLMQSRHITSVMVADGDHLLGVLHMHDLLRAGVV

SEQ ID NO: 21014 - protein, 530 aa, Solanum tuberosum
MASTSLSLPSLKLQFPSHKSSSSRKNSSSHRVSIRPIQASVSERPPYISSPSPSPSPPVKQAKLPTRKVPGDYGLPLVGPWKDRLDYFYNQGKNEFFKSRIQKHQSTVFRTNMPPGPFISFNPNVVVLLDGKSFPILFDVSKVEKKDLFTGTFMPSTDLTGGYRVLSYLDPSEPNHAKLKKLMFYLLSSRRNEVIPEFHNSYSELFETLENELSTKGKARLNAANDQAAFNFLARSLYGINPQDTKLGTDGPKLIGKWVLFQLHPLLILGLPKVLEDLVMHTFRLPPALVKKDYQRLYNFFYENSTSVLDEAEKIGISREEACHNLLFATCFNSFGGIKIFFPNMLKWIGRAGAKLHSQLAQEIRSVISSNSGKVTMAAMEKMPLMKSVVYESLRIEPPVASQYGRAKHDMVIESHDASFEIKEGELLYGFQPFATKDPKIFDRSEEFVADRFIGEEGEKLLKHVLWSNGSETENPSINNKQCAGKDFVVLVSRLLLVELFLRYDSFEIEVGASPLGAAITLTSLRRASF

SEQ ID NO: 21015 - protein, 313 aa, Silicibacter pomeroyi DSS-3
MILCCGEALIDMIAAPTIGGGHGFLPQPGGGALNTAIALGRLGQRVGLVTALSRDMFGQRLAEALTASHVDLSGAARVDRPTTLAFVQLRDGQPEYAFYDENSAGRMLSATELPPLPPEASALCLGGISLACEPGADAYADLLERHGAGRVVLIDPNIRPALVGDEARYRARLGAMIARADILRLSDEDLGWLCPDAPDLRAGARTLLALGPALVVVTRGAAGATGYLPEGAEVSVPAPRVNVADTVGAGDTFIAGMLSALAEQGLLTPAALAGLRAEALKPALTHGARVAALAVSRPGANPPWAHELAPPPG

SEQ ID NO: 21016 - protein, 473 aa, Prochlorococcus marinus str. NATL1A
MSKTSQDVLRQIKDEGIELIDLKFTDLHGKWQHLTVASDLIEESSFTEGLAFDGSSIRGWKAINESDMAMVPDPSTSWIDPFYHHKTLSLICSIQEPRSGEPYARCPRALAQKALDYLGSTSVADAAFFGPEPEFFIFDDVRYNSGEGSSFYSVDTIEAPWNSGRVEEGGNLGYKIQLKEGYFPVSPNDTAQDMRSEMLLLMGELGIPIEKHHHEVAGAGQHELGMKFAPLINAADNVMIYKYIVRNVAKKYGKTATFMPKPVFNDNGTGMHVHQSLWKGGQPLFYGEGTYANLSQTAKWYIGGILKHAPSFLAFTNPTTNSYKRLVPGFEAPVNLVYSQGNRSAAVRIPLTGPSPKAKRLEFRSGDALANPYIAFSAMMMAGIDGIKNQIDPGDGVDVDLFELPSEELSKIDTVPSSLNDALEALKNDSKYLTEGGVFTEDFINNWIELKYEEVQQLRQRPHPHEFTMYYDA

SEQ ID NO: 21017 - protein, 433 aa, Rhodospirillum rubrum ATCC 11170
MTDSKQTVTLVDNRSGKSYEFPILSGSTGPDVVDIRKFYTETGMFTYDPGYTSTGSCSSAVTYIDGDAGILLHRGYAIEDLAMHCDFTEVAYLLLRGELPTAPKKTEFEKIITYHTMVHEQLHKFYDGFRRDAHPMAVMCGVVGALSAFYHDSIDITDPIQRMIAQHRLVAKMPTIAAWAYKYSQGQPFMYPRNNLTYAENFLHMMFATPCEEYKVSPVLARAMDRILILHADHEQNASTSTVRLAGSSGANPFACIAAGIASLWGPAHGGANEAVLKMLTEIGSPDRVDDFVKKAKDKNDPFRLMGFGHRVYKNYDPRAKIMAATCHEVLDELGIVDEPLLEIAMRLEKIALEDEYFIEKKLYPNVDFYSGIIFRAIGIPTSMFTCLFALARTVGWISQWKEMIEDPDQKIGRPRQLYNGATKRDFLPMDKR

SEQ ID NO: 21018 - protein, 143 aa, Brassica napus
  misc_feature (95)..(95): Xaa can be any naturally occurring amino acid
  misc_feature (123)..(123): Xaa can be any naturally occurring amino acid
  unsure (1)..(143): unsure at all Xaa locations
MWMATRSSSGFGHEGSSLSSINFQTNTSSSEMGPYFGRSGGLLGMDMMSNNANTGLVQNGYSSNSSLDSVSGLKVDASLASEWSTEEQLRLEVGXEKYKDKPSIMKYIKIAATLPDKTVRDVXLRCRWMTRKRRKAEEQNCGK

SEQ ID NO: 21019 - protein, 456 aa, Haemophilus ducreyi 35000HP
MSKHYDYIAIGGGSGGIASINRAASYGKKCAIIEAKQLGGTCVNVGCVPKKVMFYGAHIADAINHYAEDYGFDVSLKQFDFKKLVASRQAYISRIHSSYQQVLSKNNVDVFNGFARFVDPKTIEVHYPDGSTENLTADHILIATGGRPTIPEVIGAEYGIDSNGIFALTELPKRVAIVGAGYIAVELAGVFNSFGVETHLFVRQHALLRTQDPLIVDTLLAVLAQQNIKLHTQAISKQVVKNADGSLTLTLQDGRQTEVDCLVWAIGREPTTDVINLAAAGVETNSRGFIKVDKFQNTNVTGIYAVGDIIEGGIELTPVAVAAGRRLAERLFNNKPNEHLDYSLVPTVVFSHPPIGTVGLTEPQAIEQYGAENVKVYTSSFTAMYTAVTQHRQPCRMKLVCIGEQEKIVGLHGIGFGVDEMIQGFAVAIKMGAVKADFDNTVAIHPTGSEEFVTMR

SEQ ID NO: 21020 - protein, 265 aa, Zea mays
  misc_feature (148)..(148): Xaa can be any naturally occurring amino acid
  misc_feature (227)..(227): Xaa can be any naturally occurring amino acid
  unsure (1)..(265): unsure at all Xaa locations
MAKPEGPTIGVKLFVDKEKKKVLFAESDKEFVDVIFSFLTMPLGTIVRLLDKQSQMGCLDQLYNSVEDLNLEYFQTSACKAMLLKPLNAASGHCCRLKINVDGSVPRVVYVCKDTSCSALSDNAFSSFPGTVCKCGKVMESIGQCPKXDGDTETAAASCSEDGVFVKGCLKFIVTHDLQVAPASTSLMMFVFEKFGVLDPAVLEQQVLQFSSEKITCLLKRLLTSKXPLPDHYFEAPVPQDDASLEALGQNLHPKQENEGQVLCN

SEQ ID NO: 21021 - protein, 604 aa, Candida glabrata CBS 138
MSDGSGRYVPPHIRRGGGNSHESAAADGLSGSRYSGNGFFSSPNRGNHKSSGGFFGSRPFNDRRTGQGSRASGSGGFGGSGGRYGWVNGKHVPYPKNPRLEMELFGNATDHVTSGINFDNYDDIPVEASGDNVPEAITEFKSPPLDELLLENVELANFSKPTPVQKYSIPIVTKNRDLMACAQTGSGKTGGFLFPVLSELFLNGPAPLPEHTRHSYMRKCYPSALVLAPTRELAIQIFDEAKKYTYRSWVKPYVVYGGAPIGQQMRDMDRGCNLLVATPGRLNDLLERGKISLVNVKYLVLDEADRMLDMGFEPQIRHIVEDCDMPSVNDRQTLMFSATFPREIQHLARDFLKDYIFLSVGRVGSTSENIQQKVLFVEDYDKNSALLDILINEIDGLTLVFVETKRMADQLTDFLIVQNFKATAIHGDRTQAERERALHAFRNGIANILVATAVAARGLDIPNVTNVINYDLPTDIDDYVHRIGRTGRAGNVGVATSFFNSNSMNIAKELMDLLTEANQEVPQFLVNMVQDSMRFGRGGRNSRTGSNRGRGSNTRDYRHSNKDDWGSLGSSRRGFRSNDNRGFGNNWGSSSGDGFTNKAANSWW

SEQ ID NO: 21022 - protein, 446 aa, Oryza sativa
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 21023 - protein, 112 aa, Prochlorococcus marinus str. MIT 9313
MRRLLSALLAITVCFAAPSWVMAADSAHGGQVFSSTCAACHAGGGNIVDPAKTLQKAALEATLSNYGSGHEEAIVAQVTNGKGGMPSFADVLSAADIADVAAYVEAQASSGW

SEQ ID NO: 21024 - protein, 729 aa, Rhodospirillum rubrum ATCC 11170
MPLTRPRVWPGRPYPLGGTWDGRGVNFALFSEHAEKVELCLFDGDDGRELSRVPLPEYTDEIWHGYLPDVRPGQRYGYRVYGPYAPHAGHRFNPNKLVLDPYARSWGGRLQWTDAHFGYRFGAASEDLTFDTRDNSAFMPKCVIVETAFTWDDDRAPRRPWHDSVLYELHVKGFTIRHPEVPRAIRGTFAGMSTQAVVSYLKSLGITAIELLPVQAFVDERHLVKNNLTNYWGYASLGYFAPQPSYLASGKLGEFKTFVQVMHDAGIEVILDVVYNHTAEGNHLGPTFSFKGIDNASYYRLVPGNERFYADSTGCGNALNLRHPRVLQMVMDSLRYWVREMHVDGFRFDLATTLARDHGRFDPHSAFIEALRQDPVLSTVKLIAEPWDVGDGGYRLGGFPPGFAEWNDRYRDTVRRFWKGDRGQVADLATRLTGSSDLFANRGRCPWASINFVTAHDGFTLADLVSYNGKHNEANGENNRDGTDNNNSWNHGIEGPTSDPSIQALRRRQVRNFLATLLLSQGVPMLVAGDEFGRSQRGNNNPYCQDNEISWINWAAIDAEGQSLARMVRWLIRLRRRHIVFHRNRFFHGTTLRGTDVKDITWLEPDGRERSDARDWTDPEERFLAFLIRGEAGEYFVTEMGDPEPDHSFLVALNADSRPVPMLLPVLTAGTRWVLLFDTARPGAERRPAPADGKMYSVEGRSLTVFRREPGLRDGDGDGPWELDGFPEV

SEQ ID NO: 21025 - protein, 381 aa, Acidobacteria bacterium Ellin345
MADAVILGIESSCDETAAAVIRNGAEILSSVVFSQIYTHMRYGGVVPELASREHLKAIVPVVRQAVEDAGQSYDKIDAIAVTRGPGLAGALLVGVSYAKALSFALDKPLIGVNHLEGHIHVVLLEQKQQGVGEIQFPVLALVVSGGHTHLYLAEKKDAGWTYRDVGHTRDDAAGEAYDKVAKLLGLGYPGGPILDGLAKHGDPRAVRFPFAQIKHRDRNPQNRHEDDDARVDFSYSGIKTAVLRYVETHEMKAAIEARRTALKEIEKPSQDDYLRVCDRQTLDLIASFQRAVVNDLVSKALHAAAENNAATLLVTGGVAANSELRETFERRAGELGLPVYFPSRPLSTDNAAMIAAAAYPRFLSGEFAAPDLSAEANLRLR

SEQ ID NO: 21026 - protein, 398 aa, Thiobacillus denitrificans ATCC 25259
MELSRRVQAIKPSPTLAVTARAAALKATGRDIIGLGAGEPDFDTPQHIKDAAIKAIDGGFTKYTAVDGTPSLKAAIIAKFKRDNGLDYTPKQILVSCGGKQSFFNLVQAVIDPDDEVIIPAPYWVSYPDIVILADGKPVIVEAGIEQGFKITPAQLEAAITPKTRLFVINSPSNPTGAVYSKDELAALGDVLRRHPRVLIASDDMYEHIRLDGAPFVNILNACPDLYDRTLVLNGVSKAYSMTGWRIGYAAGPEAILRAMTNVQSQSTSNPTSISQVAAEAALNGDQGCITPMLDAFKARHRFVVDALNAIPGFKCVDSGGAFYAFPDVRPAIQALLARDVIEQGTDIAFSEYLLESADVAVVPGSAFGAEGYIRLSFATSQANLDKALKRIAQAIAG

SEQ ID NO: 21027 - protein, 418 aa, Xanthomonas axonopodis pv. citri str. 306
MQPSSLADLTRAAQRQQPGAINALAQALVRAGQPEDAFAWYSRSAAAGDALAQVEAGRMRAYGVGCEMDVGQARAHWELAERQGAAAARYLLATLAVGEQPLALAGTAQDRLQSAAAADYPPALRAIAIQRGRVAHPERQRHCVALLERAAAGGDAVSAALLAERLLRGEGVPPQPDAAAQLLQQLQPLGMTALPAVDIAPPDPADDTADHRIAFAPRVGPVRRHTAPRIEEYAAVLSADECRLLMLLARPHLRASKVIDPNDASTQRAPIRTSRGATLDPIIEDFAARAAQARLAACAQLPLAHAEPLSVLCYAPGEQYRAHRDYLPPGTIAADRPTAGNRQRTVCVYLNDVGAGGDTEFPIAGVRVRPRPGTLVCFDNLHADGRPDADSLHAGLPVTAGSKWLGTLWFRQQRYRHW

SEQ ID NO: 21028 - protein, 143 aa, Rhodospirillum rubrum ATCC 11170
MKNTSALAETAALWAAVRFTADGLVPVIAQQHDSGEVLMMAWMNREALEETLVTGKACYWSRSRGRLWRKGESSGQTQKVLALRLDCDGDTILLLVDQTGVACHTGRRSCFFNEVGPTGEITVVSAPLVTPEALYGAEGHSHP

SEQ ID NO: 21029 - protein, 341 aa, Neisseria gonorrhoeae
MGIKVAINGYGRIGRQVLRSIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 21030 - protein, 198 aa, Ashbya gossypii ATCC 10895
MFHLAQGLYRNWNKKEHYSVLILGLDNAGKTTFLEQLKAVYHLYAKPLEKIVPTVGQNVATVPLDKTTLLKFWDVGGQEALRAMWSEYYVQTHGIIFIIDSTDRERLQECCDSLRSIVTDDGVEGVPILMLANKQDREDKMELHDIKQVFNKLALHLEARDSRVLPISALTGEGIQSAAEWLLVRLKRNKQTRPPIYK

SEQ ID NO: 21031 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGSFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 21032 - protein, 341 aa, Neisseria gonorrhoeae
MGIKVAINGYGRIGRQVLRAIYDYQIQDQLQIIAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGTLKGVLGYNTLPLVSMDFNHTTEASHFDATLTKVVDGNMVKVFAWYDNEWGFSCQMLNTARRMFGLEVRP

SEQ ID NO: 21033 - protein, 495 aa, Mycobacterium tuberculosis H37Rv
MTGRCPTVAVVGAGMSGMCVAITLLSAGITDVCIYEKADDVGGTWRDNTYPGLTCDVPSRLYQYSFAKNPNWTQMFSRGGEIQDYLRGIAERYGLRHRIRFGATVVSARFDDGRWVLRTDSGTESTVDFLISATGVLHHPRIPPIAGLDDFRGTVFHSARWDHTVPLLGRRIAVIGTGSTGVQLVCGLAGVAGKVTMFQRTAQWVLPWPNPRYSKLARVFHRAFPCLGSLAYKAYSLSFETFAVALSNPGLHRKLVGAVCRASLRRVRDPRLRRALTPDYEPMCKRLVMSGGFYRAIQRDDVELVTAGIDHVEHRGIVTDDGVLHEVDVIVLATGFDSHAFFRPMQLTGRDGIRIDDVWQDGPHAHQTVAIPGFPNFFMMLGPHSPVGNFPLTAVAESQAEHIVQWIKRWRHGEFDTMEPKSAATEAYNTVLRAAMPNTVWTTGCDSWYLNKDGIPEVWPFAPAKHRAMLANLHPEEYDLRRYAAVRATSRPQSA

SEQ ID NO: 21034 - protein, 427 aa, Triticum aestivum
MDQDPKERLLLPPRAASNGPHRRGKPAAPGGGGGGGGVTIDVHGLKKRGGGRRSWVRVDAATGAAEAVEVAKPALMRRLDLPARDLRLLDPLFVYPSAILGRERAVVCNLERIRCIITADEALVLRDPDADGGAAAEEAVRRYVDELQRRLVDRADDLPFEFIALEVALEAACSFLDAQAVELEAEAYPLLDELTAKISTLDLERARRLKSKLVALTRRVQKVRDEIEQLMDDDGDMAEMYLTEKKMRMEASSLDEEGLQGIAGNNVFGASVSAPVSPVSSPPAPRRLEKQFSFARSRHSSFKSSESSQYNIEELEMLLEAYFVVIDYTLSKLTSLKEYIDDTEDFINIQLDNVRNQLIQFELLLTTAFVVAIFGVVSGVFGMNFEGVAVLKVPHAFEWTLIITCVCGAVIFACLLWYFKKRRFFPL

SEQ ID NO: 21035 - protein, 334 aa, Idiomarina loihiensis L2TR
MSRTITVIPGDGIGPDIVESATAILDKAGCDFEYEYVDAGLTALEKTGELLPQNTLDAIERNGVTLKGPLTTPVGEGFTSINVSLRKHFSLYANVRPVLSFTGTQARYENIDIITIRENTEGMYSGLGQKVSEDGNEAEAVSKITREGAERIVRFAYETARREGRKKVTAVHKANILKSTSGLFLKVAREIAEEYPDIESTEMIVDAACMRLVMNPEEFDVIVTTNLFGDILSDLCAGLVGGLGMAPGANIGKDCAIFEAVHGSAPDIAGKNLANPTSVILASIQMLEYLGMQEQAEKITKALEDVISSGDRTTRDLGGSHGTTDFTQAVIERL

SEQ ID NO: 21036 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 21037 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGSFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 21038 - protein, 431 aa, Mycobacterium tuberculosis H37Rv
MADTDDTATLRYPGGEIDLQIVHATEGADGIALGPLLAKTGHTTFDVGFANTAAAKSSITYIDGDAGILRYRGYPIDQLAEKSTFIEVCYLLIYGELPDTDQLAQFTGRIQRHTMLHEDLKRFFDGFPRNAHPMPVLSSVVNALSAYYQDALDPMDNGQVELSTIRLLAKLPTIAAYAYKKSVGQPFLYPDNSLTLVENFLRLTFGFPAEPYQADPEVVRALDMLFILHADHEQNCSTSTVRLVGSSRANLFTSISGGINALWGPLHGGANQAVLEMLEGIRDSGDDVSEFVRKVKNREAGVKLMGFGHRVYKNYDPRARIVKEQADKILAKLGGDDSLLGIAKELEEAALTDDYFIERKLYPNVDFYTGLIYRALGFPTRMFTVLFALGRLPGWIAHWREMHDEGDSKIGRPRQIYTGYTERDYVTIDAR

SEQ ID NO: 21039 - protein, 755 aa, Kluyveromyces lactis NRRL Y-1140
MPALTLTTADSFIPPDVNNPPFYIPLKNIDARYNVIQELGKGSFGSVTLAETMYDMNSSATQISSMYPETLMDQTLIRNVEQENWYYKKKGIVAIKTMMNRLPTLHDYTRVREIKFILQIPAHKNLVTIYEMFIDDSLYHLHIVMECMEQNIYQLMKHRKRRVFSLPTLRSILFQILAGIKHIHDHDFFHRDIKPENILISPSHRYFSKKWLEDDNYSDNYVVKLADYGLARHVNNRSPYTTYVSTRWYRSPEILLRKGYYSKPLDIWAYGCVVVELATFSPLFPGSDETDQIWRILDLLGSPDHSINGKEHFGGSWLDSKPLYQALNYEFPYVEGKTIRDVLPNPQLEDLYDVVTSCLKWNPSERATANEICALPYFKEYVMREASLAKTNNGTASKNKDNTALANKLAANPSISNQWSRILSGLPHNPELGIVPSFNSPQKLPKVQKNNQMNCVTDKSQQQPRRGGVASWFKFSTQKNHVNINPNTNNDEKILTSVNTNTNSQKNQGIVEKKQQEQQVNAHNERLDSSTNANGNSIPDINLIGHANNDNEVFTIELDDSMETMTGSDQISKELNDKIELYQDTTNQMNPPTLDVDDDDDEHDSIDMDHENYRIQVLDEFDTDENLEHEIRATDKDENNEVAVDKMKISNQGEDEDDADSLLNYYQDMMAKKLPLNKNKGNYMHSNGPAGPTLSDQMAIDDSLDLQEQIPRNLLERAVQQRVLDCLLDPSEHASQNLIQTSNSHNHTFQDGLSF

SEQ ID NO: 21040 - protein, 217 aa, Coprinopsis cinerea okayama7#130
MSRQATIQRKTGETDIDVSIDLDCQPGSNNVQSINVSTGIGFLDHMFTALAKHGGWSLTLKCKGDLWIDDHHTADMSMYRVTLYSTLTPAAQDCAIALGTAFKQALGEVRGIRRYGTGYAPLDEALSRAVIDICSRPYCFTDLKFKREKIGDLSTEMIPHIFYSFAMASGATLHVDVIRGENDHHKSESAFKALAIAIRQAIERTGGTDVPSTKGVL

SEQ ID NO: 21041 - protein, 349 aa, Glycine max
MFGSAQPSSSPFGTPAFGTPSSTPAFGSSLFSTPFSSQQPQPQQQQQQQTPLFQQQQQQQTSSAFGFQNSLAFAAPQSSPFPNAQLTTQMANVAPVPFSLADRDVQTIVDAYKDDPGNPKYAFKHLLFSVTEPQFRVKPAGVSDIMWAEAIGKLQGMESPDRERLWPQLVQGFKDLSQRLKIQDEVIVSDAERLRITQSNVKMLQRHFQADTLPWIKRLKQKEQILQQHLLRVMRIVEALEEKGCRIPLTKGEAELAEKLATITRKLKGSGAELSRRVQNLLIVSRVKANSNGFGSSVYLPGSTKIHEQSLGDLQEVLQQQLEAIARLGNVLKRDIRDMEIMMTEDTKN

SEQ ID NO: 21042 - protein, 219 aa, Citrus cv. Murcott x Citrus aurantium
ATLVVSGDGRYYSKDAIQIITKMAAANGVRRVWIGQNGLLSTPAVSAVIRERVGSDGSKATGAFILTASHNPGGPSEDFGIKYNMDNGGPAPEGITDKIYENTKTIKEYSIAEDLPDVDISAVGVTSFGGPEGQFDVEVFDSASDYVKLMKSIFDFELIRKLLSSPKFTFCYDALHGVAGAYAKRIFVEELGAQESSLLNCTPKEDFGGGHPDPNLTYA

SEQ ID NO: 21043 - protein, 146 aa, Prochlorococcus marinus str. MIT 9313
MSTPVLSVVPATSLQEAVQLLSDHHISGLPVVNDDGTLVGELTEQDLMVRESGVDAGPYVLLLDSVIYLRNPLNWDKQVHQVLGTSVNDLMRSDTHTCNEALPLPRAAAMLHDRSTQRLFVINDQRKLVGVITRGDVVRALSMQGD

SEQ ID NO: 21044 - protein, 515 aa, Shigella flexneri 2a str. 301
MCSIFGVFDIKTDAVELRKKALELSRLMRHRGPDWSGIYASDNAILAHERLSIVDVNAGAQPLYNQQKNHVLAVNGEIYNHQALRAEYGDRYQFQTGSDCEVILALYQEKGPEFLDDLQGMFAFALYDSEKDAYLIGRDHLGIIPLYMGYDEHGQLYVASEMKSLVPVCRTIKEFPAGSYLWSQDGEIRSYYHRDWFDFDAVKDNVTDKNELRQALEDSVKSHLMSDVPYGVLLSGGLDSSIISAITKKYAARRVHHEIHFTVQEGLDAIRDVIYHIETYDVTTIRASTPMYLMSRKIKAMGIKMVLSGEGSDEVFGGYLYFHKAPNVKELHEETVRKLLALHMYDCARANKAMSAWGVEARVPFLDKKFLDVAMRINPQDKMCGNGKMEKHILRECFESYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 21045 - protein, 875 aa, Zea mays
  misc_feature (223)..(223): Xaa can be any naturally occurring amino acid
  misc_feature (244)..(244): Xaa can be any naturally occurring amino acid
  misc_feature (576)..(576): Xaa can be any naturally occurring amino acid
  misc_feature (748)..(748): Xaa can be any naturally occurring amino acid
  unsure (1)..(875): unsure at all Xaa locations
MFGNIGKIPIIGDLTGSNKNAHLKGNVVLVRKTVLGLDVTSIAGSLLDGIGEFLGRGVTCQLISSTVVDPNNGNRGKLGAEASLEQWLLNPPPLLSSENQFRVTFDWEVEKQGIPGAIIVKNNHASEFFLKTITLNDVPGHGTIVFVANSWIYPQSKYRYNRVFFSNDTYLPSQMPAALKPYRDDELRNLRGDDQQGPYQEHDRVYRYDVYNDLGLPDSGNPXRPVLGGTKELPYPRRCRTGRXKPTKSDPNSESRLTLVDGDVYVPRDERFGHIKKSDFYGYAIKALVNAVIPAIRTYVDLSPGEFDSFKDIMKLYEGGIQLPKIPALEDLRKQFPLELVKDVLPVGGDYLLKLPMPQIIKEDKTGWMTDEEFGREILAGVNPMLVKRLTEFPPRSSLDPSKYGDHTSTIREADLENKLEGLTVQQALHGNRLYILDHHDNFMPFLVRVNSLEGNFIYATRTVLFLRGDGTLVPVAIELSLPELRDGLTTAKSTVYTPKSTTGAEAWVWHLAKAYANVNDYCWHQLISHWLNTHAVMEPFVIATNRQLSVTHPVHKLLLPHYRDTMNINSNARPXLVNAGGIFETTVFPRQYAFEMSSVIYKDWNFTEQALPDDLIKRGMAVADPSSPYKVRLLVEDYPYASDGLAIWHAIEQWVTEYLAVYYPNDGVLRADVELQAWWKEAREVGHADLKDAPWWPKMQTVAELVKACTTIIWIASALHAAVNFGQYPYAGYLPNRPSVSRKPMPXPGSDEYAELERKPEKVFVRTITSQFQALVGISLLEILSSHSSDEVYLGQRDTKEWTSDAKAQEAFKRFGARLTEIEKRVVTMNADPRLKNRNGPAEFPYTLLYPNTSDTKGDAAGITAKGIPNSISI

SEQ ID NO: 21046 - protein, 110 aa, Arabidopsis thaliana
  misc_feature (100)..(100): Xaa can be any naturally occurring amino acid
  unsure (1)..(110): unsure at all Xaa locations
MACVTALEAALLPCLPARELQAIDRSPHPSHQIDVERHARDFMEAAKKLQLYFMGLKREDRAPSRAESLKKDIAVMEEELKTKDELIKKHMRLFQESQKXEKHRDELEKV

SEQ ID NO: 21047 - protein, 347 aa, Gibberella zeae PH-1
MTDDTHRKIWQPLHPTIRDRLDPQYVAYHEAHLQYIEPDEIKDWDGSTRTKKVSLPPGGTKPVPVGSIDDYHVGRFKVRVYTPTGQCDERGWPVLVWLHGGGWAVGGLNNGTDLCCWACEKARCLVVSVDYGLAPENPFPVAVEDSIDAVRWVASCPAQLQKIDTSRISVSGTSSGANLAIVAALSASNPEAALPTARPSLSNTIAHPPVSLLLFIPVVDNTATVDGVWKPNAEVAPWLTPSRMEWYRKLYFTQDEHRSRWDASPNLAPDTLLKKLPKTWIAIAEMDILATEASTFSQQLKGLGVNVETLLVEGGTHSILSLHGVIDRGYKMIEDAIKHLQETFGTG

SEQ ID NO: 21048 - protein, 581 aa, Ashbya gossypii ATCC 10895
MGIRLQSSDSMNNQHQTQQNKYFNVSNQASTRSLWSQQQQQQLLDTKGSASTSKSPMLMANNNVFSIGPYRQRKDAGRVSVLEKYEIIGYIAAGTYGKVYKAKAKETQEEQENSIHTHNQTLGSVSVAGIDGGMASREVENGGDDPLRLDGHGGIAVAPAAGGGLSSAAAHRARSNGAVKALPKKSAFTPFYAIKKFKTEREGVEQLHYTGISQSACREMSLCRELDNKHLTKLVEIFLERKSIYMVSEFAEHDLLQIIHFHSHPEKRLIAPRMLKSIMWQILDGVSYLHQNWILHRDLKPANIMVTVDGCVKIGDLGLARKFYNLVQTLYTGDKVVVTIWYRAPELLLGARHYSPAIDLWAVGCIFSELIGLRPIFKGEEAKMDSKKSVPFQGNQLQRILEVLGTPTHHTWPNIHKYPEYEQLSKFSKYRDNLSVWYHSSGGRDKAALSLLYSLLKYDPITRIDAIDALEHEYFTNNDPPVSSDVFEGLSYKYPPRRIHTSDNDIMNVGANKNKSGFNHHPPQQQTVNNNGVTNSSIGGLGVNRRILAAAAAAAAAVQVNGTNIVSGSSSSNGPIRKKKR

SEQ ID NO: 21049 - protein, 316 aa, Medicago truncatula
MEPLMISNPNLFDCCKCFQPLTIPVFQCDNGHIVCSTCCTKLRNKCHECSLRISSKRCKAIENILLSIEMPCPNANHGCKEKISYTGNRKHEDECIYFPCYCPLSGCDFAASSEVLSNHFSHKHGDSRIKFSYGHSFNVSLKSNDETIVLQEETEGKLFILNNRTTLLGNGVNICCIGPNSSESEYSYDILARSQICKLTLQSFVKNVQEVALATPSSELLVIPFGSSEPLKLDICITPMMQIYVEDLIGKTIPLRVESSDTIVDVKKKILDKEGIPIHEQRLINDGKQLEDNLTLASYNIQENSTILLVLRLHGS

SEQ ID NO: 21050 - protein, 170 aa, Arabidopsis thaliana
  misc_feature (36)..(36): Xaa can be any naturally occurring amino acid
  misc_feature (86)..(86): Xaa can be any naturally occurring amino acid
  unsure (1)..(170): unsure at all Xaa locations
VATEESSGEVTDRGLFDFLGGNKDYLKPEETPIASXFEYKVHISQPDPEVKHESFLEKLQRSDRSSSSSREEEGSDGEKRKNKKEXRKPATEVEAQDEEKKGFMEKLKEKLPGRHKPEYGSRVAAAPVVVPPPVEEAHPEKKKGILEKIKEKLPGYHPKTTVDEEKIDNE

SEQ ID NO: 21051 - protein, 339 aa, Kluyveromyces lactis NRRL Y-1140
MKRGKTQSLFQTLQQRLVNLEPLDCTAMPLVLLTGFPSSGKTTVAKKLVTLLQETIDSNDKLSNYSVVYHSDETLNISHDDYIGSNEERRARSKIMSVVKRDLSRQKVVIVDSLNYIKGFRYQLHCEVKNVMTTYCLIHTVCPMSNLVEWNEKETDLHKPWESNFLNALIQRYEEPNPQTRWDSPLFTILTSQDDISTLYTDISKAIFPTVFKPATNDRDTEKILQQLKPNNATILKAASHTNSLQILDSEASSVIKIIMKYMQQNVVSGGTSRIILTPENTDLNDPNCLYVDLSLQNCSMPQLQRIKRQFVAMNRLRNLEQDRVKPLFVEYLNKHLNV

SEQ ID NO: 21052 - protein, 218 aa, Alteromonadales bacterium TW-7
MSLQAVLFDMDGTLVDSEAMHFVCWSTLLAPFEVSYLEDEFCQRFSGRPTLEAAIEIKSENNLSVSAEFLAAEKYRLFGEYVKTNLPPLMPYVEQTLKAVKNSGLKMALVTGSATSEAMPILKGLGFYELFDTLVTKDDVINPKPAGDPYLLALKQINVKSENAIAVEDTFTGVSAANNANLRVVAIANSHTKDHDFSKATYCMGNLDEFWQWVQSQL

SEQ ID NO: 21053 - protein, 388 aa, Clostridium perfringens SM101
MSKKEIVAMILAGGQGSRLGVLTKNLAKPAVPFGGKYRIIDFPLSNCSNSGIYTVGVLTQYKPLKLNEHIGIGDTWDLDRRDGGVSILPPYQKEKGGDWYKGTANAIYQNIEFIERYDPEYVLILSGDHIYKMDYDKMLEMHKQKEADATIAVINVPMHEASRFGIMNTNEDLSIYEFEEKPEHPKSTNASMGIYIFNWKILKKFLEEDELDPSSSNDFGKNIIPKMLNSGKKLIAYPFNGYWKDVGTIESLWEANMDLLKYEDELSLYDSEWKIYSANPVRPAQFIGKDAEIKSSLTVEGCIVHGKVENSVLFQGVYVGKGAIVKDAVIMPNTKIEDNVLIEKAIIGSEAIVCKGCKIGDGNKISVIASKEVVIGSKEIIEECAMVK

SEQ ID NO: 21054 - protein, 736 aa, Agrobacterium tumefaciens str. C58
MSSHTPKLDSCGAEPIHIPGAIQEHGALLVLSAREFSVVQASDNLANYIGVDLPIGAVATEANLPFISVLSAWYSGEESNFRYAWAEKKLDVSAHRSGTLVILEVEKAGVGESAEKLMGELTSLAKYLNSAPSLEDALFRTAQLVSSISGHDRTLIYDFGLDWSGHVVAEAGSGALPSYLGLRFPAGDIPPQARQLYTINRLRMIPDVDYKPVPIRPEVNAETGAVLDMSFSQLRSVSPVHLEYMRNMGTAASMSVSIVVNGALWGLIACHHATPHSVSLAVREACDFAAQLLSMRIAMEQSSQDASRRVELGHIQARLLKGMAAAEKWVDGLLGGEGEREDLLKQVGADGAALVLGDDYELVGNTPSREQVEELILWLGEREIADVFATDNLAGNYPTAAAYASVASGIIAMRVSELHGSWLIWFRPEVIKTVRWGGDPHKTVQESGRIHPRKSFEIWKEQLRNTSFPWSEPELAAARELRGAIIGIVLRKTEEMADLTRELQRTNKELEAFSYSVSHDLRAPFRHIVGFAQLLRERSDALDEKSLHYLQMISEAALGAGRLVDDLLNFSQLGRTQLTLKPVDMQKVVSEVRRSLSHAVSDRQIEWRIGALPVIFGDPTLLRQVWYNLIENAIKYSSREPVSIITISAVETEDDVTYSVEDNGVGFDMAYYNKLFGVFQRLQRVEDFEGTGIGLALVRRIVERHHGLVGAEGTVGEGATFSFTLPVTKVEEEKIA

SEQ ID NO: 21055 - protein, 272 aa, Solanum lycopersicum
MGTLTTSLVVPSKLNNEQQSSIFIHKTRRKCKKNQSIVPVARLFGPAIFEASKLKVLFLGVDEEKHPGKLPRTYTLTHSDITSKLTLAISQTINNSQLQGWYNRLQRDEVVAEWKKVKGKMSLHVHCHISGGHFMLDLFARLRNYIFCKELPVVLKAFVHGDENLLRNYPELQEALVWVYFHSNIQEFNKVECWGPLRDATSPSSSSGGVGGVKSTSFTSNSNKKWELPKPCEEACACCFPPVSVMPWLSSNLDGVGEENGTIQQGLQEQQS

SEQ ID NO: 21056 - protein, 204 aa, Zea mays
MADAKQQQQQPQQATAAATGVWKTVKPFVNGGASGMLATCVIQPIDMVKVRIQLGEGSAGQVTRNMLANEGVRSFYKGLSAGLLRQATYTTARLGSFRVLTNKAAEKNEGKPLPLIQKAFIGLTAGAIGACFGSPADLALIRMQADSTLPAAQRRNYKNAFHALYRISADEGVLALWKGAGPTVEKFLLVLEPALFLDSSPQHA

SEQ ID NO: 21057 - protein, 198 aa, Coprinopsis cinerea okayama7#130
MHTSEYDYLFKLLLIGDSGVGKSCLLLRFADDTYTESYISTIGVDFKIRTIELEGKTVKLQIERFRTITSSYYRGAHGIIVVYDVTDNDTFSNVKQWLSEIDRYASEGVNKLLVGNKSDLTGKKVVEYSVAKEFADQLNIPFLETSAKNATNVEQAFLTMAKQIKDRMGSTSTPSGAAKSSTVTPGQTVQSQTGGGCC

SEQ ID NO: 21058 - protein, 216 aa, Citrus cv. Murcott x Citrus aurantium
YGNTLSISEIKMADIPDVDLSSLGVTNFGNFSVEVVDPVSDYLELMENVFDFPLIRSLLSRSDFRFVFDAMHAVTGAYAKPIFVEKLGAKPDSILNGVPLEDFGHGHPDPNLTYARDLVAIMYGENGPDFGAASDGDGDRNMILGKGFFVTPSDSVAIIAANAQEAIPYFKSGPKGLARSMPTSGALDRVAEKFKLPFFEVPTGWKFFGNLMDAES

SEQ ID NO: 21059 - protein, 206 aa, Brassica napus
  misc_feature (17)..(17): Xaa can be any naturally occurring amino acid
  unsure (1)..(206): unsure at all Xaa locations
MMCQVLQTNLLATFLQXEGFWTDTENAIRNAYRSTDAVILQQSLKLGKGGSTAVTGILIDGQKLVVANVGDSRAVMSKNGVAHQLSVDHDPSKERKDIEKRGGFVSNIPGDVPRVDGQLAVARAFGDKSLKIHLSSEPDITHQAIDEQTEFIVFASDGIWKVMSNQEAVDVIKSVKDPQAAAKHLIEVAISKKSKDDISCIVVKFH

SEQ ID NO: 21060 - protein, 331 aa, Coprinopsis cinerea okayama7#130
MASPAPSTPSLSTPVPQSAGGASVAAAAPARSSSQREAGNLGTFGVKSGLAQMLKGGVIMDVVNAEQARIAEEAGACAVMALERVPADIRKEGGVARMSDPKMIKEIVDAVTIPVMAKVRIGHFVEAQILQAIGVDYIDESEVLTPADEEHHINKHNFKVPFVCGCRNLGEALRRISEGAAFIRTKGEAGTGNIVEAVRHERAVMSDIKKASVMSDEELYVFAKEIQAPFHLLKETARLKRLPVVNFAAGGIATPADAALMMQLGCDGVFVGSGIFHSGDPAKRARAIVQAVTHYNNPKILAEVSEDLGEAMVGLTISDNIEGGRLAGRGT

SEQ ID NO: 21061 - protein, 277 aa, Oceanicola granulosus HTCC2516
MTEAKIPLAGVLGHPIAHSKSPRLHKYWLRRHGLPGDYVPMDVHEQNLETVLRALPKAGFVGVNVTIPHKVAALELADQVSDRATLIGAANTLSFGADGRIHADNTDGYGFLENIRHAAPSWSPAAGPAAVLGAGGAARAVIASLLDAQVPRILLTNRTRPKAEALRAEFGARVQVVDWVQAGNMLEEATTVVNTTSLGMVGAGEFRIPLDGLQPGAVVSDLVYTPLRTRLLETAEAAGCIAVDGLGMLLHQAVPAFERFFGVRPEVDDELRRVIQP

SEQ ID NO: 21062 - protein, 762 aa, Candida glabrata CBS 138
MDSSFEILPYRGDDQIPRVDSGGLRRRASQTINTNHDDTCVDIDAYNSGIDVSSKNEYLGINTADDDNEYGNGGMQNYEGPVNEQAIHCQTNDISENENNLQLLGQPLPLRSTMMTTFVGLFVAVGGFLYGYDTGLINSITDMKYVKEHIAPNHSFFTTTQISMLVSFLSLGTFVGALIAPWISDIYGRKSTIIFSTMIIFSIGNSLQVAAGGLALLIVGRVISGIGIGIISAVVPLYQAEAAQKHMRGAIITTYQLAITLGLLVSSAVSQGTESINAPSSYRVPIGLQYVWSVVLGVGMVFLPESPRYYIMKDEIEEAARSLSFLRGISLEDPRLLEELVEIKANYDYESSFGPVSIWDCFRSSEQRPKQVLRMFTGISIQAFQQFSGINFIFYYGVYFFNKTGIKSSYLVSFVTYAVNVAFNIPGMFLIDYLGRRKVLIFGGIAMTACNFIIAIVGVSAKSIVSNNVMIAFICVFIAAFSSTWGGVVWVISAELFPLGVRSKCTAICAAANWLVNFVCALMTPYIVDTGSNYTSSMGTKIYFIWGSLNALGTIVAYLTVYETRGLTLEEINELYVNSPTPFASNEWNRKIRTESTIPPMVHDHELDNHIVPTMDNILHSRNPNQPYSSDENQDVIVGEDKLDLEQGYNKEIHNHRDDNNVSPIPFLQEQNGKEFSNGADFSPSTHSTFALTEHIPANYVELGNGFGLNTYRGGPPSISDSSDDDHCTHWQSPENGSPIYHEILSSNDTNSGTYNKNSENL

SEQ ID NO: 21063 - protein, 208 aa, Brassica napus
MSLLSFPLTSLNISPPLFFTIITTLVSAFVILFLTRHSSNSKRVNLPPGPPGWPVVGNLFQFARSKKQFYEYADDLREKYGPIYTLRMGSRTMIIISDATLAHDVLIQRGPMFATRPKENPTRTIFSSNTFTVNASVYGPVWRSLRRNMVQNMLSSTRFKEFGSLRRSAMDKLAGRIKSEAVENKGLVWVLRNARFAAFCILLEMCFG

SEQ ID NO: 21064 - protein, 287 aa, Trichodesmium erythraeum IMS101
MKKSIKPSYKLHKNFRLPMGFTPENFDSGITYQAQEKDTFIVTYPKCGTTWTQHIIWMLSHDGKPLPLDKNINLEVPHLEEVGGDFVKYLSKPRFIKTHLTYNLTPYNPDTKYIYVARNPFDCAVSFYYHTQGFIKHYDFAEGTFDDFFECFITGEVDWGDYFDHLLSWVQHKNDQNVLFLTYESMKNDPKMNIIAMAKFLGDNYLEKIENLQILESILHHTSFTSMSQNQSRWSSQRPVNMTPFIRQGKVGDWRSHFSVSQTQRLSQKLRMKTAGTEAENLWQIPE

SEQ ID NO: 21065 - protein, 521 aa, Solanum lycopersicum x Solanum peruvianum
MVLNNINSILEALQANPILIFFFIIPLFFLYLFSTSRRKRYPPGPLGWPLIGNMMIMDQLTHRGLAKLAQKYGGVFHLKMGYVHKIVISGPEEARQVLQVQDNIYSNRPKTVAISYLTYDRADMAFADYGPFWRQMRKLCVMKLFSRKRAESWDSVRDEVDSMVKIVTTNAGTSINLGELVFCLTRNIIYRAAFGTSSDEGQDDFIKILQEFSKLFGAFNMADFIPWLGWIGKQGLNVRLAKARASLDGFIDTIIDDHIERKKAIHVINDDGYRESDMVDELLAFYSEETKVNESEDLQNAIRLTRDNIKAIIMDVMFGGTETVASAIEWAMAELMKSPEDLKKVQQELANVVGLNRKVDESDFENLTYLKCCLKETLRLHPPIPLLLHETAEESTVSGYYIPANSHVIINSFAIGRDKNSWEDPDSFKPSRFLKEGVADFKGGNFEFLPFGSGRRSCPGMQLGLYALEMAVAHLLHCFTWELPDGMKPSELNMDDMFGLTAPLANRLVAVPTPRLLCEIY

SEQ ID NO: 21066 - protein, 312 aa, Pseudomonas fluorescens
MYLVCGEALFDFFSEEDASGQASKVTYKAIAGGSPFNVAVGLRRLGIEAGLFGGLSSDFLGRRLLQVLKDEGVSERFLVEFAAPTTLSMVAVGADGSPQYNFRGEGCADRLLEVAHLPVLGDEVRGLHIGSFSLVVQPIGDTLLSLVKRESGKRLISLDPNVRLNPQPDIQLWRDRVAELAKHADLIKVSDEDLHLLYPGQSPESVLQGWLQHRCQLVFLTRGGDGASVFSRQHGTWSQPAQRVVMADTVGAGDTFQAALIAWLTEHQLDSVQGLQQLTRVQIDAMLGFAIRAAALTCGKTGPDLPYRQQLG

SEQ ID NO: 21067 - protein, 252 aa, Listeria monocytogenes str. 4b H7858
MNKVVVKNVTFGEGAPKICVPMVGKTVAALKEEAEMLQTIDLDVVEWRVDFFEDVKDLAKVEAALDEIRTILPETPILFTFRSAKEGGELAVGDEFYFELNETLASTGKIDLVDVELFNEEADVLRLIETAHKNNVKVVMSNHDFDKTPAKEEIVSRLTRMEALGADLPKIAVMPKSAGDVLTLLDATNTVSEKANQPIITMSMAGTGVISRLAGEVFGSAMTFGAAKKASAPGQIDVNELRHVLDLLHKQF

SEQ ID NO: 21068 - protein, 429 aa, Silicibacter pomeroyi DSS-3
MMNQDLSTRARASLPGGVSHELRYRDPYPVFIDRAQGGEKWDVEGRRYIDFKMGSASQMLGHCHPAIVEAIQKQAERSVFSADCHTREIEWAEWVNRLYPSADRTRFTASGTESTMLALRLGRAYSGKDHVLRVEGHFHGWHDHALKGAKPGSDQVPSLGIPDAINDLIHICAADPQAMESALQDDRIGTVIIEASGANYGCVPLATDTLRALHDVVRAAGVVLIFDEIITGFRWSPGGRQARDGIVPDLTTLAKVVTGGLPGGAICGRADIMELLNNATVRNGFGPAVSHKGTFNGSPLIAAAACAAMPLLANGEAQAQADAMAERMRDGMNAAMKRQGVAGIAYGDSSIFHVFFGRDRLDGLGPAEIRGLPKPLVKAYRDGMLSRGVDMMAYTSGLTSSAHTPELIDEALLAFDDTLSEMIRDGALT

SEQ ID NO: 21069 - protein, 303 aa, Ashbya gossypii ATCC 10895
MTSTSHIRFKQLERLGNGTYATVYKGLNKTTGLYVALKEVKLDSEEGTPSTAIREISLMKELKHENIVRLYDVIHTENKLTLVFEFMDNDLKKFMDSRLDREMPRGLELSLVKYFQWQLLQGVAFCHENRILHRDLKPQNLLINNKGQLKLGDFGLARAFGIPVNTFSSEVVTLWYRAPDVLMGSRTYCTSIDIWSCGCILAEMIMGKALFPGTNDDEQLKLIFETMGTPTEQTWVGVSQLPKYNPQIPLYPNKDIKQLLQATTKEQISDVLVNLIQGLLQLNPSMRLSAQQALSHPLFEEYH

SEQ ID NO: 21070 - protein, 334 aa, Ralstonia eutropha JMP134
MSASAMQAGPSGLPLDKETLLTVYRKMRTIREFEERLHVDFGRGDIPGFVHLYAGEEAAGVGILHHLHDGDRIASTHRGHGHCIAKGVDPVAMMKEIYGKKGGSCNGKGGSMHIADLSKGMMGANGILGAGAPLICGAALAAKFRGKGEVGITFSGDGASNQGTFLESLNLAAVWNLPVIFVIENNGYAESTSRDYGTAVDSYVDRAAGFGIPGVTVDGTDFFAVHEAAGEVIRRAREGGGPSLLECKMVRFYGHFEGDAQTYRAAGELDDIRANKDCLKLFSRAVTQAGVVSREELESIDREVATLIEHAVQEAKAAPLPGPEDLLTDVYVSY

SEQ ID NO: 21071 - protein, 338 aa, Ralstonia eutropha JMP134
MARKLSIKLAINEAIDQEMTRDPSVIMLGEDIVGGAGADGEKDAWGGVLGVTKGLYAKHGDRLLDTPLSESAYVGAAIGAAACGMRPIAELMFIDFMGVCFDQIFNQAAKFRYMFGGKAETPVVIRAMVGAGFRAAAQHSQMLTPLFTHIPGLKVVCPSTPYDTKGLLIQAIRDNDPVIFCEHKNLYGLEGDVPEGAYTIPFGEANIARDGKDVTIVAYGLMVHRALDAAATLAKEGIEAEVIDLRTLSPLDMDTVLESVENTGRLVVVDEASPRCNIATDISAQVAQQAFGALKAGIEMVCPPHTPVPFSPTLEDLYIPSAAHVVEAVRKTMKGGKH

SEQ ID NO: 21072 - protein, 396 aa, Methanocaldococcus jannaschii DSM 2661
MRNMQEKGVSEKEILEELKKYRSLDLKYEDGNIFGSMCSNVLPITRKIVDIFLETNLGDPGLFKGTKLLEEKAVALLGSLLNNKDAYGHIVSGGTEANLMALRCIKNIWREKRRKGLSKNEHPKIIVPITAHFSFEKGREMMDLEYIYAPIKEDYTIDEKFVKDAVEDYDVDGIIGIAGTTELGTIDNIEELSKIAKENNIYIHVDAAFGGLVIPFLDDKYKKKGVNYKFDFSLGVDSITIDPHKMGHCPIPSGGILFKDIGYKRYLDVDAPYLTETRQATILGTRVGFGGACTYAVLRYLGREGQRKIVNECMENTLYLYKKLKENNFKPVIEPILNIVAIEDEDYKEVCKKLRDRGIYVSVCNCVKALRIVVMPHIKREHIDNFIEILNSIKRD

SEQ ID NO: 21073 - protein, 166 aa, Neisseria gonorrhoeae
KGMYLLKAGGKGDKKVQLMGSGTILQEVIAGAELLKADFGVEADIWSCPSFNLLHRDAIETERFNRLHPLEAEKVPFVTSQLQGHDGPVIAATDYIRSYADRIRAYIPNDYHVLGTDGFGRSDSRANLRRFFEVDRYNVAVAALAALAEQGKVSKETVQQAIEKYG

SEQ ID NO: 21074 - protein, 166 aa, Neisseria gonorrhoeae
KGMYLLKAGGKGDKKVQLMGSGTILQEVIAGAELLKADFGVEADIWSCPSFNLLHRDAIETERFNRLHPLEAEKVPFVTSQLQGHDGPVIAATDYIRSYADRIRAYIPNDYHVLGTNGFGRSDSRANLRRFFEVDRYNVAVAALAALAEQGKVSKETVQQAIEKYG

SEQ ID NO: 21075 - protein, 318 aa, Neisseria gonorrhoeae
MKHLHDLPAWSKLWNHFDDSKTLHMREMFEQDPQRAERYWLQVGGLTLDYSKNRINDETMSLLFELAREAGVPERMRQMFHGEKINTTENRAVLHVALRNRTNSPIMVDGEDVMPKVNRVLQRMGEFAHEVRSGSWLGYTNQVITDVVNIGIGGSDLGPLTMCTALKPFGHPRLNMHFVSNVDGSQLRDVLSKVHPETTLFIIASKTFTTQETLTNALTAREWFLNHAGDEEAVAKHFAAVSTNRKAVAEFGIDIANMFEFWDWVGGRYSLWSAIGLPIMLYLGEENFIEMLNGAHLMDQHFINTPLERNLPVILALI

SEQ ID NO: 21076 - protein, 292 aa, Coccidioides immitis RS
MSVRDGVETNKVLRITSFTICADGGANRFYELMRKNGTESTELPNAIVGDLDSIRPFVRKHYENLGVPVLEDPDQYSTDFTKCLRHLKSNIRTIVSSDISPGPPQSTAESEVQDNGTEPHLDVLVLGGLGGRVDQAFSQIHHLYTASQSSLSAADKPAGDLYLISEESITFLLPEGKSTIFTPGGNSLEAESRWKAPTSIPGSHSALDGDKPISECPEKCYLSENVGIIPVGGPSVINTEGLEWDVHDWKTEFGGQVSTSNHIRADMVEIRTTAPVLFTVELADWLKFHGRV

SEQ ID NO: 21077 - protein, 263 aa, Triticum aestivum
  misc_feature (217)..(217): Xaa can be any naturally occurring amino acid
  misc_feature (239)..(239): Xaa can be any naturally occurring amino acid
  unsure (1)..(263): unsure at all Xaa locations
AYLGDSIEQVCTKKQAGTGPEFPGYRRPTRPVAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHASTEGVTKFLMPSVAGFLMQKELDYLVGAVAHPKKPFAAIVGGSQVSSKIGVTKSLLAKXDILNPGGGMIFNFYKAQGLPVXKSLGEKNKLELANFLDQTAKAQGG

SEQ ID NO: 21078 - protein, 930 aa, Coprinopsis cinerea okayama7#130
MAATFYPLASLSQIEKTPSREDGIPAELEEDLRAYGCKLIHQAGILLRQKQVAVATAQILFQRFWFVTSMRQFGVGDIGMGALYLSSKLEECPLRMRDIINVYDLLLQRATHSISPKGKSGQEFVYHPMSYFGDTFYQLKEALVVAEMQILKRLGFNVHVTLPYNTLINYLRLLGLGQNSELCTKAWGYLNDALQTPVYAIYQIPTIVCAAIVLSTRHLNIPLPTSPPWWELFDAHWDDIWSVCGYVMRLYRPRETPNVAEALVTKKDKLMATNLISSTGGIVLWSRSFTPDAAQLASSSASPVNSLIREALIEGRTAEEKYEKDGYAVRWTFVNDLELIFVVAYQRILQLTYVDDLLSAIKTLFIKYFEPFIAAFVASLHAINTARAAAVQTTSWDFSKAFEGWDNIFDKVLRGFEEKAALERKSRLRAPVRPVEDLSTPPSDDQGTEPTVTADTSQDEQQIARNVQALKNRLRGRGGRRGGRGGGRSDAGSGRDSVPHSDSEFTPKRKTKTKAQRKWGDEVPTESDMASLDFSIDKPEDSEVGSHDLQSLVDQASLGTRTRDGMYEVKDWEFSTNDKDTDNAIANVLRPIEHKAASTSALGSLFARLTGSKVLTEADLKPVLEGMKQHLMKKNVAMDIAEKVCEGVGETLVGKKIGSFQTVTAAVRVALSNSLTRILTPKTSTDLLLSIKNKRASALPSGQQRMPYSITFVGVNGVGKSTNLSKVCFWLIQNGLRVLIAACDTFRSGAVEQLRVHVRNLGMLGVNGAGDSKGRVELFERGYGKDAAGIAKEAILYAKDNDFDVVLIDTAGRMQDNEPLMRALAKLVAVNNPDKIIFVGEALVGNEAVDQLTKFDRALRDFSSASGAGKGRGIDGMLVTKWDTVDDKVGAALSMTYVTGQPIIFVGCGQTYTDLRQLRVANVVGAILDN

SEQ ID NO: 21079 - protein, 672 aa, Roseovarius nubinhibens ISM
MDIAALRTANPDHWKKATAIRALTLDAVHAANSGHSGMPMGMADVATVLFEKHLKFDASAPNWPDRDRFILSAGHGSMLLYSLLHLTGYKGMEIDQIRNFRQWGALTAGHPENFLHDAIETTTGPLGQGIANSVGFAMAEESLRARYGAKLMNHYTYVIAGDGCLMEGISQEAIGLAGRHELGRLIVFWDNNNITIDGTVELSDRTDQVKRFKASGWHVIEIDGHDPKAIDAAITEAKKTSKPSMIACKTHIALGHAAQDTSKGHGALTDEAQMAAAKEAYGWTSAPFDVPADIKQAWEAIGARGASEREAWEARLAEASERRQAEFERIFALDTPKQLSARIKALKKQISAEAPKVATRKSSEMVLEVVNPIMPETMGGSADLTGSNNTKTGDLGVFDVENRKGRYIYWGIREHGMAAAMNGMALHGGIRPYGGTFMCFTDYARPAMRLAALMKVPSVFVMTHDSIGLGEDGPTHQPVEHLAISRATPNTMVFRPCDTVETAEAWELALSSKETPSVLSLTRQGLPTLRTEHKNKNLTAQGAYVLADAEGKRQAILLATGSEVEIAMKARDLLQAEGIGTRVVSMPCWELFEQQEESYRKRVLPGGAAVRVAVEAAARQGWDRWLCGERGREARSGFVGMEGFGASAPAETLFEKFGITAEAVAEKVKSLL

SEQ ID NO: 21080 - protein, 337 aa, Malus x domestica
MGVESVERERESNEGTIPAEFIRSENEQPGITTVHGKVLEVPIIDFSDPDEEKLIVQITEASSNWGMYQIVNHDIPSEVISKLQAVGKEFFELPQEEKEAYAKPPDSGSIEGYGTKLFKEISEGDTTKKGWVDNLFNKIWPPSVVNYQFWPKNPPSYREANEEYAKHLHNVVEKLFRLLSLGLGLEGQELKKAAGGDNLEYLLKINYYPPCPRPDLALGVVAHTDMSTVTILVPNDVQGLQACKDGRWYDVKYIPNALVIHIGDQMEIMSNGKYTSVLHRTTVNKDKTRISWPVFLEPPADHVVGPHPQLVNAVNQPKYKTKKYGDYVYCKINKLPQ

SEQ ID NO: 21081 - protein, 319 aa, Glycine max
  misc_feature (253)..(253): Xaa can be any naturally occurring amino acid
  unsure (1)..(319): unsure at all Xaa locations
MAIAAAAVVVPLGLLFFASGLLVNLIQAICYVVVRPVSKSLYRRINRVVAELLWLELVWLIDWWAGVKVQIFTDHETFRLMGKEHALVISNHRSDIDWLVGWVSAQRSGCLGSTLAVMKKSSKFLPVIGWSMWFSEYLFLERSWAKDESTLKSGIQRLSDFPLPFWLALFVEGTRFTQAKLLAAQEYATSTGLPVPRNVLIPRTKGFVSAVSHMRSFVPAIYDVTVAIPKSSPAPTMLRLFKGQPSVVHVHIXWACLVVAGSVKFLQWSSLLSSWKGVAFSAFGLAVVTALMQILIQFSQSERSNPAKIVPAKSKNKGS

SEQ ID NO: 21082 - protein, 533 aa, Triticum aestivum
MDPGPWMSSPAALSVLSWICGGLVAAVLLWQAARLLDQLWWRPRRLERALRAQGLPGTRYRFLLGDVNDYARQTKAASSGPPMPPRCHNVGPRAMPFLYSTIQEHGTPCISWFGPVPKVSITDPALVREVMSSKLARDVEKFKFPALTRLLADGVGNYEGDRWAKHRRILNPAFHAEKLKLMLPAFTACCEELVGRWERSLGPDGSWEVDVCPELQSLTGDVISQTAFGSSYLEGRRIFQLQTEQIGRFMAAISKIMIPGYMSFPTKNNRRMHQINNEIESILRGIIAKRMQAIQEGERTKDDLLGLLLESNMTDTDENGQSTLGMSSDEVMEECKLFYFAGMETTSILLTWTMIVLSMHPEWQDRAREEVLGLFGKHKLEYEGVNRLKIVTMILYEVLRLYPPATVFTRKTYKKIEIGGITYPAGVMFEMPVLYIHHDTDIWGEDVHQFNPDRFAKGISKASKDPGAFFPFGWGPRICIGQNFALLEAKMALCMILQRFEFELAPSYTHTPHSVMMLRPMHGAPIRLHTISS

SEQ ID NO: 21083 - protein, 753 aa, Oceanicola granulosus HTCC2516
MAKARFTPEDALAFHMEPSPGKWEVQPTVPMTTQRDLSLAYSPGVAVPCEAIAANPELAYDYTNKGNLVAVISNGTAVLGLGNLGALGGKPVMEGKSVLFKRFADVNSIDIELDTEDPDAFCDAVRLMGPTFGGINLEDIKAPECFIIEQRLKEEMDIPVFHDDQHGTAVICAAGLINALHISNKKIEDVKIVLNGAGAAGIACIELLKSMGARPENCIVCDTKGVIYQGRTEGMNQWKSAHAVKTDLRSLEEAMDGADVFLGVSAKGAVTEKMVASMADNPVIFAMANPDPEITPEEAHAVRVDAIVATGRSDYPNQVNNVLGFPYLFRGALDIHARAINDEMKIACAEALAALAREDVPDEVGVAYGRKLAFGRDYIIPTPFDPRLIYRIPPAVARAGMETGVARRPIIDMDGYETALKGRMDPTASILRGIYARARAAQGTVLFAEGDDPRVLKAAVLYQRSGYGRSLVVGRESDVKTKLEAEGLADAARELTIVNAANTDHLETYKRFLYERLQRKGHDQQDVHRLAARDRHVFASLMLAHGHADAMVTGATRKSAHVLELINHVFDAGPHDGAVGVSAVLARGRIVLIADTLVHEWPDETDLAVIAERGAAVARTLGLVPRVAFVSFSTFGYPVSERATKMHQAPRVLDARGVDFEYEGEMTVDVALNTRAAEHYPFSRLTGPANVLVVPARHSASISVKLLQEMGGATVIGPILAGVHKPIQICSTVSTVTDILNMAVIAASKVDDR

SEQ ID NO: 21084 - protein, 336 aa, Candida glabrata CBS 138
MGSHEGIDTDVISLPRFIIEYQKRVHNATGEFTLVLNALQFAFKFIAHAIRRAELIHLGGLFGTSNATGDEQKKLDVIGDEIFINTMESSNCVKILVSEEQEDMIVFEHNTGNYAVCCDPIDGSSNLDAGVSVGTIVSLFKLQPGSTGKVEDVLRPGTEMVAACYAMYGASTHLVLTMGDGVNGFTLDTNLGEFILTEPDMRVPMYRQIYSINEGNTYYWNDNIKSFINFLKEPQDDGKPFSARYVGSMVSDMHRTFLYGGIYAYPEDKKNPKGKLRLLYEAFPMAFLMEQAGGKAVTDRGERILDLTPTHIHDKSSIWVGSPGEIDKFLKHIGKA

SEQ ID NO: 21085 - protein, 433 aa, Trichodesmium erythraeum IMS101
MASTPQLRREIGVFGATLMGNGSILGTGVFVSIGIAASIAGPSVIIAVAVAGVVATCNAFNSAQLAANHPVSGGTYEYGYKYLNNWLGFIAGWMFLFAKSASAATAALGFAGYFLNAFGVNNNTWLVLTALTAVVVLTIVVLSGIRRSNVTNIIIVSITLFSLVLFILAGVPQVVFSEGKNLMPFFPGDKPIASLLQATALMFVAYTGYGRIATLGEEVKEPRRTIPRAIALTMIFTCVLYISTAIVSVFAGQEVIQKLSQADVSLVAPLEVIAKVGGLGIPVIPKLIAIGAITAMLGVLLNLILGLSRVLLAMGRRRDVPKVVARLDSGQTTPYIAVVIVGVAIACLVLIGDVKTTWSFSAFNVLIYYAITNFAALHLSPEERLYPKWLGWLGLASCLFLAFWVEKQIWLVGLGLILIGLIWHSLIHRFITD

SEQ ID NO: 21086 - protein, 615 aa, Zea mays
SHSATPAPRPLLSEATPRALLPCPVSGPPAPSARQPAVTEARSGPRENEDIQLRLNSIRRLSTIARALGEERTRKELIPFLSENNDDEDEVLLAMAEELGVFIPYVGGVEHAHVLLPPLETLCTVEETCVRDKAVESLCRIGAQMKETDIVDWFIPVVKRLAAGEWFTARVSSCGLFHIAYPSASDQLKTELRTIYGQLCHDDMPMVRRAAASNLGKFAATVEQNHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILNPQLSVQHILPCVKELSSDSSQHVRSALASVIMGMAPVLGKDATIEQLVPIFLSLLKDEFPDVRLNIISKLDQVNQVIGIDLLSQSLLPAIVELAEDRHWRVRLAIIEYIPLLASQLGVGFFDDKLGALCMQWLEDKVFSIRDAAANNLKRLAEEFGPEWAMQHIIPQVLEKINNPHYLYRMTILQAISLLAPVMGAEITCQKLLPVVINSSKDRVPNIKFNVAKVLQSLVPILDQSVVEKTVKPSLVELSEDPDVDVRYYANQALQACDQMMVSS

SEQ ID NO: 21087 - protein, 629 aa, Ashbya gossypii ATCC 10895
MSSSVSASQAKVNELLEAIRQEFQSVSQEATSYRLQNQKDYDFKINQQLAEMQQIRNTVYELELTHRKMKDAYEEEIQRLKVELEQRDRQLSQYAQGTAVPLAAPAASVVTASPAPAVGTSGAAASNTLPSLSEGALAKSKSLSSPHHQVVGGGAMVPQSLGPTPMPPIGSHQHLPQPLAAVAPSGGQPVVPLGAQAQPEQAPVDSAVHGQASEHYLVPYDQRPVHAKPIPPFLVDLDSQLVPTHLKKQTSEYYVLYNPALPRDLDVDLHHSLDHSSVVCCVRFSNDGEYLATGCNKTTQVYKVSTGELLARLSDDSVAGVNNEASTGPANNGTADNGGENSATIQPASSSDLYIRSVCFSPDGKYLATGAEDKLIRIWDLTTKKILMTLQGHEQDIYSLDYFPAGDKLVSGSGDRTVRIWDLRTGQCSLTLSIEDGVTTVAVSPGDGKYIAAGSLDRTVRVWDSETGFLVERLDSENELSTGHKDSVYSVVFTRDGQGVISGSLDRSVKLWDLRGLNGQKSHATCEVTYTGHKDFVLSVATTQDDEYILSGSKDRGVLFWDTASGNPLLMLQGHRNSVISVAVVNGFPLGPDVGVFATGSGDCKARIWKYTKKSNPTATGAKLQELKE

SEQ ID NO: 21088 - protein, 539 aa, Neisseria gonorrhoeae
MDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADAVYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETARHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPYNLGMLMAAYEHKTFVQGAIWNVNPFDQWGVEYGKQLAKTIIGELEGGTSVHDASTEGLMAFYREC

SEQ ID NO: 21089 - protein, 483 aa, Candida glabrata CBS 138
METIHNISNRLQEVLATNKSVNVDTDNDSLSSNQEDNEVEKVRHLVVILGEKYSYAVDRNTGINALMQWFTTNSEIPEEILNAIRSKLNFTYRTNFEPIERAPDGPSPINPLIMLRINPIDAIENVFNNRECFFTDVGWGCMIRTGQSLLGNALQRVKSTVKDQPYIYEMDDTKEITDLFKDNTKSAFSLQNFVKCGRIYNKIAPGEWFGPATTATCIRYLIQENPCYGIEACYISVSSGDIFKENIQGMIDRYPNGNILILLGIKLGLDSVHERYWGEIKTMLESPFSVGIAGGRPSSSLYFFGYFDDTLLFFDPHNSQTALIDDFDESCHTENFGKLNFSDLDPSMLLGFLLPCSKWDEFQEFTSLLTIVNVLDGMDQYRDPDLNSNDIGNVELSPQLKLSQTPDAITDDDYVDIGALIQGNSMNINDRDNGYQEVQCKNQQIVIMDSLNETKPLEIEKVLVGQGTNLVNATTPCREAFPK

SEQ ID NO: 21090 - protein, 539 aa, Neisseria gonorrhoeae
MDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADAVYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETARHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPCNLGMLMAAYEHKTFVQGAIWNVNPFDQWGVEYGKQLAKTIIGELEGGTSVHDASTEGLMAFYREC

SEQ ID NO: 21091 - protein, 689 aa, Neurospora crassa
MPAQTSFPSLAALRRLQTLNHVYAPLRRTGTGRITNGWTCASCRSQLSASSASSSSSSSSLSVSLYNSTLARRSFSSSSKRSSDQNSNGSSSSSSSSSSSNGNGKTNNNNNNNNNNGRRTVLLAAGGGAAAAGLLAVGDDVKYTYEAVERTGRVASTLAICVNDYRVTLNAREKIEDPEEKQRLLRECHQRCADRTLEVLEKSGGIFIKLGQHLSAMNYLLPPEWTTTFIPLQDKCPVSSFESIERMFLEDTGTSLWDYFSEFSREPIGAASLAQVHLATIKETGQRVAVKRWAPLDMRLTSTTFKTLKYFFPEYDLEWLSSEVEISLPKELDFTCEAENARRTSRYFAEFAPSLPLVIPDVLWAKKRLLVMACESGHRLDDLAYMDAYGIDRDEVSATLARIFNEMIFGEGAPLHCDPHGGNIAIRYHDNSNKSKSKSNFDIILYDHGLYRDIPLPLRRSYAKLWLAIIDGDIPKMKRYVHEVAGIGEDKFPLFASAITGRDFINVVSATDSGGVLKPKEASEQKSMSTALQEGLIVDLVQMLGQVPRIILLILKTNDLTRALDESLHTKQGPVRQFLILARYCMRTVFYEQLEEIRGLGSIWSPANLVRLVGAWWGMARVEVKLEVFELWLRVKRTLGLGSGFGMGMGTGEEAQQQVVPVGKKGQKRLEREVEAAAAVSVAAAAAAA

SEQ ID NO: 21092 - protein, 157 aa, Zea mays
MMLLGKRQRPEIKRTTSLSEIKFDLNLPCEPEEPSDHQHVQTLSPRKSKLVTVDEHRQVHHGLLDQRLLAMVSPRGTQRRHSEDYSTHAGDFLRCCSLCKRNLVPGRDIYMYRGDRAFCSLECRQQQITVDERKEKGLVRSTVAAGSGKGERVSAAV

SEQ ID NO: 21093 - protein, 88 aa, Zea mays
  misc_feature (65)..(65): Xaa can be any naturally occurring amino acid
  unsure (1)..(88): unsure at all Xaa locations
MAPTVMASAGTSVAPFQGLKSTAGLPVSRRSNGASLCSVSNGGRIRCMQGWPFEGIKKCETLSYXPPVNTEALLEQEDYLVRCQGAPG

SEQ ID NO: 21094 - protein, 99 aa, Rhodospirillum rubrum ATCC 11170
MATKVRIFQPAKTAMQSGRANTKRWVLEFEPTEKKVHDDLMGWVGSGDMNGQLRLFFATRKDAESYAKRKGFTYTAQDANPRVIKPKSYSDNFAYHKIS

SEQ ID NO: 21095 - protein, 539 aa, Neisseria gonorrhoeae
MDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADAVYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETARHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPYNLGMLMAAYEHKTFVQGAIWNVNPFDQWGVEYGKQLATTIIGELEGGTSVHDASTEGLMAFYREC

SEQ ID NO: 21096 - protein, 334 aa, Zea mays
MGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGARALEAFGRHCRSLVGLRRVMHPIDLADKVCQHDEAHAIARSMPRLRHLEMGYMLVATEAVLEILEQCSELKFLDLRGCWAVDDRFLRERHPGLRVLGPRVVDDCYENSYWEECSDYYSDEDEDYDDDVVSWGLFVDDDDYYYAVGSDDDEAIWDDAQGLENLEVRFYGGGGFGESFAGFDWPPSP

SEQ ID NO: 21097 - protein, 344 aa, Candida glabrata CBS 138
MFKKLTGKKEVKKVDESKLISIDKPIKSLPEEIKRPEEEKLTAEQQAKYDEVYKYLTNAELKVGNKEKNPTESSGLIDEERAWLTRECIIRYLKATKWHVKDAIDRILGSLAWRREFGINHLGEENGDEVTSDLVAVENESGKQVVLGYENNARPILYLKPGRQNTKTSHRQVQHLVFMLERVIDFMPIGQGSLALLIDFKEYSDVPKVPANSKIPPIGVGKEVLHILQTHYPERLGKALLTNIPWLAWTFLKLIHPFIDPMTREKLVFDEPFTKYVPMDQLDAIYGGHLNFKYKHEVYWPALIEYSKEKREHYMKRFQKFGSKIGLSEYDLRGTHETPLYPVN

SEQ ID NO: 21098 - protein, 539 aa, Neisseria gonorrhoeae
MDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADADYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETARHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPCNLGMLMAAYEHKTFVQGAIWNVNPFDQWGVEYGKQLAKTIIGELEGGTSVHDASTEGLMAFYREC

SEQ ID NO: 21099 - protein, 184 aa, Magnaporthe grisea 70-15
MAERSLIFSPAPYHIISYGTLLGTTFFQSFVNGIVAFRALPRPQFSILQQKIFPVYFVIQSVLPVTLALTWPGSRNGLLSTASGIAGVLDEQNRWGVLVPIGTMFVTGVANLLWLLPATTGCMLERRVQEKKDGKRSYDPAPHSEEMKALNKKFGILHGISSLLNLGTFIALICYGFTLAGHLH

SEQ ID NO: 21100 - protein, 387 aa, Oryza sativa (japonica cultivar-group)
MAAEADARKVCGLPERVQLHGAMLALQFGYAGFHVVSRFALNMGISKLVFPVYRNIIALILLVPFAYFLEKKDRPQLTLSFVVQFFLLALCGITANQGFYLLGLDNTSPTFASAIQNSVPAITFAMAAALRIERVRLDRRDGVAKVLGTLACVAGASVITLYKGPTIFGPKLQLQAVAEVPLRAAIAGEGKNWTLGCVYLIGHCLSWSGWLVLQAPVLKKYPARLSVTSYTCFFGVIQFLIIAAFMERDADAWAFHSGSELFTILYAGFIASGVAFAVQIWCIDRGGPVFVAVYQPVQTLVVAIMASLTLGESFYLGGIIGAVFIIAGLYLVLWGKSHERARLAKDAAAIATDRDAAPCRIIAAGKQSSSVTQPLLLPTSSSSDNAV

SEQ ID NO: 21101 - protein, 364 aa, Glycine max
KHNTISRSFSDNLYLKDPQPQPEDRMESISDPPFHEAYKILFDKTRNGNNFEEHKELLAVAEECDLPVIDLSRLEESDEVVREECKSQIARASQEWGFFQVVNHGISTEIFSSLRCEQEKVFKQPFEKKTKEDKFLNFSAGSYRWGTPSATCIKQLSWSEAFHIPLTDILGSTGSNSLSWTIEQFATTVSSLAQTLADILAEKMGHKSTFFKENCLPNTCYLRLNRYPPCPIGFGIHGLMPHTDSDFLTILYQDQVGGLQLVKDSKWIAVKPNPDALIINIGDLFQAWSNGVYKSVEHRVMTNPKLERFSMAYFFCPSNDTVIESCREPSFYRKFSFREYRQQVRDDVQKLGSKIGLPRFLTHA

SEQ ID NO: 21102 - protein, 675 aa, Treponema denticola ATCC 35405
MKNELEAIALSIRSLSMDAIEKANSGHPGLPLGAAELGAALYAKILKHNPKNPDWKDRDRFVLSAGHGSMLLYSALHISGYDVSIEDIKSFRQLGSKCPGHPEYGDTPGVETTTGPLGQGISTAVGMAIAEKMLAARFNTAEHKIVDHYTYALVGEGCLMEGVSSESSSLAGHLKLGKLIVYYDENKITIDGSTDLTFTENIEERYKAYGWQVLRGSMYSFEDIERLTLEAKKDERPTLIILKSVIGQGAPTVAGKNKAHGAPLGKDGIAEAKKNLLLEGKGDFYVAEEAYAFFKKRNEELALAEAEWNKTFEVWSKANPEKRKEWDLSFAQGGADEALVKSVKLPEFKKDESLATRAASKKALNEFAKVLPNLVGGSADLEGPNAVGLDGISAFSHQNPSGRYIYFGIREFAMGTITNGIQLHGGFRAFCATFLVFADYLRPALRLAALMKLPSIYVFTHDSIFVGEDGPTHQPIELLASLRAIPNVLVLRPADAEETGEAWKQALLHKDGPVCLILSRQNLPVLEKSDLFWRESIKNGAYIVKDVEASASGCTVGKPDRTPDVTVLATGSEVSMAVKAASLVKDKKVRVVSVMSKERFENSPKDFKHGVLGGCKKHIRVVTAEAGVAQGWEGWTGCKCDNFSIEGFGTSAPGAKVAEHLGFTSENLAKLIEKN

SEQ ID NO: 21103 - protein, 429 aa, Bacillus anthracis str. Ames
MRKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLQFFAAYYREMVEQGVFLPPSQFEGLFLSTVHSDADIEATIAAAEIAMSKLKA

SEQ ID NO: 21104 - protein, 542 aa, Rhodospirillum rubrum ATCC 11170
MPSPYSTGLDRTPANHVPLTPLAFLDRAAQVFPDRPSLVHGKRRYTWAETAQRARRLASALRARGIGPEDTVAVMGANTPELYEAHFGVPMAGAVLNALNVRLNAEEIAFILEHGEARVLLTDTEFSPIIADALARIDRPITVIDIVDPEYDGPGACVGEMEYEAFLAEGDPTADWRWPADEWESITLNYTSGTTGNPKGVVYHHRGAYLNALSNIITWGMPHHAVYLWTLPMFHCNGWCFPWTMAANAGTNVCLRRVTAAGIFQAIAEEKVSHFCGAPIVLSFLINARPEERRSFDHQVNVMTAAAPPPASVLEKMQREGFCVTHVYGLTETYGPATVCAWKEPWNDLPMDEQARLKSRQGVRYLVQEGLMVGDPETMEAVPADGESMGEVFFRGNITMKGYLKNPEATAEAFRGGWFHTGDLGVLHPDGYLQLKDRSKDIIISGGENISSIEVEGVLHRHPDVVAAAVVAKPDEKWGETPKAYVELRDGATVTEDELVAFCRLHLAHYKCPRDVEVGPLPKTSTGKIQKFVLRRQVRAEG

SEQ ID NO: 21105 - protein, 213 aa, Phaseolus vulgaris
EASRSRTLQDIIREEKPNGDAKDRNSWKAFKEKLRLKRAVGLAWSSATSHSNNNDNDDGNLPQTRLHSDGAATQQNDVVVEDANDSDPIERFGSPAENTAAGGDSSEGENNQEAAVGVSLMDLLEEAEQELDLYRVSDDDAVADFEKREEDEEEKEGLVEYNCNCCVCMVRHKGAAFIPCGHTFCRMCSREIWASRRNCPLCNNLILEILDIF

SEQ ID NO: 21106 - protein, 317 aa, Mannheimia succiniciproducens MBEL55E
MTTQLDALRNMTVVVADTGDIEAIKKYQPQDATTNPSLILSASALPQYASLIDDAINYAKAKSTDKAQQLIDAEDKLAVNIGLEILKIVPGRISTEVDARLSYDTAATVEKARKLIKLYNEAGINNDRILIKVASTWQGIRAAEILEKEGINCNLTLLFSQAQARACAEAGVYLISPFVGRILDWYKANTDKKEYVPNEDPGVISVTSIYNYYKQYGYQTVVMGASFRNIGEITELAGCDRLTIAPALLKELQESNADLPRKLDYKGEVKPKPAPLTESQFYWEHNNDPMAVDKLAEGIRKFAADIEKLEAMLSTKL

SEQ ID NO: 21107 - protein, 510 aa, Candida albicans SC5314
MGRATIKSGSINLLNTIIGAGILAMPYGLKNNGLLFGCILIIWSSLTSSMGLYLQNKVAKYTGQRGSVSYFSLSQLTYPNLSILFDSAISIKCFGVGVSYLVVIGDLMPKIVESLVGGGNINSDSLLMARNFWITIFMIVIVTPLSYLKKLDSLKYTSILALFSVGYLICLVVAHYFTTPTTSPSGGGGGDDDDIVYHYIGPISLKSTLSSFPIFVFAYTCHQNMFAIINELKPSDTDGSQTRQSNLIIRNAISIACLSYLIVGIFGYLTFGNSVNANIITMYPHNSISSLIGRLCIVVMVSLSFPLQCHPCRGSINHVIHFCTHGVQQSKFRSTTTNNNYNNGDQHGYTSLSSDIESLQSIGGNDTTAGSIGSIGGGDSVVGDADESFISTTPVEGAQDTDGHDPIIVPMTTKKFYIITTVIVVLSYLVAISVTSLAHVLAFVGSTGSTSISFILPGLFGYLLIKPIEGNTSLNNLEKFCKYGGLFLAIWGILVMIVCLSATIFLGATH

SEQ ID NO: 21108 - protein, 93 aa, Brassica napus
MGFIMEFAENLVLRLMEDPEVRDRKAREHIYEMHERCKKIKEMWALPIRPYGFWTFERHNAQLRWDPQISQVAGRRDPYDDLLQDHPSSSSSN

SEQ ID NO: 21109 - protein, 553 aa, Mycobacterium tuberculosis H37Rv
MTSAPIPDITATPAWDALRRHHDQIGNTHLRQFFADDPGRGRELTVSVGDLYIDYSKHRVTRETLALLIDLARTAHLEERRDQMFAGVHINTSEDRAVLHTALRLPRDAELVVDGQDVVTDVHAVLDAMGAFTDRLRSGEWTGATGKRISTVVNIGIGGSDLGPVMVYQALRHYADAGISARFVSNVDPADLIATLADLDPATTLFIVASKTFSTLETLTNATAARRWLTDALGDAAVSRHFVAVSTNKRLVDDFGINTDNMFGFWDWVGGRYSVDSAIGLSLMTVIGRDAFADFLAGFHIIDRHFATAPLESNAPVLLGLIGLWYSNFFGAQSRTVLPYSNDLSRFPAYLQQLTMESNGKSTRADGSPVSADTGEIFWGEPGTNGQHAFYQLLHQGTRLVPADFIGFAQPLDDLPTAEGTGSMHDLLMSNFFAQTQVLAFGKTAEEIAADGTPAHVVAHKVMPGNRPSTSILASRLTPSVLGQLIALYEHQVFTEGVVWGIDSFDQWGVELGKTQAKALLPVITGAGSPPPQSDSSTDGLVRRYRTERGRAG

SEQ ID NO: 21110 - protein, 205 aa, Proteus mirabilis
MQEYNQPLRIGVGGPVGSGKTALLEVLCKAMRDSYQIAVVTNDIYTQEDAKILTRAQALDADRIIGVETGGCPHTAIREDASMNLAAVEELAMRHKNLDIVFVESGGDNLSATFSPELADLLFMLIDVAEGEKIPRKGGPGITHPDMMVINKIDLAPYVGASLEVMEADTAKMRPVKPYVFTNLKEKVGLETIIDFIIDKGMLRR

SEQ ID NO: 21111 - protein, 318 aa, Gloeobacter violaceus PCC 7421
MAEQTVIITGASSGVGLHAADSLAQSGRWHVVMACRDKAKAQNAAASLGMRPQSYTIVHLDLASLASVRRFVQDFRALGQPLDALVCNAAVYTPTAREPRYTADGFELSVGTNHLGHFLLCNLLLEDLQNSPAAEPRLVILGTVTHNPKELGGSIPPRPDLGDLRGLEQGFKAPHTMIDGKAYNPVKAYKDSKVCNLLTMRELHRRFHTSHKITFSALYPGCVATSGLFRESPRLFQILFPVFQKYVTGGFVSEAEAGGRVAALVDDPAYSRSGVYWSWGNRQKKDGKSFIQDVSTEASDEDKARRLWDLSAGLVGLA

SEQ ID NO: 21112 - protein, 198 aa, Bacillus anthracis str. Ames
MKVTKADIVISAVKPEQYPDGDLPEIALAGRSNVGKSSFINKILNRKKLVRISSKPGKTQTLNFFLINEMMHFVDVPGYGYAKVSKTERAAWGKMIETYFTTREQLDAAVLVVDLRHKPTNDDVMMYDFLKHYDIPTIIIATKADKIPKGKWQKHLKVVKETLDIESGDEVVLFSSETGLGKEEAWKAIHKFTKTKNA

SEQ ID NO: 21113 - protein, 419 aa, Vibrio fischeri ES114
MPKLNLHRRDYVSILGGDISADKLEQSLNPHFEKPLNKITPSPYLTEKNLTRRWDKLAKPELQSELLDPHTQNQMHVYEKNIEHFIGTVKLPVGLAGPLRVNGLFANDDYLVPLATTEAALVASYNRGAQLLTASGGASAMLLNEGVTRTPAFAFFGLAEAGQFVAWAVTQYDTFKQLAESTTSHGKLSDINISIEGNHVYLVFEFLTGDASGQNMVTIATNAVFSYIMENSPITPENAYLDGNLSGDKKASSQTLRSVRGKKVTAEAHIPAKLVKKYLHTTPEKMMQFTQMSTVGATLSGTIGINAHYANALAALYIACGQDAACVAESAIGMTRIEVDRNGDLYASVTLPNLMLGTVGGGTGLPSQKACLELMGLHGAGKSQALAEVCAALCLAGELSIVGAFCAGHFSRAHHKLAR

SEQ ID NO: 21114 - protein, 180 aa, Glycine max
PSSLRNMGLMLRGFTKEGLLKHPRDQGDQGAVAPRKRHRDDYKDRDYRRRSRSRSYDRYERDRHRGRDKDYRRRSRSRSASLDYKGRGRGRYDDERNSRSRSRSVDSGSPARRSPSPRRSPSPQRSTSPQRSPSPRKSPRGESPANRSRDGRSPTPRSVSPRGRPDASRSPSPRNSNGDE

SEQ ID NO: 21115 - protein, 370 aa, Triticum aestivum
YNKFVQKSRLVPAPEFPGYRRLFHWETQAMKWPMRLRVVLYLAEALEYCTSKGRALYHDLNAYRVLFDDDCNPRLSCFGLMKNSRDGKSYSTNLAFTPPEYMRTGRITPESVIYSFGTLLLDVLSGKHIPPSHALDLIRDRNFSMLTDSCLEGQFSNEEGTELVRLASRCLHYEPRERPNVRSMVQALAPLQKDVETPSYELMDMPQAGASSVQSLPLSPLADACSRKDLTAIHEILEKTGYKDDEGTANELSFQMWTNQMQDTLTSKKKGDSAFRQKDFTTAIDCYSQFIEVGTMVSPTIYARRCLSYLMNGMAEQALSDAMQALVISPTWPTAFYLQAAALLSLDMENEAQDALKDGCAQETSSSSGR

SEQ ID NO: 21116 - protein, 490 aa, Comamonas testosteroni
MKQYRNYINGEWVESARRFDDVNPVDGTVVAQVHEADREAVDSAIRAGHAAVRGAWGRTTVAERAAILCRIADEIDRRYDDFLAAEIADTGKPVAMASTIDIPRGAANFRVFADILKTAPLDTFQTDLPDGARALNYAVRKPLGVVGVISPWNLPLLLLTWKIAPALACGNAVVAKPSEETPGTATLLAEVMHTVGVPPGVFNLVHGFGPDSAGEFITTNDDIDAITFTGESRTGSAIMRAAATHVKPVSFELGGKNAAIIFADCDFEKMIDGMMRAVFLHSGQVCLCAERVYVERPIYNRFLDAFVERVKALKLGWPQDGTTGMGPLISAEHRDKVLSYFKLAREEGAQVLVGGGVPKFGDARDAGFWVEPTIITGLPQTARCIKEEVFGPICHVSPFDTEAEAIALANDTKYGLSATTWTGNLNRGHRVSEAMRVGLSWVNSWFLRDLRTPFGGVGLSGIGREGGMHSLNFYSELTNVCVRIDQEAVS

SEQ ID NO: 21117 - protein, 641 aa, Debaryomyces hansenii CBS767
MQFKALYKIFIAILYLKTSFAILQVRDLPENKVAPVQHRLAYAGDTGMVVSWNTYQQLEAPWVQYGLSPDSLDQTAESLESITYPTSITWNNHVVIKDLQPDTTYYYKVANSENNSDIYKFVTAKSPGSPDEFSFSVVVDMGTMGELGLSEEVGKGAEGALEPGEQNTMQSLRNGMNEFEFLWHPGDIAYADYWLKEEIQHYLPNTTIADGYKVYEQILNAFYEELQPISAFKPYMVGPGNHEADCDNGGTSDKDNDIKYTNSICVPGQTNFTGYRNHFRMPGAESGGTGNFWYSFDYGQVHFVQFNTETDFGNGLAGPEDAAPNGPQGSYPNEQIDWLENDLASVNRTKTPWVIAAGHRPWYVVGEGCTDCKTAFESILNKHNVDLVVSGHVHNYERQKPISNGIIDPNGLNDPSAPWYIVNGLGGHYDGLDPLEYPLPNYTEVAQDSAYGWSKFTVHNCTHLTHEFVASANNSVLDRATLFKNRTCIVSSTNTTDTTNPEQSSLTNSSIHSTHMYTNVSTVIDSIDPKVLDTKTKSNVKVITITSCSNNICSEASVSATPVLTTTTIQGVENILTSYCPISNTGDNKTADTIISAPYSNSSISNASSISPLMVSSVGENSAAKIAAGGVIGFIILALAF

SEQ ID NO: 21118 - protein, 865 aa, Actinidia deliciosa
MDPITDENMNKKTKHEVGEIKKIQGTVVLMKKKFLDSNDLTASVTDRFDEILGNKVSLQLISAVNGDPEKELRGKLGKPANLEDWDTKITALTAPGVTFNVTFEWEEEIGVPGAFIIKNSHHNEFYLKTVTLEDVPGHGRVHFVCNSWVYPASCYKKDRVFFTNQTYLPTETPAPLRCYREEELLTLRGNGNGKLEEWDRVYDYDIYNDLSEPEKGPKHVRPILGGSSEYPYPRRGRTGRPPAETDPRHESRIPLFKSLSIYVPRDERFSHLKFSDLVAYGLKSAVQFIVPEVEAQFDSTPSEFDKFEDILQLYEKGIKKVPNFPLLESIRNQIPLQTLKELLRTDGEQPFRFPTPQVIKEDKSAWRTDEEFAREMLAGINPVVICRLQEFPPNSKLNPQVYNNEASSKTKECIEKNLEGLTIDEALNNKKLFTLDYHDILMPYLRRINSTSTKIYATRTLLFLKNDGTLKPLAIEMSLPHPEDDKLGEVSEVYTPAEHGAEGTIWQLAKAYVAINDSGYHQLISHWLYTHAVIEPFIIATNRQLSVLHPIHRLLHPHFRDTMNVNALARQTLINGGGLLERTVFPSKYAMELSAVAYKGWVFPEQALPADLIKRGVAVEDLKSPHGVRLLIEDYPYAVDGLEIWSAIKTWVEDYCSSYYKTDDIIQEDLELQSWWNELREKGHGDKKDEPWWPKMQTHKELVETCTTIIWVASALHAAVNFGQYPYGGYLPNRPAMSRRFIPERDTPDYAELESNPEKAFLKTVTPQMLSILGISLIEILSRHTADEVFLGQRDTPEWTTDKEALKAFERFGEKLTEIEDRITRMNNDEKLRNRTGPAKMPYTLLFPTSEVGLTGKGIPNSVSI

SEQ ID NO: 21119 - protein, 572 aa, Debaryomyces hansenii CBS767
MVLGSEKKLKPVISETRRGSSASGSECDNIPSVGVTKWDRFVDSFRRQHVQHGDEGKSLQKGISSRHLILMALVTGMGTGLFVGTGNILSTAGPLFLIVGYIIVGSFLYPTLQAAGELAVNYSELSGGYNNYPLKFIDESVAFAVTWIYCIEWLSTFALELVTASITIRYWDGDQKINPDVWVTIIFVIVVLLHFVGSKAYGEGEFVIGCLKVLMVTGFLIMSIVVNVGGGPEGKFIGGQYWHDPGYYTNFKGLCTVFVTGAFAFSQSEFVALSAAEQPNPRRAIPTACKLVFWRILILFLGSLIMVGLLVPMNSPELMGASGGGSNASPFVLAATLHGVTVVPHIINAVILLSVCSVASSSLYASSRTLQSLADQGYAPKYFNYIDRSGRPLRSLIACSIVGLFSYIAAYEKQETVFNWLLSISGLAQLFTWDVICISHIRFRQALKYNGISTDSLGYTSSTGIWGSVYAIVIHWLILIALFYTALFPVGSSTPDAQSFFQNYLGAIVLVFFYVCHKLWSRNWKFYVNICDIDINTDRTIFDEEILNLEKQEFQEKYNNDPWYKKLTTILL

SEQ ID NO: 21120 - protein, 252 aa, Magnaporthe grisea 70-15
MLSYENPTPAAPSASTAAEKLATSLSSSARASKVSGSVPDNSVSQSSMASTMKATGSSASAASNSASDRSAAHIWLVTGPAGCGKSTVAQHLATSLDVPYIEGDEYHPPANIEKMSNGIPLTDMDRWDWLILLRDEALRRLGEGGSDTKGVVVTCSALKRKYRDVIRVARYFEPSVHVHFIYLAATEEALLERVARRQNHYMGANMVRSQFQDLEPPRPDETDIISIDVSGTLDDVKTSALDKVREVMAADQ

SEQ ID NO: 21121 - protein, 248 aa, Ashbya gossypii ATCC 10895
MARTFFVGGNFKLNGSKQSIKEIVERLNTADLADNVEVVICPPATYLDHAVSLVSHPQVTVGAQNAYTKASGAYTGENSVDQIKDVGAKWVILGHSERRTYFNEDDEQVAEKTAFALERGVSVILCIGETLDEKKAGVTLDVVKRQLTPVLEKVKDWTNVVIAYEPVWAIGTGLAATAEDAQDIHAAIRDFLAERTSRDVADAVRILFGGSANGANAASFRDKADVDGFLVGGASLKPEFVDIINSRR

SEQ ID NO: 21122 - protein, 308 aa, Canavalia lineata
MAKEIVGGFKFDQRHGKERVQVARVWKTKQGWYFIVEWRVGNSLLSDCVNSYVRDDNSDIVATDTMKNTVYAKAKECSEILSVEDFAILLAKHFISFYKQVTAAIVNIVEKPWERVSVDGQPHEHGFKLGSERHTAEAIVQKSGALQLTSGIEGLSLLKTTKSGFEGFIRDKYTALPETHERMLATEVTALWRYSYESLYSIPQKPLYFTDKYLEVKKVLADNFFGPPNVGVYSPSVQNTLYLMAKAALNRFPEIASIQLKMPNIHFLPVNISNKDGPIVKFEADVYLPTDEPHGSIQASLRRLWSKL

SEQ ID NO: 21123 - protein, 301 aa, Canavalia lineata
MAKEIVGGFKFDQRHGKERVRVARVWKTKKGGYFIVEWRVGISLLSDCVNSYVRDDNSDIVATDTMKNTVYAKAKECSEILSVEDFAILLAKHFISFYKQVTAAIVNIVEKPWERVSVDGQPHEHGFKLGSERHTAEAIVQKSGALQLTSGIEGLSLLKTTKSGFEGFIRDKYTALPETHERMLATEVTALWRYSYESLYSIPQKPLYFTDKYLEVKKVLADTFFGPPNVGVYSPSVQNTLYLMAKAHSSIQLKMPNIHFLPVNISNKDGPIVKFDDDVYFPTDEPHGSIQASLSRLWSKL

SEQ ID NO: 21124 - protein, 485 aa, Arabidopsis thaliana
MAMASLYRRSLPSPPAIDFSSAEGKLIFNEALQKGTMEGFFRLISYFQTQSEPAYCGLASLSVVLNALSIDPGRKWKGPWRWFDESMLDCCEPLEVVKEKGISFGKVVCLAHCSGAKVEAFRTSQSTIDDFRKFVVKCTSSENCHMISTYHRGVFKQTGTGHFSPIGGYNAERDMALILDVARFKYPPHWVPLKLLWEAMDSIDQSTGKRRGFMLISRPHREPGLLYTLSCKDESWIEIAKYLKEDVPRLVSSQHVDSVEKIISVVFKSLPSNFNQFIRWVAEIRITEDSNQNLSAEAKSRLKLKQLVLKEVHETELFKHINKFLSTVGYEDSLTYAAAKACCQGAEILSGSPSKEFCCRETCVKCIKGPDDSEGTVVTGVVVRDGNEQKVDLLVPSTQTECECGPEATYPAGNDVFTALLLALPPQTWSGIKDQALMHEMKQLISMASLPTLLQEEVLHLRRQLQLLKRCQENKEEDDLAAPAY

SEQ ID NO: 21125 - protein, 238 aa, Zea mays
MRAVVVDWLVVLAEEFELHAETLHLAVSYVDRFLTMNVVARDKLQLLAVTALLVAAKYEEIESAEMKVNIYINSMDNTYTKQQVVKMEADLLKSLNFQIGGPTVTTFLRQFIASCRGGNSTSREKLEFVCSYLADLSLLDYDCISYLPSVVAAACLFVARFTIHPKTRPWNLTLEQNTGYKVFDLQKSIYVIHELQLTIRCPDQEATRKKYKDPKFGCVSTMVSPREIPTSFPEDCHK

SEQ ID NO: 21126 - protein, 323 aa, Triticum aestivum
  misc_feature (69)..(69): Xaa can be any naturally occurring amino acid
  misc_feature (165)..(165): Xaa can be any naturally occurring amino acid
  misc_feature (173)..(173): Xaa can be any naturally occurring amino acid
  misc_feature (194)..(194): Xaa can be any naturally occurring amino acid
  misc_feature (215)..(215): Xaa can be any naturally occurring amino acid
  misc_feature (222)..(222): Xaa can be any naturally occurring amino acid
  unsure (1)..(323): unsure at all Xaa locations
MASDGVVALYGNNKAVVEPSAKPAAATFSVKVGLAQMLRGGVIMDVVTAEQARLAEEAGACAVMALERXVPADIRAQGGVARMSDPALIRDIKRAVTIPVMAKARIGHFVEAQILEAIGVDYVDESEVLTLADDAHHINKHNFRVPFVCGCRDLGEALRRIREGXAAMIRTKXGEAGTGNRGGGPSATSGSRDXAARPGPLRNMDEDEVFSYAEXIAAPYDXLVIQTQAVGPASRVVAVRPPAGVATPADAALMMQLGCDGVFVGSGIFKSGDPARRARAIVQAVTHYSDPEILANVSAGLGEAMVGINLSDPGVERFAARSQ

SEQ ID NO: 21127 - protein, 481 aa, Mannheimia succiniciproducens MBEL55E
MSGEKTSRYVLGVTLVATLGGLLFGYDTAVISGTVSSLDTVFIQPKGLPEISANSLLGFCVASALIGCIIGGACGGYLSSKYGRKKALLIAALLFLISAFGSAYPEFGLKTINETNNIPYYLSNFLIQFVIYRIIGGIGVGIASMVSPMYIAEITPARIRGKMVSFNQFAIIAGQLIVYFVNYFIALNGDNTWLNMLGWRYMFLSEMVPAALFLILLFFVPESPRWLVLQNKFSQAEITLLKLLGERSGKTELQNIVSSLEHRVVKGAPLFSFGLGVIVIGIALSVFQQFVGINVALYYAPEIFKSLGASTNNALLQTIIMGTINLSCTTIAIFTVDKYGRKPLQIIGALGMAMGMFVLGMAFYANLSGTIALTGMLFYVAAFAISWGPVCWVLLAEIFPNAIRSQALAIAVAAQWIANYIVSWTFPMMDKSSYLVERFNHGFAYWVYGLMAILAALFMWKFVPETKGKTLEELELLWNKK

SEQ ID NO: 21128 - protein, 461 aa, Oryza sativa (japonica cultivar-group)
MVNGEAEAECTRASLLGRYEIGRTLGEGNFGKVKYARHLATGAHFAIKILDRNKILSLRFDDQIRREIGTLKLLKHPNVVRLHEVAASKTKIYMVLEYVNGGELFDKIAVKGKLSEHEGRRLFQQLIDAVSYCHDKGVYHRDLKPENVLVDRRGNIKISDFGLSALPQHLGNDGLLHTTCGSPNYIAPEVLQNRGYDGSLSDIWSCGVILYVMLVGYLPFDDRNLVVLYQKIFKGDTQIPKWLSPSARDLLRRILEPNPMKRINIAGIKEHEWFQKDYTPVVPYDDDDDNYLDSVLPIKEQIDEAKQEKPTHINAFQLIGMASALDLSGFFEEEDASQRKIRFTSTHSPKDLFDKIENVVTEMGFQVQRGNSKLKVMKNGRGSKNLRNPSSFLVCTEVVELGPSLYVVELKKSHGDPILYRQLCERLSDELGVCKTEQIQRTESLEDDLESFDSGSSLPGF

SEQ ID NO: 21129 - protein, 1028 aa, Zea mays
MVAACRSTASTYAFLLLLLFAAAVAVSSSSGLRRVQDQDRSALLQIKNAFPAVDLLQQWSPDSSGRNHCSWLGVTCDSSSRVVALEVLSPSRRFGPSQELAGELPAAVGLLTELKVVSFPLHGLRGKIPGEIWRLEDLEVVNLAGNSLRGALPASFPPRLRVLSLASNLLHGEIPSSLSTCKDLERLDLSGNRFTGSVPRALGSLPNLKWLDLSGNLLVGGIPSGLGNCRLLRSLRLFSNSLHGSIPAGIGKLRKLQVLDVSRNRLSGLVPPELGNCSDLSVLVLSSQSNSVKSHEFNLFKGGIPESVTALPRLRVLWVPRAGLEGTLPSNWGRCSNLEMVNLGGNFLSGAIPRDLGQCSNLKFLNLSSNRLSGLLDKDLCPHCMTVFDVSGNELSGSIPACVNKVCTSQLMLDEMSSSYSSFLMSKTLQELPSVFCNSGECSVVYHNFAKNNLEGHLTSMPFSADRFGNKTSYVFVVDHNNFSGSLDSILLEQCSNLKGLVVSFRDNKISGQITAEFSRKCSAIRALDLAGNQISGMMPDNVGLLGALVKMDMSRNFLEGQIPASFKDFKSLKFLSLAGNNISGRIPSCLGQLRSLRVLDLSSNSLAGEIPNNLVTLGDITVLLLNNNRLSGNIPNFASSPSLSIFNVSFNDLSGPLPSKIHSLTCNSIRGNPSLQPCGLSTLSSPLVNARALSEADNNPPADNTAPDDNGNGGGFSKIEIASITSASAIVAVLLALVILYIYTRKCASRPSRRSLRREVTIFVDIGAPLTYEAVLRASGSFNASNCIGSGGFGATYKAEVAPGKLVAIKRLAIGRFQGIQQFQAEVKTLGRCRHSNLVTLIGYHLSDSEMFLIYNFLPGGNLERFIQERSKRPIDWRMLHKIALDVARALAYLHDNCVPRILHRDVKPSNILLDNDYTAYLSDFGLARLLGNSETHATTGVADKKALDPSFSPYGNGFNIVAWACMLLQKGRAREFFIEGLWDVAPHDDLVEILHLGIKCTVDSLSSRPTMKQVVRRLKELRPPSY

SEQ ID NO: 21130 - protein, 436 aa, Gloeobacter violaceus PCC 7421
MTVPLSELAREKGIRYFLISFTDLFGTQRAKLVPTQAIDAIAASGAGFAGFAAWMDMSPADPDMFAHPDAGSVFQLPWQPEVAWMPADLFTPEGTAIAQTPRLVLKRVLKLALELGYRVRTGVECEYFLLAADEVQIADSRDFQSKPCYDQQALMRRYAVISEICDAMNALGWGAYQNDHEDANGQFEMNWTYADALVTADRHAFFKYMVKTVAEKHSLRATFMPKPFMHLTGNGCHTHLSVWDSEGKVNRFDDPRGELGLSPLAYHFIGGVQHSAEALCAFANPTVNSYKRINAPITASGATWSPNTISYSGNNRTHAIRIPEPGRFELRLADGAANPYLLPAALTAVGLDGIAHQRDAGPRRDNNSYTNPLPPESAKPLPANLLDALRALESDTVLSEAMGADFVASYLKLKHREWQDYCARVTPWELEHTLDC

SEQ ID NO: 21131 - protein, 343 aa, Neurospora crassa
MATTAMDYENANGDRFDEDAPRYDRDRSASPRRDDGHDSSRRRSMSPNGNDRAPAKDEGQSKGGEEDGARNPGSNLFVTGIHPRLEEAEVTRLFEKYGEVEKCQIMKDPHTGESRGFGFVKMMTPEQANAAKEGLQGEVIEGRTLSIEMARRARPRTPTPGKYFGPPKRGEGRFDDRNGRRGGGFGGGYGGGRDDSYRGYRGGGYRDDRGYDRGYDRGYDRSGGYGGGDRGYERNSYREDRGYDRSYRGEDRGYDRRERGGADEAYGRGGDRYRDDRGGERYGGSGRGGPDERRAPGYDRDRGYDRPSDRDARPPRDAAPGTSSYGEPAPREAREPYGTYSNV

SEQ ID NO: 21132 - protein, 206 aa, Zea mays
LMGEEASCDAVSLTEAGTNAKPVGKEVGREPAAAPAAAADPRLQGISDAIRVVPHFPKQGIMFNDITTLLLRPRVFKDAVDLFVERYRGMGIDAVAGIEARGFVFGPAIALAIGAKFIPLRKPRKLPGEVISEKYVLEYGTDCLEMRVGAIERSGERVLVIDDLVATGGTLCAAIRLLERAGADVVECACVIGLPKFKVPRCWIHN

SEQ ID NO: 21133 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPNTRYPGVDFDGGFASFVVVPESVCWPVPCGIPPLQAAMMEPFGLAVHASLEGSGVSGLNVLVSGCGPIGLMNIAAAKALGASKVIATDIHPLRLTAAAKMGADECINATEESVYKTVRSLLGERGVDVAIDYSGQAAALKELIQSITHGGELRLMGVPSHDILLNLEEWLFKGLIVRGLHGRRLFETWERSTSLLVTGRVDLSSLVSHRLPLSAAEDAFEMALNGESLKILFEPNGTCI

SEQ ID NO: 21134 - protein, 341 aa, Rhodococcus sp. RHA1
MVHTETVQPQSIWDPDVAIMVRRMRDNRVGPLHTVGVEGARDALESIVRPPGPEMRSVHDTEIDGPHGKIPVRVYRPLGAPRTDSPALVWFHGGGMIMGTLRSFDRLAREIADATGAVLFNVDYRLAPEYRYPVANDEAYAALRWAHDTAAEWGIDTRRIGVGGDSAGGGLAAATTLRSRDENGPGIAQQVLFYPGIERRTDRPSMREFGDSPFLSAEDIDWMKNLYLGEDPFTDDSYGVPALATSLAGLPPAVLAVGQGDPIRDAVEAYGDRLRDAGVPTAQLRYPGVGHGFAMQTASIARARTAMAEVGALVAARFRQLPQSAPACGASPRPTAVDPVN

SEQ ID NO: 21135 - protein, 523 aa, Magnaporthe grisea 70-15
MFLQRGSRHLLRQLPKGVIAIPTTPTVTTTVSARSRQQPTQQRQQQRHCRTTRGFHSTRRLLDVKPVLLADIGEGIVECEIIQWFVEPGARVEEFSPLCEVQSDKASVEITSRFSGVVKKLYYDAGEMAKVGKPFVDIDITGDLEAEPEKVLAGDVAPAKPVEEKTTQKAVETAPDMIGTPASVGGAERKRGKCAALATPAVRHLSKELKVDINEIDGTGRDGRVLKEDIYKFVQGKQSGSGVAPTIPAAPAAPAPQAASKVPPTPAPLPSQPGTPQTEEVMQLSHTQQMMFKTMTRSLTIPHFLYADEIDFTSLVELRTRLNRVLAAGGTGGPGTAEISKLSYLPFIIKAVSLALYQYPILNARVDIPSDGGKPSLAMRKQHNIGVAMDTPSGLLVPVVKNVNERNVLSIAAELVRLQSLATAGKLSPADMSGGTMTVSNIGSIGGTYLSPVVVEREVAILGVGRMRTVPAFDENDKVVKKHVCNFSWCADHRVVDGATLARAANMVRQVVEEPDVMVMHLR

SEQ ID NO: 21136 - protein, 375 aa, Arabidopsis thaliana
MVTKAEKQFAKNFNIDDLPDVPAGLPPHLKAQQTRVVSKNNAPAHTASAIYSGTYVSSTEEDDNVKLGNFYDNFKVDVVSLTKTDMEFDMIGIDAAFANAFRRILIAEVPSMAIEKVLIAYNTSVIIDEVLAHRMGLIPIAADPRLFEYLSEHDQANEKNNIVFKLHVKCPKNRPRLKVLTSDLKWLPNGSELLRESENKTSKPKTYTSFSCSQDSLPEFANNPITPCDLDILIAKLAPGQEIELEAHAVKGIGKTHAKWSPVGTAWYRMHPEVVLRGEVEDELAERLVNVCPQNVFDIEDMGKGKKRATVAQPRKCTLCKECVRDDDLVDHVDLGSVKNHFIFNIESTGSLPPEVLFTEAVKILEAKCEAITDF

SEQ ID NO: 21137 - protein, 655 aa, Debaryomyces hansenii CBS767
MATAATIDMADEVNPPLTYEPVDLDIPASKIYGTLKPNHNGLENKNLYELASKWIDAFNAIVKEIQNDPSEKNLDKLNSVIASHASWKDHLALSWDYRQFHDLDNIKDVAKNSFPSFKLKNFEIDTTADHRFDKAVGLQTIDKADETNSIPIQWVQIIVKFENEFGYGNGLIRLISVDEKDAPGGLKAFTIYTALENIKGNEETLGRSRPQGVNHGQNQGRISWLEKREKDFEWGSEKTPTVLIVGGGQGGLNVAARLKTMGIDCLIIEKNSKIGDNWRNRYKFLVLHDPVWYDHLAYIKFPDVWPVFTPKDKLGDWFEAYSKSMELSYWVNKTVSGADFDPVTGVWSVNIIDNDTGKLTNIKTKHIVMATGHSGEPNIPTFKDQDKFKGTIVHSSQHSTGKSFQGENAVVVGCCNSGHDIAQDFYEQGAKPILVQRSTTCVINSEIGLKVTTKGLYEEGGPKTETADLILQSMPVKLLNLVMQQQYRQTMILEKDLHESLKKSGFKTDSGYGGTGLFGKYYRRGGGYYIDVGCSKLIADDKIKVQQGKNIERFTENGLVFSDGTKIDNLAIVVLATGYSNMRDTARRIFGDKVADKLNPVWGLDDEGEINTMWRDSGHPKFWYMGGNLAVSRYFSKRLALKIIAQERGFDKSNS

SEQ ID NO: 21138 - protein, 527 aa, Burkholderia sp. 383
MSAGPAGLTHDVPAAPFERNATMSDSVAKPVDATFDQFGLAADILKAIAEQGYTTPTPIQAQAIPVVLAGRDVMGAAQTGTGKTASFSLPIIQRLLPQANTSASPARHPVRALILTPTRELADQVAANVHAYAKHTPLRSAVVFGGVDMNPQMAELRRGVEVLIATPGRLLDHVQQKTANLGQVQILVLDEADRMLDMGFLPDLQRILNLLPKERQTLLFSATFSGEIKKLASTYLRNPQTIEVARSNSTNANVTQIVYDVAEGDKQAAVVQLLRDRGLKQVIVFCNSKIGASRLARNLERDGVVASAIHGDKTQIERMQALDAFKRGEIEALVATDVAARGLDIAELPAVINFDLPFSAEDYVHRIGRTGRAGATGDALSLCSPNERKQLADIEKLIKRPLEMQTLALDKPARHRHDERGNDRGGDRNSERGGERGGERGGERGGRRDRDEHRGASAGRRPGGSERGHHRRHEAPVDDFFLKPYEPSAPAKQQDDAQPAQQPEKKGPKRQVAALLGGFGMPRKPSA

SEQ ID NO: 21139 - protein, 1122 aa, Silicibacter pomeroyi DSS-3
MPKRTDIQSIMIIGAGPIVIGQACEFDYSGAQACKALREEGYRVILVNSNPATIMTDPGLADATYIEPITPEVVAKIIEKERPDALLPTMGGQTGLNTSLALEEMGVLDKFGVEMIGAKRHAIEMAEDRKLFREAMDRIGLENPKATIVSAPKNEKGKFDIRAGLAEAMDALEDIGLPAIIRPAFTLGGTGGGVAYNRDDYEHFCRSGLEASPVAQILIDESLLGWKEYEMEVVRDKADNAIIVCSIENVDPMGVHTGDSITVAPALTLTDKEYQIMRNGSIAVLREIGVETGGSNVQWAVNPADGRMVVIEMNPRVSRSSALASKATGFPIAKIAAKLAVGYTLDELDNDITKVTPASFEPTIDYVVTKIPKFAFEKFPGSEPYLTTAMKSVGEAMSIGRTIHESMQKALASMESGLTGFDEVTIPGLSVGLWDAVEGADDKAHVIKAISRQTPDRLRTIAQAMRHGLSDDEIFGVTKFDPWFLARIREIVEEERALRKTGLPTTEEGLRALKMLGFTDARLGQLTGRDEDNVRRARHNLGVTAVFKRIDTCAAEFEAQTPYMYSTYEAPMMGEVECEARPSDRKKVVILGGGPNRIGQGIEFDYCCCHACFALTDVGYETIMINCNPETVSTDYDTSDRLYFEPLTFEHVMEILRVEQQNGTLHGVIVQFGGQTPLKLANALEQAGIPILGTTPDAIDLAEDRERFQDLVNRLGLKQPRNGIASTDAQALAIAEDIGFPLVIRPSYVLGGRAMEIVRDMDQLRRYIAEAVVVSGDSPVLLDSYLSGAVELDVDALCDGEAVHVAGIMQHIEEAGVHSGDSACSLPPYSLSAEIIEQIKDQTNKLARALNVVGLMNVQFAIKANEQGVDEIYLIEVNPRASRTVPFVAKATDSAIASIAARVMAGEKLSAFPMRPPYKEGEDTKIADQMTLADPNMPWFSVKEAVLPFARFPGVDTILGPEMRSTGEVMGWDRSFARAFLKAQMGAGMVLPSEGRAFISIKDADKGAAMLEAAQVLVDQGFTLVATRGTQSWLEGHGVPCEIVNKVYEGRPDVVDMLKDGQVHLVMNTTEGAQAVSDSKAIRSIALYDKIPYFTTAAGSNAAALAIKAQAEGDIEVRSLQG

SEQ ID NO: 21140 - protein, 706 aa, Saccharomyces cerevisiae
MSFLPLRSRSRSGAPHWVYIILYHIFTIPKIYSLPLLSGSHVLNSRDVADSGHSVGDEASVTTYYIISIILVLLGGVFAGLTLGLMGQDEVYLKVISTSGSNSEKKLAKRVLDLISRGKHWVLVTLLLSNVITNETLPIVLDRCLGGGWQAVVSSTILIVIFGEIIPQSVCVKYGLQVGAFFCPFVLVLMYLMYPVAYPIATLLDYMLGEDHGTMYKKSGLKTLVTLHRTMGVERLTKDEVTIISAVLDLKAKRVEEIMTPIENVFTMSADTILDDKTVEKIFNSGFSRIPIFLPNEPNNFIGMLLVRVLISYDPDDCLPISHFPLATLPETSPNTSCLNILNYFQEGKAHMCVVSKEPGSSHGAIGVLTLEDVIEELIGEEIVDESDVFVDMHQHIMRQQPGPLSKRHITSYLHHLYTSSHKEHKAADQADESSPLLSPSNSNHPSEHPQQDLNNKSWKQKSNDGYDRSNAVLSPTPQVTEHGTIIPSNLASNPLNVNKSFVTIKKPANVPKIITTHTPHSSKEPSPAPHSNDKSLSAEEQQLLSDHAELSRQAVLHTQRSGQPTQVTTSTKTTRNSPDSISIPNSGANHGNENQNVTISTSYQNTKNGIVESVITVKGVPKTIIGPAKDWDESKSEYGNENINQENSNRSDDRESSSSNASLFSSIKNKFKNENANNNDRSNFTDSLSRTSNYDANGSSSTIKR

SEQ ID NO: 21141 - protein, 303 aa, Saccharomyces cerevisiae
MTVTDTFKLFILRHGQSELNSENIFCGWIDAQLTEKGKSQARHSAKLIKQFCDSNNISLPQIGYTSRLIRTQQTMDVILEELGLKHTNYVITTNTNIKEELQDTRFEGSMPVLQTWRLNERHYGAWQGQRKPDILKEYGKEKYMYIRRDYNGKPPKVNLNLEMVQEENDQGSSTGYDFKEPNRHLKYGPEEKANERLPESESLCEVVVRLKPFLNNVVLSTANKISQESCVIVGHGSSVRSLLKVLEGISDEDIKDVDIPNGIPLVIELDRDNYSFVRKFYLDPESAKVNAQMVRDEGFEKNP

SEQ ID NO: 21142 - protein, 312 aa, Synechococcus sp. WH 5701
MPPEISAHTSLVAVLGDPIRHSLSPAMHNAALRQLGLDWVYLALPVQANDLAVVVRALEAIDCRGLNVTLPHKRAVAELAAELTPLARRVGAVNTLVRREGGGWLGTNTDVEGFLAPLRGIANAEGVSVPDLAGGRALVLGCGGSARAVVAALVELGLERIQLAGRRPDALAAFQAECGSWAAQLSGVAWPAAAGERGDLIKALAEADLVVNTTPVGMGASSSACPLDAAELDALRAGSLIYDLIYTPRPSRLLQEGRQRGCGVLDGLEMLVQQGAAALRLWLGEPERGHSEPMPLPLAAMRQAALDQLGNA

SEQ ID NO: 21143 - protein, 645 aa, Clostridium perfringens SM101
MCKKPYYITTPIYYPSTNLHIGNTYTTVAADAIARFKRLTGHEVMFLTGTDEHGQKIERIANEKGITPKEHVDEIVAGIKDLWKMMNISYDKFIRTTDDYHVKAVQEIFKKLYDQGDIYKDSYEGLYCTPCESFWTETQLVNGNCPDCGRPVEKAKEEAYFFKMSKYADRLIQYIEEHPDFIQPESRKNEMLNNFLRPGLQDLCVSRTSFTWGIPVSFDEKHVIYVWIDALSNYITALGYGQENQELYKKFWPADVHLIGKDILRFHTIYWPIMLMALGLELPKQVFGHGWLLVDGGKMSKSKGNVVDPVVLVNMFGADAVRYYLLREIPFGSDGLFNNEIFIKKVNTDLANDLGNLLSRTIAMVYKYFDGVIQAPTCKEAIDDELINLALSTPGKVEASIDALKIPEALESIWTLISRANKYIDETTPWILAKDEEKKERLGTVLYNLLETLRFVSVMISPFLTETSVKINDQLNTKVTTWESLKEFNGTVAGDKVVKGDVIFPRIDVEEKLAELEALKPAPVKPANEELVKNPIKEEITIDDFDKIDLRVVKVLECEPVKKAKKLLKLKVDLGGEERQVISGIAQYYKPEELVGKYVVLVANLKPVKLRGELSQGMILAAAPSDDSELVLVNPGEMLTGSQVR

SEQ ID NO: 21144 - protein, 663 aa, Methanocaldococcus jannaschii DSM 2661
MQNWFKSGDSLNLVDLYVKKFMDLIEIERRCEMDFHKNEIIKLGKKRENVGRAILNLKGKFLGESLGCTIVRFGRKKPFKTEISPGDVVLVSKENPLQSDLYANVIYVGKNFIDVAFDVDVPKWVYKERVRVDLYVNDITFKRMKEALREFARKRDKLAYIILGIEHPEKPLREDIKLEFYDKNLNESQKLAVKKAVLSRDLYLIHGPPGTGKTRTITEVIVQEVKFNKHKVLATADSNIAADNILEYLIKKYPDLKVVRVGHPTRISKDLIQHSLPYLIENHEKYQEILALREKIKEIKEQRDKFLKPSPRWRRGMSDEQILKVAKRKKSYRGIPKEKIVSMAEWIIRNKKIKRIINNLDEITEKIMNEILAEADVIVATNSMAGSEILKGWEFDVIVIDEGSQAMEPSCLIPIVKGRKLIMAGDHKQLPPTVLSENEELKKTLFERLIKKYPEFSSILEIQYRMNEKIMEFPNKMFYNNKLKADESVKNITLLDLVKEEEIDEVDRDIINEIPVQFINVEGIERKDKESPSYYNIEEAEKVLEIVKKLVKYKIPTNVITPYDAQVRYLRRLFEEHNIDIEVNTVDGFQGRENEAIVISFVRTKNFGFLKDLRRLNVAITRAKRKLILIGNENLLKQDKVYNEMIKWAKSVEEEHKNKIIQK

SEQ ID NO: 21145 - protein, 316 aa, Paracoccidioides brasiliensis
MAEQLVHRGTLEGHNGWVTSLATSLENPNMLLSASRDKTLIIWNLTRDDTAYGYPKRSLHGHSHIVSDCVISSDGAYALSSSWDKTLRLWELATGNTTRTFVGHTNDVLSVSFSADNRQIVSGSRDRTIKLWNTLGDCKFTITDKGHTEWVSCVRFSPNPQNPVIVSAGWDKLVKVWELSSCRIQTDHIGHTGYINTVTISPDGSLCASGGKDGTTMLWDLNESKHLYSLQAGDEIHALVFSPNRYWLCAATSSSITIFDLEKKSKVDELKPEYVEKGKKSREPECISLAWSADGQTLFAGYTDNKIRAWGVMART

SEQ ID NO: 21146 - protein, 634 aa, Desulfotalea psychrophila LSv54
MCGLAGFFNYQFIADNTILHLQSMGKSISHRGPDASGTWYDADTGIGLVHTRLAIVDLSSAGHQPMHSQCDRYVIAFNGEIYNHLMLRQKLEQANQAPAWRGHSDTETLLACFVAWGIEQTLKVTVGMFALALWDKQEQNLTLARDRAGEKPLYWGWQGDTLLFGSELKALKAHPDFKAKVSRDALAVYMRHNYISAPQSIYEGIYKLLPGHYVTLNSVSNIDTATPKAYWTMNQAIESGIAQPFSGTDIEAVDLLEHRLSQSIGGQMLADVPLGAFLSGGVDSSVVVALMQKQAQQSVKTYAIGFDDPRYNEAQYAAAVARHLGTEHTELYVSAQDALELVPQLPSIYCEPFADSSQLPTFLVTKMARQHVTVALSGDGGDELFGGYTPYLFTPRYWNLLKCYPQPLRAALAASMSRLPLPDKFLKLAEVMGASNKESFYRSIMSHWGQPEDVVIGAKEPASVLNSSDLWPETDSFEHWMMAMEAQMYMPDDILVKVDRAAMANSLETRVPLLDHRVIELAWQLPLSMKIRDGKGKWVLREVLYRHVPRELIERPKKGFSIPLANWLRGPLRDWAEALLDEKRLRGEGYFYPAPIREAWQQHVQGKRDNASKLWSVLMFQAWLDEQDANSITL

SEQ ID NO: 21147 - protein, 172 aa, Streptococcus agalactiae A909
MDLNNYIASIENYPQEGITFRDISPLMADGKAYSYAVREIVQYAADKDIDMIVGPEARGFIVGCPVAYALGIGFAPVRKPGKLPREVISANYEKEYGLDTLTMHADAIKPGQRVLIVDDLLATGGTVKATIEMIEKLGGVVAGCAFLVELDGLNGRKAIEGYDTKVLMNFPG

SEQ ID NO: 21148 - protein, 528 aa, Oryza sativa (japonica cultivar-group)
MEIVDGASPPLHPWSLLLYALGALAALWWAWRALDRFWLRPRRLGRALRSQGLRGTDYRFPSGYLKEFARLLAAALAAPMPPLSHDVASRALPFELAAIKQHGNVCVTWFGPEVRVIVSDPKLFREILANKNGRFGKQKSILWVQNLLADGLTSHQGEKWVAHRRIMNHAFHLEKLKRMLPAFAACSSELISRWQDSVGADGAQEIDVWPEFQNLTGDVISRSAFGSSFSEGRRIFQLQSEQARNVMKMAKALYFPGYRFLPTELNRRTKANAREVRELLKGIITKRESAMKDGHAVNDDLLGLLLETNIKESQEAGSSKPTMTTKDIIEELKLLYFAGSDTTAVLLTWTMVLLSMHPEWQDRAREEVLRVFGKNSPDFEGINHLKVVTMILHEVLRLYPPILLLGREAYEETELGGVTYPPGVTFALPIAGIHHDPDVWGEDVGEFKPERFAEGVSRASKDSPALVPFSWGPRICVGQNFALLEAKMALSMILQRFSFGLSPSYTHAPFPIPTLQPQHGAQIKLTKL

SEQ ID NO: 21149 - protein, 390 aa, Zea mays
MGGEFRSSLMQQMVWSSSGGGTDSKNMMSSSLMPCAEEQEEEGSNKMPPLSSPSMLLLPQHHLQIFSGLPLPLPPEVLNDSSATSDLHDGRESSMPESWSQLLLGGLVGDHERYNAATALLSKGLEERPAAYNCYDPGHGGGEEIQTSGTNIRSHQVSQALLASSSPRSCITTSLGSNMLDFSNTTVPPAPDLKNHHSDNSSEGNSAGSGSAPKKARVQTSSSAQSTLKVRKERLGDRITALHQIVSPFGKTDTASVLQETIGYIRFLLSQIECWKALRISAALSFPYLGHDNGDSMQQHNTNNLLLNHSTSDAMVQVQGPPMTNQEGEVYGNGIEEGSRKDLRSRGLCLVPVSCTSHLADDNGPSDFWAVSAAPSPPPPPPPFAGIIWR

SEQ ID NO: 21150 - protein, 360 aa, Mycobacterium sp. JLS
MATEDPLRLGVVAGDGIGPEIVSAAVQISERALAAVSVPVDWRRLRMGAEAITAEGTPLPEATLAELDRLDAWLLGPHDNAGYPAPFRDALSPGGTIRKRYGLYANIRPARRLSGAIPAVCPTLDVVVVRENTEGFYSDRNMYDGPGEFMPTADVAMAVAVFTREACERIAHQAFRLARTRRRSVTVAHKANVLSKTTGLFRDSCVRVAEQYPDVTVRLEHIDALAALLVARPAEFDVIVAENMFGDILSDLTGQLAGSLGMAPSVNLSDTKAMAQAAHGSAPDIAGRNIANPVAMILSTAMLLEWLAERHHRGALADAATRIRDAVCRSLDDGVHTPDLGGAATTTGFTEHVLSVLASA

SEQ ID NO: 21151 - protein, 350 aa, Mycobacterium sp. JLS
MSAHRIAVIPGDGIGTEVTASARTVLDAVAARHGIDLSYEEFDWSCRRFERDGAMMPADGLETLSGFDAILLGAVGWPGVPDHVSLWGLLIPIRRAFRQYVNLRPIRVFDGVASPLRDATDVDFVVVRENVEGEYSEIGGRINRGFPDEMAVQESVFTRVGVTRIADYAFDLAETRRRYVTSATKSNGIVHTLPFWDEVVAERAANHPGVRFDSEHIDALAAKFVLQPGRFDVVVGSNLFGDILSDLAAAVAGSIGIAPSANLDPTKQNPSMFEPVHGSAPDIAGRGVANPIGAVWSAALMLEHLGHASAAADVMTAVERTLAQPQTRTADLGGHASTAEVTDALAAQLR

SEQ ID NO: 21152 - protein, 320 aa, Rhodococcus sp. RHA1
MSKRRSDLHPEVEAMLSSLEVFPDVTQHRAADLRDMIVSRRLPLTRQPEMRKVDDLVIEGPGGALALRVYAPYRDESVLPVVVFAHGGGFVFCDLDSHDEFCRSMADAVGVVVVAVDYRLAPEHPGPAAMEDVYCALNWAAENISAYGGDPEQIAVAGDSAGGNLAATVSLAARDRGGPKIVAQILLYPVIDDDFSTESYELYGEGYYNTTRAMRWYWKQYAPHGTDDPYLVPSKADSLAGLPAAVVATAELDPPCAAGEMYAKQLAAADVPVTEYRFDGLFHGFLTFPALSLTGPARARLWRMMREVLTLPAASNYRSH

SEQ ID NO: 21153 - protein, 460 aa, Bacteroides thetaiotaomicron VPI-5482
MKSYNKKFVYSICLVSAMGGLLFGYDWVVIGGAKPFYELYFGIADSPTMQGLAMSVALLGCLIGAMVAGMMADRYGRKPLLLISAFIFLSSAYATGAFSVFSWFLAARFLGGIGIGIASGLSPMYIAEVAPTSIRGKLVSLNQLTIVLGILGAQIANWLIAEPIPADFTPADICASWNGQMGWRWMFWGAAFPAAVFLLLACFIPESPRWLAMKGKREKAWSVLSRIGGNRYAEQELQMVEQTSASKSEGGLKLLFSRPFRKVLVLGVIVAVFQQWCGTNVIFNYAQEIFQSAGYSLGDVLFNIVVTGVANVIFTFVAIYTVERLGRRALMLLGAGGLAGIYLVLGTCYFFQVSGFFMVVLVVLAIACYAMSLGPITWVLLAEIFPNRVRGVAMATCTFALWVGSFTLTYTFPLLNTALGSYGTFWIYSAICVFGFLFFLRALPETKGKSLETLEKDLIK

SEQ ID NO: 21154 - protein, 227 aa, Magnaporthe grisea 70-15
MASSGAGGWSTLRNQARTLEKDTEALFHTYSQIATSSNIPAKPTEQERETEARLREILDKRENVIAQLTRLLDSDSDLASSSTKVRNLALFRDKLAEQRRELPRLRSRIQETRNRANLLSNVRNDIDAYRASNPEQAEAEYMLDERSRIDNSHSMADDVLYQAYAINDNFNSQREMLASINRRITLAASQVPGINTLMTRISAKKRRDGIIMGSFIAICFFVFWFFL

SEQ ID NO: 21155 - protein, 323 aa, Trichodesmium erythraeum IMS101
MTTSTLLFSPVEADLQLLTNNLKQLVGARHPILYAAAEHLFRVKGKRIRPAIVLLISRTTMLTQEITPKHRRLAEITEMIHTASLVHDDIVDESEIRRGVPTVHSLFTNRIAVLAGDFLFAQSSWYLANLDNLEVVKLLSKVIMDLAEGEIQQGLHRFNTDLSIEAYLEKSYYKTSSLIANSSKAAAIISDVPPEIVQDMYYYGRYIGLAFQIVDDILDFTSATESLGKPACSDLKSGNLTAPTLYALEEKPALEKLLERELAQDSDLEEAIQLIKNSRGIKRSQELATKYAKMAVEHLQSLPDCDSRQALINLTDYVLSRLS

SEQ ID NO: 21156 - protein, 212 aa, Ostreococcus tauri
MAHVDASMPASPSSPTASAWADASAPITVRVHVYDLTGDDAMHAAARMCGLGIHHSGCEVLEREYAFGYHDVRGITGVFDVAPMKAPMPATYRETIEMGRIDMTREEVGEAIDELRAAWPGTSYDLLKRNCNSFTEAMVMRLTGKMIPGYVNRLATIGCLAREYAPCLLPTSLVGDLRTLPAATGDEGSDTEDEEDAEEVQLLAVNPVEEMK

SEQ ID NO: 21157 - protein, 142 aa, Brassica napus
YNSSINIAVAVAIDGGLITPVLQNADKVDIYSLSRKWKELVDKARAKQLQPQEYNTGTFTLSNLGMFGVDRFDAILPPGTGAIMAVGASRPTVVATKDGRIGMKNQMQVNVTADHRVIYGADLAQFLQTLASIIEDPKDLTF

SEQ ID NO: 21158 - protein, 692 aa, Clostridium perfringens SM101
MKRIQSTCNYCALACNLDFYTEDGKIKRVVPTPHYPVNKGFSCIKGLNLDKQCTKFNGSKKPLLKMKDGERKAIEWKEAFDLFASKMTAIQEKYGKESVAYISTGQLPTEEMALLGHVGRSYMGINGDGNTRLCMASAVVAYKQSFGFDAPPYTLKDLELSDTIFFIGANPVIAHPIAWGRVRKNKDAKIITIDPRKSETAMNSDMWIDIKTKGDLALFYTLANVLIEKGWIDQDYINNYTEGFEDFKAHVKKYTLEDVEERTGISKMRVLELAKIIHEGKRVSFWWTMGVNQSYEAVRTAQAIINLALITGNMGREGTGANSLTGQCNAMGSRMFSNTTALYGGGEYNNKERRKVVADILGMDENMLPSKPTLDYEQIIKGINKGEIKGLWVICTNPRHSFSNNEEFKKAMKNLDFFVVQDIYEDTDSSKECDLYLPSVPAIKKEGFLINTERRLSAMVPVLEKEEDELSDYEIFLGIGEALGMGSLLDKWRTPKDAFNLLRECSKGMPCDITGVTYERLRGSKGIQWPCREGEELEADERRLFEDGKYYTPSGKAKFIFEDVTENPNATNEEFPFNLNTGRGTVGQWHTHTRTREIQAVINIVPQKAYVDINRKDAERLDIKENDEVLIHSSNGHTSKFIARLTDNLKEKDLYAPIHYIETNLLTPSVFDPYSKEPSYKTVQVNIEKVRK

SEQ ID NO: 21159 - protein, 168 aa, Sorghum bicolor
MAAADVEYRCFVGGLAWATNNETLEQAFANFGQVIDSKVITDRETGRSRGFGFVTFSSEQSMLDAIENMNGKELDGRNITVNQAQSRGGGGGGGGYGGGGGGYGGREGGGYGGGGGGYGGRREGGGGYGGGGYGGGGGGYGGREGGGGYGGGGGYGGNRGDSGGNWRN

SEQ ID NO: 21160 - protein, 157 aa, Daucus carota
MAEVEYRCFVGGLAWATNDESLEQAFSQFGDITDSKIINDRETGRSRGFGFVTFKDEKSMRDAIEGMNGQELDGRNITVNEAQSRGSGGGGGRREGGGGGYGGGGGYGGRREGGGGGGYGGRREGGGGGYGGGGGGYGGRREGGDGGYGGGGGGSRW

SEQ ID NO: 21161 - protein, 441 aa, Propionibacterium freudenreichii subsp. freudenreichii
MSVSDELFAEALKVMPGGVSSPVRAYRSVGGTPRFVKRALGSHIVDVDDKRYVDLVCSWGPMIAGHAHPEVVAAVLQAVADSTSFGAPSEVELRLAQAVVARMGGAIDKVRFTCSGTEAVMTAARLARGITKRPLLVKFVGCYHGHSDSFLVSAGSGVASLGLPDSPGVPKEVAGDTVALPYGRIDMVEELFAERGDQVAAIVTEGVPANMGVIVPPEGFNRRLHDIAHAHGALLIQDEVLTGFRLSPTGAWGLQGAKEGWTPDLFTFGKVIGGGMPLAAVGGSAQLMDYLAPEGPVYQAGTLSGNPAACAAGLATLALMDDAAYSRLDATADRVSAMADAALESAGVPHRINKVSNLFSVFLTDAPVTDFASASKQDTKAFSRFFHAALDAGLWLAPSGFEAWFCSTALDDDDLEVIDAGLHKAAQAAAQGLSSLEDVRR

SEQ ID NO: 21162 - protein, 429 aa, Xanthomonas campestris pv. phaseoli
MNHSRSHALFAQAQTLLPGGVNSPVRAFKSVGGEPFFVARADGPYLFDVDDNRYIDYVGSWGPMIAGHNHPAVREAVEQSIRNGLSFGAPCAAEVTMAQTIARLVPSCEMVRMVNSGTEATLSAVRLARGATGRNRIIKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGRRDLMEQVAPAGPIYQAGTLSGNPVAMAAGLAMLELVQEPGFHTRLSEATSMLCEGLEDAARAAGIAVTTNQVGGMFGLFFTDDVVESYAQATACDITSFNRFFHAMLQRGVYLAPSAYEAGFMSSAHDEAVIEATLAAAREAFADVAR

SEQ ID NO: 21163 - protein, 566 aa, Helianthus annuus
MATLISDTASWKDLKAHVGEIDKTHLRDLMTDTDRCKSMMLEFDGIFFDYSRQRATVNTVSKLFKLAEEAHLKQKINSMFNGEHINSTENRSVLHVALRASKDATINSDGKNVVPDVWQVLDKIKEFSDKVRNGSWVGATGKALTNVVAIGIGGSFLGPLFVHTALQTDSEASKLAGGRQLRFLANVDPVDVARNISGLDPETTLVVVVSKTFTTAETMLNARTLREWISSALGPQAVSKHMVAVSTNLKLVEKFGIDPNNAFAFWDWVGGRYSVCSAVGVLPLSLQYGFSVIEKFLAGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLVPHKTFTGNRPSLSLLLPSLDAYRIGQLLAIYEHRIAVEGFVWGINSFDQWGVELGKSLASQVRKQLHASRKKGESVEGFNFSTTKLLTRYLEASADVPSEPTTLLPKI

SEQ ID NO: 21164 - protein, 470 aa, Arabidopsis thaliana
MENLKEALRFICSSNFWRMVLFWNIALLFSYFQLLKKSIFAPKSSSSSSCSKFNHSHTPVCVITGATSGLGKATAFALSRKGFYVVLVGRSSHLLSKTLSDIKRQNEDAKLKAFEVDMSSFQLVLKFRSSLEQWLFESDLHSSVQLLVNNAGILATSSRPTVEGFDRMIATNYVGAFSLTKLLLPLLRNSPVPSRVVNVTSFTHRSAFTGRFDMDSVTGVNFSRSKQYPCARIYEYSKLCLLLFSYELHRQLHLMDDSHHISVVAVDPGAVKTNIMHELPSYIQVIAFCGLKILGLMQSPEDAAESVIDAALAPPEISGKYFFGGRTIESSTLSSDPKMAKELWDTSCLIFNELQEASTPQCVISSLTKPRIIFPNHNPLLCLSTCISERAKTKKGASSVFVHTFEKMQDMRDQNPPQGYPAAEQVSEQPGQDKKKKKPRFFETKQKGDRGFIEGCLFALCCCWICEMCF

SEQ ID NO: 21165 - protein, 317 aa, Burkholderia sp. 383
MTTALDQLKQYTTVVADTGDFQQLAQYQPQDATTNPSLILKAVQKDAYKPILEKTVRDHRNESTDFIIDRLLIAFGTEILKLIPGRVSTEVDARLSFDTPRSIDKGRELIKLYEAAGIGRERILIKLASTWEGIRAAEVLQKEGIKCNMTLLFSLVQAAACAEAGAQLISPFVGRIYDWYKKQAGAEWNEEKDGGANDPGVQSVRRIYTYYKTFGYNTEVMGASFRTTSQITELAGCDLLTISPDLLQKLQDSNDTVTRKLSPDALQDKPAARVAIDEAAFRFQLNDDAMATEKLAEGIRVFAADAVKLEKLIDSLR

SEQ ID NO: 21166 - protein, 395 aa, Thermus thermophilus
MGGAWPEVVILGGGFAGLAAARVLERARIPYLLVDARNHHLFQPLLYQVATGFLEGPAIAYPLRALVRRGRVLLARARAVDLEGRRLLLEDGDVLPYRHLVVATGSLPSDLGVPGVGERALLLKTLGQALRVRHRLLMALERAAREGAPLSLVVVGGGPTGVELSGALAEFLRYALPRDFPEIPEARVVLLEAGPRLLPAFRPALSRYAERALAHLGVEVRLGAQVAAVEERGVRLASGEGLVGYLILWAVGVRGNPLPGLPADPRGRVPTDPYLRLPGHPEVYVEGDLNGLGFPQLAPVALQQGAWAAGNLLRALRGQDPLPFRYRDRGQLAVIGRNRAVAELWGRGFAGFPAWLLWAFVHLRELVGFRNRLLVFLDWAYTYLFREPGVRVLPD

SEQ ID NO: 21167 - protein, 412 aa, Triticum aestivum
MAAQPAERSFDVIVVGAGIMGSCAAHAAASRGARVLLLEQFDLLHQRGSSHGESRTIRATYPQPRYPPMVRLSRRLWDDAQRDSGYAVLTPTPHLDLGPRDDPAFVASVANGGATFLASAADAPRPSWADAFRVPDGWAAASSELGGVMKATKAVAMFQALAAKMGAVVRDRTEVVDVARKGEGTTATIVVKTATGEEFHGGKCIITVGAWTSKLVKSVTGADLPVQPLHTLICYWKVKPGHERELTTEAGFPTFASYGVPYIYSTPSMEYPGLIKIAMHGGPPCDPDGRDWAIGPGEDGLVEPVARWIDEVMPGRVETAGGPVVRQACMYSMTPDEDFVIDFLGGEEFGRDVVVGAGFSGHGFKMGPAVGRILAEMALDGESGTAAEAGVELRHFSIRRFDGNPTGNARSF

SEQ ID NO: 21168 - protein, 396 aa, Streptomyces coelicolor A3(2)
MKAVTWQGKRDVRVEEVPDPKIQEPTDAVIRVTSSGLCGSDLHLYEVLTPFMTPGDILGHEPMGIVEEVGPEVTNLKPGDRVVVPFQIACGHCYMCDTGLPTQCETTQVTGEGMGAPLFGYTRLYGAIPGGQAEYLRVPQAQFGPIKVPEGPADDRFVYLSDVLPTAWQAVEYAAVPQGGSLAVLGLGPIGDMACRIARLKGIDKVFGVDLVPERLERARERGVETFDLRSFDNEKELVSAIQDRTGGRGPDAVIDAVGTEAHGGAVAKLVQQTAAVLPRAIGGPLAERFSIDRLAALYTAIDLVRRGGTISLSGVYGGMADPMPMLTMFDKQIQLRMGQANVRRWSDEIVPYLTDDDPLGVDGFATHRMPLADAPHAYEMFQKKQDGAVKVLMQP

SEQ ID NO: 21169 - protein, 361 aa, Triticum aestivum
  misc_feature (86)..(86): Xaa can be any naturally occurring amino acid
  unsure (1)..(361): unsure at all Xaa locations
MDVEAPKDDDQRPAPPAHGKAMQRFLVALNCGMLTLGTTGGPLLSRLYFSKGGHRKWLSAWLETGGWPLLLLPVAASYLSRRAHDXPGAPVVLTPPRILLAAAGLGLATGADDFLYAYGLSFVPVSTSAILISTQLAFTVFFAFLIVRQRLTALSVNAVALLTVGAVVLGLHVSSDRPAGVTKGQYWLGFLLTLAAAALYGLVLPLIELTYKRAAGGGRVVTYALVMEMQLVMGFFATAFCTVGMIFNNDFQAISREAQTFELGEARYYTVLVWSAILWQFFFLGAVGVIFCVHTLFAGILIAVFIPVTEVLAVIFLHEKFTSEKGVALALSLWGLASYSYGEYSDAKAAKKKAALDAQAS

SEQ ID NO: 21170 - protein, 248 aa, Solanum lycopersicum
TGVISGALLYIRDDFKSVGKRTWLQETIVSMAVAGAIFGAAFGGWFNDKYGRRKSILLADILFFIGAIVMAVAPAPWVIIIGRVLVGLGVGMASMTSPLYISEASPARIRGALVSTNGLLITGGQFLSYLINLAFTRTKGTWRWMLGVASIPALVQFILMLSLPESPRWLYRADKKDEARAILEKIYPAHEVEDEMKALQTSIEVEKADKEFLGDGVFSKVKSAWSNTIVRRGLYAGITVQVAQQFVG

SEQ ID NO: 21171 - protein, 187 aa, Prototheca wickerhamii
EAVQIILKLAAGNGLQKVVVGRNGITATPAMSAIIRRRGLYGGLIMSASHNPAGPNEDWGIKFNYSSGEPAPEKITDKIYGFTQSIKELQVADIPDVDLSVLGTTTFGDFEVEVIDYTVDYFNQLKEVFDFEALRTLLASPDFSFVYDALHAVTGAYAEPLFVDELGASPDSLKNCVPLEDFGGGHP

SEQ ID NO: 21172 - protein, 1190 aa, Oryza sativa
MYRSVRALSRGANSAASQVASTSNLKLPSVARSLHSQAATASLHRASLATSGTKIFRSRFSTSALLKEPAPTAVAKAAVEDIQPAATGLQKWSKYLPKVERSDVKKVLLVGSGGLSIGQAGEFDYSGSQAIKALRESGIETILINPNIATIQTSHHLASQIYFLPISPEYVAYVLEKERPDGVLPTFGGQSALNVGVKLDEMGVFDRLGVKVLGSQVDVLRMCEDRDLFVQALDQINIPVAKSEAVSTVNQALKAAAEIGYPVIVRAAYALGGLGSGFADNEDELRDLSARSLSLSPQILVEKSLKGWKESEYEMLRDQEDNAIICCNMENFDPLGIHTGDSIVVAPSQTMSDDNYHMLRSAALKVIRHLGIVGECNIQYALSPDSREYRVIEVNPRLSRSSALASKATGYPLAYTAAKLALGYTLPELPNAVTKTTTACFEPALDYVVTKIPKWDLSKFQHVNREVGSSMKSVGEVMSVGRTFEESLQKAIRQVNPAYDGFDAYIAPEDLDHALSVPTDTRLFAIAYAMLVKNYDVERLHALTKIDRFFLYKLQNIVDINRQLEALGSLSAVDKELMKLAKQRGFSDKQIAKLTNSKEHEVRAHRKAFGLTPFVKRIDTVAAEYPAQTNYLYTTYNASTHDVEFDNDGTMVLGSGVYRIGSSVEFDWCAVTCARKVRDMGHRTIMVNYNPETVSTDFDEADRMYFEELGFERVMDIYELEGAQGVVVSVGGQLPQNIALRLKETGVNVLGTDPLMIDSAEDRHKFSQILDNVGVDQPEWTEATSVDKAKEFANRVQYPVLVRPSYVLSGAAMNVIWDESTLEHHLTAAAEVNTDYPVVISKFIDNAQEIDVDAVAYKGELLVHAVSEHVENAGVHSGDATLVLPPFSLDPNDLARLKVIAQKVAKAFNISGPFNMQVIRKPPTEGETEAPLKVIECNLRASRSFPFVSKVLGVNFIDIATSAIVGKDVPEPVDLMAQERDYVAIKVPQFSWTRLAGADPYLGVEMASTGEVASFGKDLYEAAWASIASQTAFRVPQANTGVLMGGDISKEQFPRIAKKLFDLGFKLYCSDAEVEEYINSLDGVRAKRIRFPVKDKRKLREVFDEHEINIVINLAKFRGRDLLDQDYVARRNAVDFGIPLLNEARSAELFVDALKARMPHGCLRGYEEGKIPSEVQPWKYFVKEEAEAHK

SEQ ID NO: 21173 - protein, 552 aa, Zea mays
MYTLPVRATTSSIVASLATPAPSSSSGSGSGRPRPRLRLIRNAPVFAAPATVVVASKRDGGQLRSQTREIERERKGGHPPAGGHKRGGERGQRRGGEEEEDEQLPLPSEKKGGASEGEAVHRYPHLVTPSEPEALQPPPPPSKASSKGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFTFVEDWVRIGSPAKNKVKKEHASVPFDDQCSILEKEAVNVSLQNLKSYPFVKEGLAGGTLKLVGAHSHFVKGQFVTWEPPQDAIERLTSGFQQFKVNVYDKKPELFGPLKSGQAPKYMVFACSDSRVCPSVTLGLQPGEAFTVRNIAAMVPGYDKTKYTGIGSAIEYAVCALKVEVLVVIGHSCCGGIRALLSLQDGAAYTFHFVEDWVKIGFIAKMKVKKEHASVPFDDQCSILEKEAVNVSLENLKTYPFVKEGLANGTLKLIGAHYDFVSGEFLTWKK

SEQ ID NO: 21174 - protein, 581 aa, Glycine max
MCGILAVLGCSDDSRAKRVRVLELSRRLKHRGPDWSGLHQHGDCFLAHQRLAIVDPASGDQPLFNEDKSVIVTVNGEIYNHEELRKQLPNHNFRTGSDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEAIPSAPYDPLVLRHAFEQAVIKRLMTDVPFGVLLSGGLDSSLVASITSRYLANTKAAEQWGSKLHSFCVGLEGSPDLKAAKEVADYLGTVHHEFTFTVQDGIDAIEDVIYHIETYDVTTIRASTPMFLMSRKIKSLGVKWVISGEGSDEIFGGYLYFHKAPNKEEFHRETCRKIKALHQYDCLRANKSTFAWGLEARVPFLDKAFINAAMSIDPEWKMIKRDEGRIEKWILRRAFDDEEHPYLPKHILYRQKEQFSDGVGYSWIDGLKAHAAKHVTEKMMLNAGNIYPHNTPKTKEAYYYRMIFERFFPQNSARLTVPGGASVACSTAKAVEWDAAWSNNLDPSGRAALGVHISAYENQNNKGVEIEKIIPMDAAPLGVAIQG

SEQ ID NO: 21175 - protein, 413 aa, Rhodococcus sp. RHA1
MPESTTVIVGASIGGVRTAQALRSEGYPGAIVLIGAEGELPYDKPPLSKSILAGDSTMAEITLLTTEQARELDLELRLGQPAIRLSTANQDVELADGTRVAFDNLVLATGARARPSPWGTPNGLHVIRTAADARALRRHFGTTDHLVIIGGGFIGAETAATAVELGIRVTLVDPEPVPMARVMGAEIGELFIDLHRRRGVDTRFGVGVESVHGEHRSFAIGLSDGSTLAADTVVVGIGAIPNDDWLESSGLEVSNGVVCDVYCRAIGHDNIYAVGDVCRFDNTRRGGSTRLEHWTNAVEQAVVVARNIARPDEKIRHEPVEYVWSDQYDWKIQTVGLAGSPTHTVIGEVTNKARFAVCYPDENGKLTGVVVVNWPKALVTARKAIALGVEYAEFAARLEAMTVSARTTVKETT

SEQ ID NO: 21176 - protein, 424 aa, Streptococcus agalactiae A909
MKFNEQSNSQAALLGLQHLLAMYAGSILVPIMIASALGYNAKQLTYLIATDIFMCGIATLLQLRLSKHFGVGLPVVLGCAFQSVAPLSIIGAQQGSGYMFGALIASGIYVVLVAGVFSKVANFFPPIVTGSVITTIGLTLIPVAMGNMGDNAKEPSLQSLTLSLVTIGVVLLINIFAKGFLKSISILIGLISGTILAAFMGLVDASVVADAPLVHIPKPFYFGAPRFEFTSILMMCIIATVSMVESTGVYLALSDITNDKLDSKRLRNGYRSEGLAVLLGGLFNTFPYTGFSQNVGLVQISGIRTRKPIYFTALFLVILGLLPKFGAMAQMIPSPVLGGAMLVLFGMVALQGMKMLNQVDFEHNEHNFIIAAVSIAAGVGFNGTNLFISLPNTLQMFLTNGIVISTLTAVVLNIILNGLPKKLI

SEQ ID NO: 21177 - protein, 341 aa, Shewanella sp. MR-4
MKALSKLKAEKGIWLVDAPKPEMGHNDLLIKIKKTAICGTDMHIYNWDEWSQKTIPVPMVVGHEYVGEVVDIGQEVRGFKIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQESLKDVMKELGMTEGFDVGLEMSGVPSAFHAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 21178 - protein, 1043 aa, Vibrio vulnificus YJ016
MFTATDVLKPEFVAQPLDKLWALISPLYMVDESQWLEQLLPLATPSAEEKQAIANRTTQLIEAIRADKKSIQLIDALLLEYSLDTHEGILLMCLAEALMRIPDAATADALIKDKMSVADWKSHLKNSESVFVNASTWGLMLTGKVVGLGDDETQSASQALNRLVNKLSEPVIRKAMYQAMKIMGHQFVRGRTIEEAQKNGRPMRDKGFTYSFDMLGEAALTTADANKYFKDYLMAIEAVGRETYGNDTSPAPSVSIKLSALHPRYEVANEHRVMSELFDTLAQLLKRAVELDVAITIDAEEADRLELSLKLFEKLYRSETVKGWGKFGLVVQAYSKRALPVLVWLNALAKEQGDLIPLRLVKGAYWDSEVKWSQQRGYDNYPVYTRKEATDVAYLACARFLLSDDVRGNIFPQFASHNAQTVSSIATMATHSDYEFQRLHGMGDSLYNHVMEQYRQPVRIYAPVGSHKDLLPYLVRRLLENGANSSFVHRLVDARCPVAELTKHPVEALTSFETLNNTKIPLPAAIFPERKNSYGVNVDIESEAKPFEAQVESFLSKQWLAGPIINGASLAESMIKDGQAESVTAPYDRRIQVGQIAFANLDHVSQAIDIAQAAFADWNRTPLVEKARCLDNLADLMEANLAELVALCHQEAGKTLHDSIDEVREAVDFCRYYAKQAQNLQPFELEGFDGVKRIASREGLGVFVCISPWNFPLAIFLGQVTAALVAGNTVVAKPAEQTSLIAVRAVELMLQAGFPAGVVQLIPGRGADIGSALTSHPAIAGVAFTGSTATAQRINVTLAQREAKPVPFIAETGGQNAMIVDSTALPEQVVRDVIRSAFASAGQRCSALRVLFVQQDIADRVIGLIQGAMNELSVGVPHLHKTDVGPVIDARAKEKLLQHIEQMNQTQKPIAQLTLADDCQHGDFVAPTAFEISGIDVLKEEQFGPILHIVRFKASELTRVVEQINRTGFGLTMGIHSRNETTYRWIEKHARVGNCYINRDQVGAVVGVQPFGGQGLSGTGPKAGGPHYLYRFTQVQFNQTENA

SEQ ID NO: 21179 - protein, 213 aa, Methanococcoides burtonii DSM 6242
MFNTLIFDADGVLVNSMPFHADAWIQTFSEVGIDVIRQDIYDIEGSNFVGIIELIFKKAGRDADPELIEKLRVRKRELFFKYEKATAFEGMYDFLNEKKDKYNLAVVSGSDRPIIDKMFNKLYPDIFDLLISGADVAHGKPHPEPYLKAVEYFGVDKEKCLVIENAPLGVESAKNASLYCVAVSTHVNPKGLEKADKVFNNHSELLEFLKQLV

SEQ ID NO: 21180 - protein, 570 aa, Salmonella enterica subsp. enterica serovar Typhi str. CT18
MSEKYPGPLVVEGKLSDAERMKLESNYLRGTIAEDLNDGLTGGFKGDNFLLIRFHGMYQQDDRDIRAERAAQKLEPRHAMLLRCRLPGGVITTTQWQAIDKFAADNTIYGSIRLTNRQTFQFHGILKKNVKPVHQMLHSVGLDALATANDMNRNVLCTSNPYESELHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGLETFKAEVERRAGITFEPIRPYEFTGRGDRIGWVKGIDDKWHLTLFIENGRILDYPGRPLKTGLLEIAKIHQGEFRITANQNLIIASVPESQKAKIEKLARDHGLMNAVSAQRENSMACVSFPTCPLAMAEAERFLPSFTDKVEAILEKHGIPDEHIVMRVTGCPNGCGRAMLAEIGLVGKAPGRYNLHLGGNRIGSRIPRMYQENITEPDIQASLDELIGRWAKEREAGEGFGDFTVRAGIIRPVLDPARDFWE

SEQ ID NO: 21181 - protein, 457 aa, Trichodesmium erythraeum IMS101
MIKLPGPKSPALTQILQWTAKPIKFMEKCAREYGDTFEVKLNYPIVFISHPKAIEEIFKANPKKFDCGSSNKLAQPLLGDYSLLLLDDIPHQRQRKLLMPPFHGKRMQAYGELICNVAQEVASKWEIGQVFSMREFTAEISLKVILQAVFGLYEGERYSKLEKLLGSLLESLSSPLKTSMLFFQFLQIDLGPWSPWGNFIKNREEIYELLCAEISERRQKLDPERSDILTMLLLARDEEGEGMSDIELRDELMTLLIAGHETTATSLSWAFYWIHHQPEIYQKLSRELETFGDDLNPMTVINLPYMNAVCSETLRIYPVVIIVSPRKTKLPITIMGQTYPAGTALTPCIYLTHHREDLYPEPKKFKPERFLERQYSSYEFLPFGGGNRRCIGAAFAMFEMKIVLATILRRYSLALAEKQEVKPLRRGLTLAPAGGVKMVMTGKLMQTEKKFPSVATV

SEQ ID NO: 21182 - protein, 126 aa, Arabidopsis thaliana
MGEVWTWIISFLILITLLGLIVYQLISLADLEFDYINPYDSASRINFVVLPESILQGFLCVFYLVTGHWFMALLCVPYLYYNFHLYSRKQHLIDVTEIFNLLDWEKKKRLFKLAYIILTLFLTIFW

SEQ ID NO: 21183 - protein, 227 aa, Phleum pratense
YYEAGARFAKWRAVLKIGPNEPSQLSIDQNAQGLARYAIICQENGLVPIVEPEILVDGPHDIDRCAYVTEVVLAACYKALNDQHVLLEGSLLKPNMVTPGSDAKKVAPRESLAEYTVRTLQRTVPPAVPAIVFLSGGQSEEEATVNLNAMNKLQTKKPWFLSFSFGRALQQSTLKAWSGKEENVGKAQKAFLVRCKANSEATLGTYKGDATLGEGASESLHVKDYKY

SEQ ID NO: 21184 - protein, 1046 aa, Oryza sativa
  misc_feature (226)..(226): Xaa can be any naturally occurring amino acid
  unsure (1)..(1046): unsure at all Xaa locations
MEIPKQGQPPRVAGTPPTLPGAITHTTQVGYPAVFYNGNWGAQVPASSYLIVPMSEPPAQVGVPRPNALGLSGSGARPLSRVSLRPPQQVLSVQTALPGMAAMMPSPSMIAGKKMAASPKVQMLKSVPFRSAGSKRPAQELLPKAQPQLFESVRSKFRETLAAALNMDSDQQCAPQSVETVSHVGSASENKQADGAGIDSVTETSALKSGQHNMLSSNSASNMSIXDELLQGHGLCWSSDVVGASETISQSDPDRVRKSDIDEGVDVSLIEHESKRIKTDDGAAEEKKSVTQKAQILAFEIEGELFTLLGGVNKKYKEKGRSLLFNLKDKSNPVLRGRVLSGDITPKRLCSMTTEELASKELSDWRLAKAEELAKMVVLPSKEVDVRRLVRKTHKGEFQVEVEETDGISVEVGIGGDLLSHVPSRPTEGQTKTDDKSVHTEEKESDNSEQDGVIVTGGNNMPSNLEHTENEKTDLMQELMVDDLKDTENLPPIMSLDEFMETLDSEPPFEDDSTQTVKDDPNSIEKTDISLKSEDSSKNVDSASASDSQLDPQTLSPQDKFESKLQSPKKDAGSILFPVEQIKEDLLVKSSPEKANAENIDTGSQSIPESITDCKSAPDALLTHDSVWEGTIQLSLSSLTNVVAIFKSGEKTSTNEWRHFLDIKGRVRLSAFQEFLEQLPKSRSRAIMVTELRWKEGSLESGRQHLLRTIDSYIADERVGLVKPADGVELYLCPSQGKAAQILAEHLPKEQSSSLTVTGTSAIGVVVWRRPHVSPRIPARNDGSRNQSISRKQHAVIASAVPLSSKPTNERQHHGQDVVTDDVPPGFGPGVVREDDDLPEYDFVTVPNAAANVVPSRQAHRSQQQHSQAASRRPVDHVREMVRKYGSRSAAAAQPWEDDDDDDIPEWDPNQSNLNLQQTRHAIPQPPLPPPGPVHQQMHAYHQQHQQQQQHYQSIQQYHATQESQNTLSQAYYVQSHSQQHSVPVQQLTHLQPGWQTTAQWLAAGAAHSGLPANNVVQQYCTSATPDGSGQGYATGNQGSMPWNLQ

SEQ ID NO: 21185 - protein, 71 aa, Triticum aestivum
LLPHRRPPYSTNYCILSGVWNGVLDRHKVFEALEMIVFFRTGVRPRSWDETQAAWMEDTGSAAAVALTDSS

SEQ ID NO: 21186 - protein, 331 aa, Oryza sativa (indica cultivar-group)
MALIATGATATATAAPVASPAASSMASELMAQGRESAAVLEALLHGASLPPAHGGAHALAAEILRCCDRALAALRAGGDAESSSADTKRKPATAQPSTRRRRRATASGGGAAAAAEPARVEKARTSEDGFLWRKYGQKEIKNSKHPRLYYRCSYKDDHGCTATKQVQQSEEDPSLYVITYFGDHTCSCQTAAAAAMDDDDDDENSQHFVINFGPATASRSGSPPLLYDDGDDGDVWRETAATPPSSRQSRCSPEGDGEESGVKMSKEEPVDSCPAPSAVSSPADVVSCSSPAMEPDLLGCLNWDDDFGDSSFVDADEFMNFDEIDLFQIYS

SEQ ID NO: 21187 - protein, 120 aa, Brassica napus
  misc_feature (107)..(107): Xaa can be any naturally occurring amino acid
  misc_feature (112)..(112): Xaa can be any naturally occurring amino acid
  unsure (1)..(120): unsure at all Xaa locations
MAWDLFLWIISFVISLALVASAFYQVICLTDLEADHMNPFETSTCINRLVLPEFILQGSLCLLFLLTWHWFFFLVSLPVTCYHAMLYNKRRHLVDVTEVFRGIDFEXKLRFXKLGFYISL

SEQ ID NO: 21188 - protein, 1279 aa, Zea mays
MALSHNEKEVVLFNAFKNRLGTSQQTTMVFNLPALIQPIGNLSELEQPFSSREIDQIIACLPSNKSPGPDGFNIDFVKKYWPVIAPDFYDLFNKFFEGSLCMHSINGSYVTLIPKNGSPDSVGDYRPISLLNTSVKVLTKILANRLQLVITKLVHQNQYGFIKDRSIQDCLPWAFEYISLCHKSRKEMVILKLDFEKTFDKLEHAALLEILRHKGFGNKWIHWISMILGSGSSEVLLNGVPGKRFHCRRGVRQGDPLSPLLFVLAADLLQTIVNKACKGGILRLPLPNNCGPDFPIIQYVDDTILIMEACPRQLFFLKAMLNSFADSTGLHVNYHKSNIYPINVSDQKMEILANTFHCKIGSLSFTYLGLPLGIQRPKLGAFLPLIQKIEKRLASTSIFLSQAGRLEMVNAVFSSLPTYYMCTLKLPKMVIRHIDRLRRHCLWRELPPPGLILFGPITTVTLPSGKPVGSFWWRDVLKTLEPFKSIARVEIEDGKTTLLWHDNWDGIPKSTQYLELWSFSACKDITVLQARLVDSQELFHAPLSTEAFVQLQELNDCLDNLPHNNYKDKWCCSTPSGLFSSQKIYAHLMGNQWTHPIFSWLWKSKCQPKHKVFFWLLLKDRLNTRAFLRQRSMFLDSYSCDNCILQVEETTIHLFFRCNFAKRCWSLIGISPSHSADLLNTILRIRRRWQVPWKLEAIILLTWGIWKCRNNWVFNETPPTVEGCTDRLYLSYISAGKLSSDPFTSLMGSSSGHQRSKTRSRNRKPLGIQLLERVRGSPISFRSCQALVLVLTFLSYASYHATRKTTSVVKSVLDPKTKTNLGTSSAHYWPPSHLFYLHNLKDADNSSAGGSLSSGGGGGWVPFNEAEDGTALLGEIDLAFLGAYAAGMFFAGHLGDRVDLRVLLTVGMVGTGLFTAAFGAGYWLDVHSFYYFLAVQMVAGLFQSSGWPSVVAVVGNWFGKSKRGLIMGVWNAHTSVGNISGSLVAAAMLRYGWCWSFVVPGVVIALVGLAVFLLLPVAPDVIGVQEDLCLKDAPLLERRRADVEEKAVGFIEAWRIPGVAPFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPAASDLLPVSSSSMDEP

SEQ ID NO: 21189 - protein, 219 aa, Shewanella sp. MR-4
MTESHIDFRRAKFLISAPDIAHLDQYLPGDVGVEIAFAGRSNAGKSSALNALTEQKNLARTSKTPGRTQLINVFELDAQRRLVDLPGYGFAQVPLAMKLKWQQSLGEYLQKRACLSGVVVLMDIRHPLKDLDMQMIEWAVASEIPVLALLTKSDKLAQSAKMKTVNEVRKALVEFGDWVQVEPFSALKGTGKPKVLSILNEWCHPQWLADELENQDDAE

SEQ ID NO: 21190 - protein, 413 aa, Rhodococcus sp. RHA1
MPESTTVIVGASIGGVRTAQALRSEGYPGAIILIGAEGELPYDKPPLSKSILAGDSTMAEITLLTTEQARELDLELRLGQPAIRLSTANQDVELADGTRVASDNLVLATGARARPSPWGTPNGLHVIRTAADARALRRHYGTTDHLVIIGGGFIGAETAATAVELGMRVTLVDPEPVPMARVMGAEIGELFIDLHRRRGVDTRFGVGVESVHGEHGSFAIGLSDGSTLAADTVVVGIGAIPNDDWLESSGLEVSNGVVCDVYCRAIGHDNIYAVGDVCRFDNTRRGGSTRLEHWTNAVEQAVVVARNIARPDEKIRHEPVEYVWSDQYDWKIQTVGLVGSSTHTVIGEVTNKARFAVCYPDENGRLTGVVVVNWPKALVTARKAIALGVEYAEFAARLEAMTVSARTTVKETT

SEQ ID NO: 21191 - protein, 249 aa, Brassica napus
  misc_feature (199)..(199): Xaa can be any naturally occurring amino acid
  unsure (1)..(249): unsure at all Xaa locations
MSCVQSNYGSEESPPEKKRRNEKASPWWSSLPDAVALSIVARLTRLDQAALSLVSKRHRSLVASPELCRTRSLIGCTEASLYVCLNIMPDPNPSWFVLTRNRQLRQIPSNPYQPLRPSSSFVVVDWGIYVIGGIVNGNPTRDVWFLDCYSRTWHPVPSMKMARASASANVIDGKIYVFGGCRDEEAEVFDPKTQTWRNXISPIGIQQSVVVQGKKIYAVDEEDQSFCSLPSQCPSWTSGKRDCKPRNRK

SEQ ID NO: 21192 - protein, 432 aa, Salmonella enterica subsp. enterica serovar Typhi str. CT18
MSKIVKVIGREIIDSRGNPTVEAEVHLEGGFVGMAAAPSGASTGSREALELRDGDKSRFLGKGVTKAVGAVNGPIAQAILGKDAKDQAGIDKIMIDLDGTENKSNFGANAILAVSLANAKAAAAAKGMPLYEHIAELNGTPGKYSMPVPMMNIINGGEHADNNVDIQEFMIQPVGAKTVKEAIRMGSEVFHHLAKVLKGKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 21193 - protein, 496 aa, Treponema denticola ATCC 35405
MQNVFYSLRELDKRAEEDFNLKNGILMENAARGSAEKIKNLFPLKKRDEKKTLQIVCGSGDNGGDGLALARILADDFNIHVIILKEPKSELCKLQYERLKALNIRTAKNILPESDILFDAFLGTGLKGLLKAEDKKTIEKINKVKAFKIACDIPSGLNLDGEASPNAVLCNMTFSMGALKQAFYSDEAKDITGKIEVIDLGLPRSLYEQNEKSNVFLLEKEDMLLPSRKKQNTHKGSFGHAGIIVGEKNGAALLAASAALEFGAGLVTLIGENRERPKNLKADFMYDGKFEAGKFNVKKFTSIAIGQGLGRKNDGLFSILKVKETQSMPMVIDADIFYYAELKKILPELSAAVLTPHPKEFSSLLNIAGFGSLSIEEIQKKRFILALSFSKKFPKLVLVLKGANTLIAHNGKICINTLGSPSLSKAGSGDVLTGLICSLLAQGYKPLDAAITGSLAHSLASQNSRASYSLTASKLIKNLEKLEAEQFKESKARQVK

SEQ ID NO: 21194 - protein, 234 aa, Magnaporthe grisea 70-15
MTWGIYMLSRYPEVQDRLREEIRSRLPSPESGEDVTSADIDSMPYLNAVCNEILRYFGPVPLTIRDAARDTSILGNFVPKGTRIFIGIWAINKSKELWGPDADQFKPERWLDEDKTAANGGGSENADGSESDNQKTSGSKKAASGGASNNYAFMTFLHGPRSCIGSGFARAEFAVLLAAWIGRFKFKLRHAEEQDEAKVVIKGGVTARPANGMHVKATVVEGICNDEMAREAKF

SEQ ID NO: 21195 - protein, 723 aa, Thermotoga neapolitana
MWLLFLIPLVALGFAAANFAAVVKKPEGTDRMKEISSYIRSGADSFLAHETRAIFKVAIVIAILLMIFTTWQTGVAFLLGAVMSASAGIVGMKMATRANVRVAEAARTTRKIGPALKVAYQGGSVMGLSVGGFALLGLVLVYLIFGKWMGQLDNLNIYTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQRVGENLVHQIPKETIQSLITYPILFALVGLGCSMLGILYVIVKRPSDNPQRELNISLWTSAILTVVLTAFLTYFYLKDAQGLDVVGFRFGPISPWFSAIIGIFAGILVGFWAEYYTSYHYRPTQFLSRSSIEGTGMVISNGLSLGMKSVLPPTLTLVLGILFADYFAGLYGVAISALGMLSFVATSVSVDSYGPIADNAGGISEMCELDPEVRKITDHLDAVGNTTAAIGKGFAIGSAILAALSLFASYMFSQISPSDVGKPPSLILLLNMVDARVIAGALLGAAITYYFSGYLISAVTKAAMKMVDEIRRQAREIPGLLEGKAKPDYNKCIEITSDNALKQMGYPAFIAILTPLVTGFLLGPEFVGGVLIGTVISGAMLAILTANSGGAWDNAKKFLEAGNLEGYGKGSEPHKALVIGDTVGDPLKDTVGPSLDILIKIMSVVSVIAVSIFKHVHLF

SEQ ID NO: 21196 - protein, 373 aa, Synechococcus sp. WH 5701
MAEYYDLLGVSRDADADTLKRAYRRLARQYHPDINKEPGAEDRFKEIGRAYEVLSDPQTRARYDQFGEAGVSGAGAPDMGDMGGFADLFETFFSGFGGAAAGGGAGGGPRRRGPRQGDDLRLDLSISFNEAVFGQEKEVQIRHLETCATCQGSGAKSGSGPTTCGTCAGQGQVRRATRTPFGSFTQVAPCPTCEGSGQVIADPCGACGGQGVQQVRKKLRITIPAGVDSGTRLRVAGEGNAGQRGGPAGDLYVYLFVQAHDKLRRDGIHIHSDVTVNYLQAILGDTIEVDTVDGAATLEIPAGTQPGTTLTLTGKGIPKLGNPVARGNHLFNVKVQVPTKLSSHERELLEELAGHHSTKDHPHKSGLFGGLFG

SEQ ID NO: 21197 - protein, 396 aa, Streptomyces coelicolor A3(2)
MSRLKTADRPYDIVLFGATGFVGELTAQYLAAHAPDGLRWAVAGRDGEKLRRLRDRLAAAADTAADVGVLLADVSDPDSLRELAGHARVVATTVGPYVRYGDALVAACADAGTDYLDLTGEPEFVDLAYVRHDTRARETGARLVHACGFDSVPHDLGVYFTVRQLPEGVPLRVDGFVRVGATFSGGTFASALGQFARGRALRAAALERRRHEPRLVGRLVVTPTGAPRFAGEVGAWALPLPTVDAQIVRRSAKALDRYGPDFRYRHYAAVRRLPVAVGGVAAVGALVAAAQVPPARRWLSGRLAPGEGPSAERRAKSWFSVRFVGEGGGRQVFTEVAGGDPGYDETAKMFAEAALCLALDALPPTAGQVTTAVAMGDALTERLRAAGIGFRVAAAR

SEQ ID NO: 21198 - protein, 221 aa, Staphylococcus aureus subsp. aureus N315
  misc_feature (30)..(30): Xaa can be any naturally occurring amino acid
  misc_feature (66)..(66): Xaa can be any naturally occurring amino acid
  misc_feature (108)..(108): Xaa can be any naturally occurring amino acid
  misc_feature (121)..(121): Xaa can be any naturally occurring amino acid
  misc_feature (125)..(125): Xaa can be any naturally occurring amino acid
  unsure (1)..(221): unsure at all Xaa locations
HHHHHHSSGVDLGTENLYFQSNIGSGSNAXIYQKQRNTAETQLNISISDDQSPSHINTGVGFLNHXLTLFTFHSGLSLNIEAQGDIDVDDHHVTEDIGIVIGQLLLEXIKDKKHFVRYGTXYIPXDETLARVVVDISGRPYLSFNASLSKEKVGTFDTELVEEFFRAVVINARLTTHIDLIRGGNTHHEIEAIFKAFSRALGIALTATDDQRVPSSKGVIE

SEQ ID NO: 21199 - protein, 616 aa, Zea mays
MASISGAAAAPSSAACRLRLRRHLLLRPSHLRLRAPHSIADLSRSSSSSNSAPTRAQPLGSRPENGGVRAVEKDPIKLWERYVEWLYQHKELGLFVDVSRMGFTEDFLRQMEPRMQRAFAAMRELEKGAIANPDEARMVGHYWLRDPALAPNSFLRSKIETTLDRILAFSQDVVSGKIQSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLAGAALMDEETRNTVVKENPAALLALCWYWASEGIGNKDMVVLPYKDSLLLLSRYLQQLVMESLGKEFDLDGNRVNQGLSVYGNKGSTDQHAYIQQLREGVHNFFVTFIEVLRDRPAGHDWELEPGVTCGDYLFGMLQGTRSALYANDRESISVTVQEVTPRAVGALVALYERAVGLYASLVNINAYHQPGVEAGKKAAGEVLALQKRVLTVLNEATCKDPCEPLTIDEIADRCHCPEDIEMIYKIVQHMAANDRAIIAEGSCGSPRSVKVYLGECNVDEDLQAA

SEQ ID NO: 21200 - protein, 354 aa, Staphylococcus aureus subsp. aureus Mu50
MNFLKPAKHIKPLPENQIDDTYKRLRLQVFLGIFIGYAGYYLLRKNFSLAMPALQEQGFTKAELGFALSAVSIAYGFSKFFMGTVSDRSNARIFLVLGLALTAIVNLLMGFVPFFTSGIGIMFVLLFLNGWFQGMGWPPSGRVLVHWFSVSERGSKTALWNVAHNVGGGIMAPIAAWGITTTAFINFGYLKGFEGVFIYPALLALIIAAISYVLIRDTPQSQGLPPIEIYKNDFATSDKKTLETELTTKEILFKYVLNNKWVWAIAFANIFVYFVRYGVLDWAPVYLSEEKHFDLKASGWAYFLYEWAGIPGTLLCGYISDKLFKGRRGPAGFFFMLGVTVFVLIYWLNPPGNA

SEQ ID NO: 21201 - protein, 340 aa, Synechococcus sp. WH 5701
MTLRVAINGFGRIGRNFMRCWLSRGENTGIEVVGLNDTSDPHTNAHLLEYDSMLGKIRDTEVGYTKDTITVNGKPIKCFSDRNPLNLPWKDWGVDLVIEATGVFIDTEGAGKHIKAGASKVLITAPGKGEGIGTFVVGVNDDQYRHDDYNVISNASCTTNCMAPLVKVLDQAFGIVKGTMTTTHSYTGDQRILDASHRDLRRARAAAINIVPTSTGAAKAVALVYPPMKGKLNGIAMRVPTPNVSVVDLVIEVSRGTTREEVNAVLKQASENGMKGIIKYSDLPLVSSDHAGTDESTIVDADLTLVMGDNMVKVIAWYDNEWGYSQRVVDLAELVAKNWK

SEQ ID NO: 21202 - protein, 509 aa, Prochlorococcus marinus str. MIT 9211
MNITITTPLYYVNDKPHLGSTYTTIACDAYSRFQRLQGNTVEFVTGVDEHGQKIQRTAQSHQITPQVHCDKISLNYKELWKKWDITYTSFIRTTSPSHQELVNQFFDKVVKSGDILLGNQQGWYCVGCEEYKDDPPDSKSPCCPIHLKPLEWRDEENLFFALSKYQSKIESLVAQPSFIQPLSRRNEILNFVSKGLRDFSISRKNVEWGIPVPGYKGHTFYVWFDALLGYLSSLLPMQNKINLADLSHYGWPASVHVIGKDILRFHAIYWPAMLMSAGLELPKKVFGHGFLTREGQKMGKSLGNILDPELLLEQYGKDPIRWYLLSDIRFGQDGDFQQKRFQDLVNNDLANTIGNLLNRTSTMSRKWFDNGTPDFDINLEDSNLKLLAQESITSSLLAYEEFDFKTVCETVIKLATESNVYLNNTQPWTLIKEPSNKELVGYYLYNVLESCRIIGLLLLPIIPDTGSSILNQLGYTEQIDNWSDHIKWGVLSKGSILPKPTPISKKIEE

SEQ ID NO: 21203 - protein, 346 aa, Zea mays
NDDNHSSRSTSDCILIEFYQRLREESLTAISRHVKDLRGAQKGSTISDENNKATAMGGDIQEIYDKLKDSSLPEGFFTEEQPWKDIYITELLNCIKEEHLKDFEQEYCLAEKIEGATEDTDIAVELYKLSISTLDLLKLASKEEQGDYVGAWYSMLLSCAQELKHGVALWQEFYHANVCDRVVSEGGHYFIALGEIYRVAQILYLSLQRFKPWVLADPGMLSKMLSCLDSCTYAWTSGLETALKMVIDSSHIDSSLAKALMESIKNITKLEVPNLQKNIPNNEMQCRLTLLPSSLLPGLNLVIWNGGHYFVKVANLWANRISPDPPLLPSNPTSSMNNAATHSQSC

SEQ ID NO: 21204 - protein, 194 aa, Triticum aestivum
  misc_feature (65)..(65): Xaa can be any naturally occurring amino acid
  unsure (1)..(194): unsure at all Xaa locations
MGSGSFLKVLVSNLDVLAGPIVSLAYPLYASVRAIETKSPIDDQQWLTYWVLYSFITLFELTFAXILEWLPFWPYGKLFFNCWLVFPCFNGAAYVYEHFARPMFVNRQIVNIWYVPRKEKLSKSDDVLSAAEKYIELNGPEAFEKLISKSTSTKPSKFRSTRRSILQEAEAEKMGKAERDSWGENPFYDKNYRH

SEQ ID NO: 21205 - protein, 563 aa, Bacillus anthracis str. Ames
MKVEKPWLKSYPEEIPSTISYDIQPLHKYVEQMASRYPEKKALHFLGKDITFSVFHDKVKRFANYLQKLGVGKGDRVAIMLPNCPQAVIGYYGTLLAGGIVVQTNPLYTERELEYQLHDSGAKVILCLDLVFPRVTNVQSATKIEHVIVTRIADFLPFPKNLLYPFVQKKQSNLVVKVSESETIHLWNSVEKEVNTGVEVPCDPENDLALLQYTGGTTGFPKGVMLTHKNLVSNTLMGVQWLYNCKEGEEVVLGVLPFFHVYGMTAVMNLSIMQGYKMVLIPKFDMKMVFEAIKKHKVTLFPGAPTIYIALLNSPLLKEYDISSIRACISGSAPLPVEVQEKFETVTGGKLVEGYGLTESSPVTHSNFLWEKRVPGSIGVPWPDTEAMIMSLETGEALRPGEIGEIVVKGPQIMKGYWNKPEETAAVLQDGWLHTGDVGYMDEDGFFYVKDRKKDMIVASGFNVYPREVEEVLYEHEKVQEVVTIGVPDPYRGETVKAFVVLKEGTECSEEELNQFARKYLAAYKVPKVYEFRDELPKTTVGKILRRVLIEEEKRKNEDEQTG

SEQ ID NO: 21206 - protein, 563 aa, Zea mays
  misc_feature (61)..(61): Xaa can be any naturally occurring amino acid
  misc_feature (132)..(132): Xaa can be any naturally occurring amino acid
  unsure (1)..(563): unsure at all Xaa locations
MAAASPPPSPPHAKRPKMSSSSDPEADAEPTSASAAVEGADPAQRRPRYKRRKVAILLGYXCGAGYQGMQKNPGARTIEGDLEEALYQAGAVPEADRSAPRRYDWARAARTDKGVSAAAQVVSGRFYVDPPXFIDRLNAQLAPQIRAYGYVRVTNSFNAKKFCDRRRYLYLLPVFALDPSAHPDREAVMASMGSGSELTKCLECSERGRKIPGVMGREGKLPSPGQNGVDAPVEGSSHDESGTLGDAKCDHTSSDGNNPFAHGEVGSNSKEKPDLPVSGDGTEVANAKMGSNDDGAVVSSDIYIGNEEKKLEPAATENKAQGMESEKINGEEKLPTKSTFSYTDEVKERFNRILKYYIGTHNFHNFTTRTKAEDPAAKRFIISFAADRVVSLDGIDFVRCEVVGQSFMLHQIRKMIGLAVAVMRNCAPESIYDVAFRKDVNLNVPTAPEVGLYLDECMFTSYNKKWKDSHEAVSMEPYSEEAEEFKVKYIFTHIAAMEHKEGAVALWLHSLNHRNYPDFRYMETAEHNPGAEVESIAAGAEPKVGAEVENTEEVQMPSDNLSE

SEQ ID NO: 21207 - protein, 261 aa, Oryza sativa (japonica cultivar-group)
MTNDEFVLVICRYLAELLAERHKLSPFIPVLPNSVRLLNQEILRVSTLLENASLLNQSGLEHGSPLTTGGLYSNGAAADMNGWTSAFQSEGSPAYSWRGGSQGSSSGLIVKKTMKVDIPVDKYPTFNFVGRILGPRGNSLKRVEATTDCRVLIRGRGSIKDPAREDMMRGKPGYEHLNEPLHILVEAELPVEIIDTRLIQARDILEDLLKPVDESQDFFKKQQLRELAMLNGTLREEGMQRSGSASPFHNSLGMKRAKTRG

SEQ ID NO: 21208 - protein, 440 aa, Zea mays
  misc_feature (238)..(238): Xaa can be any naturally occurring amino acid
  misc_feature (264)..(264): Xaa can be any naturally occurring amino acid
  unsure (1)..(440): unsure at all Xaa locations
GPNPSKAILSFIGQVTVAATSYDPISIPLDSTKRRSLSFSPPAVRPFQLAKRSRAAAMAGAGAPAVPQAGRPAPNFDVIVVGAGIMGSCTAHAAASRGARVLLLERFDLLHPLGSSHGDSRIIRDAYAQPRYLRMVRLARCLWAAAEAEAGYRVLTPTPHLSMGPRSSASLAAAIANIGAEEVDVDDLHRRWGGAFALTVPGPVDAWVTALSDHGGVLSATKAVAMFQSLAVAKGRRXCVVTVGAWAAKLLGSWGVDLPIRPLXHTLHLYWRVKPGQEQTVSASAGFPTFSSYGDPPVYGAPSLELPGLIKISCDGGPPCDPDARDWLAGDAEVTHRVARWIQEAMPDHVDAAGGPVVRQSCICSMTPDADFVMDFLGGGRDVVVGAGFSGHGFKMGPAVGKILAEMAIDGGSETAAEAGLDLGFFRIGRFDGNPMGNAK

SEQ ID NO: 21209 - protein, 221 aa, Griffithsia japonica
ARGSLGSIFSVYYRKSAPGKEGDTSDLLQRPGFEQVAAGYCVYGSTTYLTFSMGYGVHVFILDTLSGHFVLAKQHVQTPKAGPIYSVDTSVLPNVVDGVRKYVDLLEAEGSGKKFRHLNNLVANFHNVLTKGGILMLPGPQKQDLAKFLTEAAPLAFVARQAGARASVGKRNLLELSAWSLEMSVPLFVGSTADVDRLEEMVLGHAVEEKNSVDPSTMHKI

SEQ ID NO: 21210 - protein, 358 aa, Triticum aestivum
  misc_feature (88)..(88): Xaa can be any naturally occurring amino acid
  misc_feature (222)..(222): Xaa can be any naturally occurring amino acid
  unsure (1)..(358): unsure at all Xaa locations
IKGAGSFVNEHEVKVDLNEGGETSVRGKNILIATGSEATPFPGLEIDEKRVITSTGAIALEKVPETMTVIGGGIIGLEMASVWSRLGXKITIVEFLGQIGGPGMDSEIAKNTQKTLKKQGLEFKLNTKVVSGDKSGGKVKLEVDSAKGGKVESIESDVVLVAIGRRPYTAGLGLENIGLEADDRGRVVIDSEYRTKIPHIRCVGDCTFGPMLAHKAEEEAVXVVEYIKSGYVGVNYGAIPSVMYTHPEVAWVGQSEQDLKSQNIPYRVGSFPFAANSRAKTNIDTEGMVKMLADPETDRILGVHIIGPNAGEMIAEGTLALEYGASSEDIARTCHAHPTLAEAFKEAAMATHAKAIHY

SEQ ID NO: 21211 - protein, 216 aa, Ostreococcus tauri
MRAVQTSGSRPGAAGGRGGEGEYAETLERCDGLIARLRAINEEMRETLERDDQRALGSSGKAVQEGGYRDSRRHTLQRHQEVLMEYEEERRRLTRDAEAALERERLLGGYGVRSSSNGGGDESAEARLIRERARIAGGTSAVEDIIGVAQNTARELFSQRGLLQNAGSKLLTMASRFPVLDNLVMAIKKKKNKDAMVLAAVIAACTTFVLLYYMSK

SEQ ID NO: 21212 - protein, 84 aa, Glycine max
MASSADPWVREYGEAARLADDVAAMVADRAALPQSGPEVMRHTSAIRRKITILGTRLDSLEGMLARLPPKSITDKELNKHRDTL

SEQ ID NO: 21213 - protein, 305 aa, Prochlorococcus marinus str. MIT 9211
MHNFLPYAWFRGECVPFEKAKLSIATHALHYGTAAFGGMRAIPDPLDPNNFLLFRVDKHVKRLCQSAQLLLTDLKYEDVYDALSSFIKANKPKKPIYIRPFVYTSDLGIAPRLHEIETDFFIYGLELGDYLSPEGVTCRMSSWTRQQDCSLPLRGKISGAYITSSLAKTEASLSGFDEALLLNAQGKVSEASGMNLFIVRDGNLITPGVDQDILEGITRASVIEIAKDLGIDVIERPVDKTELFISDEVFLTGTAAKITPVKRIESSELNSSRPIMKKLKDRLLSITQGQPDKFDDWVTRINIYE

SEQ ID NO: 21214 - protein, 466 aa, Amycolatopsis mediterranei
MPTTPDDIQRLIADEDVEVIDVQFCDLPGVMQHFTVPAKAFTEEAYEEGLAFDGSSVRGFQSIHESDMLLLPDAATARIDPFRKAKTLALNFFVHDPFTREAYSRDPRNIARKAEQYIAEYGVADNVYFGPEAEFYIFDSIRFDSAEHASFHEIDSVEGWWNTGADEVGGNQGYKTKFKGGYFPVPPVDHFADLRDDIVRNLQGSGFEIERAHHEVGTAGQTEINYKFNTLLHAADDLQLFKYIVKNTVFAAGKTATFMPKPLAGDNGSGMHCHQSLWKDGQPLFHDESGYAGLSDTARHYIGGLLKHAPSLLAFTNPTVNSYHRLVPGFEAPVSLVYSQRNRSACVRIPITGNNPKAKRAEFRCPDSSGNPYLAFSAMMMAGLDGIRNKIEPPEPIDKDLYELPPEEAKDVKLVPGDLGTVLNTLEGGVFTPDVIETWISYKRENEIDPLRLRPHPYEFSLYYDV

SEQ ID NO: 21215 - protein, 457 aa, Bacillus subtilis subsp. subtilis str. 168
MKKQSNIWLYFFGALGGALYGYDTGVISGAILFMKKELGLNAFTEGLVVSSLLVGAILGSGAAGKLTDRFGRKKAIMAAALLFCIGGLGVALAPNTGVMVLFRIILGLAVGTSTTIVPLYLSELAPKHKRGALSSLNQLMITVGILLSYIVNYIFADAEAWRWMLGLAAVPSLLLLIGILFMPESPRWLFTNGEESKAKKILEKLRGTKDIDQEIHDIKEAEKQDEGGLKELFDPWVRPALIAGLGLAFLQQFIGTNTIIYYAPKTFTNVGFGNSASILGTVGIGTVNVLMTLVAIKIIDKIGRKPLLLFGNAGMVISLIVLALVNLFFNNTPAASWTTVICLGVFIVVFAVSWGPVVWVMLPELFPLHVRGIGTGVSTLMLHVGTLIVSLTYPILMEAIGISYLFLIYAAIGIMAFLFVRFKVTETKGRSLEEIEQDLRDKNGQGGAAGKQQTVGT

SEQ ID NO: 21216 - protein, 1166 aa, Oryza sativa
MASAAAAAASDEPPRKRARSAGAEDRLSELPDCLLHDILALVGSRQAVRTSVLSRRWRGLWRSAPRVDIDQREFRRACGGEEGEPVVDCDGFEDFADGILSPTLLGGTGTPPLDAFRLHLLYEGRFITFGRWVRRALTRRPASVDIHVEYGGTVDWPPALTLGDGAGTGRLKRLHLFGVHLGFISGDGGRLAELLPVLEDLRMESCTFGHEPSSPTTTIAIPTLRSLALAVVPRRTARPYALTVASPRVASLRLFLPFSRTRAAAVRVAPAEEGEALASLVTASITVLETDQELNRRMNKHKLDFLASTRNMLDRFPNALLDKASQEFPTLPSLTTLLLSECDVGANCYVLKSVLRNAPNLEHLRLHRCKFLGTPKRKRGNSRSKGKSSSTCLDSLSSKCKSLQSVEIKFRPIDNARHHDLVGLGYLEADHPEAAPGPAAPEAGAGASPGEIFVPTPAQLPRHRVGSTLDPSWATGDGEGAAASRRRRRGGRDSSAAASAPPSAAELALPRDELRRLQGAGIRLRNRLKVGKAGVTEGIVNGIHERWRNAELVKIRCDDVSAMNMKRTHEILERKTGGLVIWRSGSTIILYRGTDYKYPYFHDREMKNDMDESSEHTSSDDEDADLAIIASEQSGSEEDSDNPAEHGSNHTEEGDDLTRRFGVDALEGNLDIGSAEQSINSATKDQQAILHTSTNVSRPSEISGRARSTLVAGVGSPNKFRLQLPGEVKLAEEADKLLDGLGPRFSDWWGYDPLPVDADLLPAIVPGYQNIDSDLISEKLKGLTGGTLLSRDNESIVFYRGKDFLPTAVSLAIEKRRKYGNSTISNPKLNFDKSTPQNSSKLKMATDVSLDGHECYEKKHKDETAVSDNRAESLNVFTQNVEARLSQAIAEKEKTEKLIEELEMSSEPSRAETREVISEEERYMLRKVGLKMKSFLLLGRRGVFDGTVENMHLHWKYRELVKIICKEHNIKDVEYAARTLEAESGGILVAVERVSKAHAIIIYRGKNYQRPSTLRPKSLLNKKDALKRSVEYQRYKSLKLHVLNLSKNIDYLKDQMVAGRNNVITGVAQAIKTHFKKHPLAIVNIKNRADGTPIQQLISELEEATGSVLVSREPNKVILYRGWGADVAQNSLSGNNSTEQVEKEVISPQLLEAVRLECGLHPGESE

SEQ ID NO: 21217 - protein, 158 aa, Treponema denticola ATCC 35405
MYKMQWIMFFSNPIFLSAITSWMMSQIIKTIFALFNASIKTPIDFFELVFWRTGGMPSSHSALVASLTVSIGIRQGFDSDLFIFACFMALIVIRDAVGVRRSSGLQAKALNDLGAKFAEKNEGYHFRAVREIQGHKPVEAVAGIILGIITSILFAYFG

SEQ ID NO: 21218 - protein, 294 aa, Bacillus cereus ATCC 14579
MKQTILGAICLSLAASIWVGMYVVSKYVLDFIPPLTLVWLRFIIAFVVLYGILKLAEKKQKKKVTIRKKDWLLFAWIGFIGYFISITCQFIGTKLSDAHTGSLVTSATPAFMVIFAALILKEKLTARRLLSTIIATIGVIIVIGWDIEIGSYFIGTIILVGAAITWALLSIYVKIASIQFSSLVITTYAIFFSLFFITPFMIWELQAASIGTVNTYVILGVLYLGIVSTAGAFFLWNKGLKLLDASIGSLFFFFQPIVGSLLGWLLLNETLNSNFFIGGILIICSVLITTFEKK

SEQ ID NO: 21219 - protein, 378 aa, Ostreococcus tauri
FTGLTSTALPTKAEQTFAGRVQRQTATKATGSKTVAAMKGKTIKVAINGFGRIGRNFLRCWHGRANTMLDIVAINDSGGVKQASHLVKYDSVLGTFEADVKIVDDTHISIDGKKIEIVSSRDPLQLPWKALGVDLVIEGTGVFIDTPGASKHITAGASKVLITAPAKGDDIPTYVLGVNADGYKHSDKIISNASCTTNGLAPFVKVIDEKFGLVKGLMTTTHSYTGDQRILDASHRDLRRARAACLNIVPTSTGAAKAVALVLPQLKGKLNGIALRVPTPNVSVVDLVVQTSKKCTADEVNAAFREAANGPLKGILAVADEPLVSCDFRCTDVSCTIDAALTMVMGDDMLKVVSWYDNEWGYSQRVVDLAELCAANWE

SEQ ID NO: 21220 - protein, 462 aa, Arabidopsis thaliana
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGEVLTLHHPT

SEQ ID NO: 21221 - protein, 211 aa, Streptomyces coelicolor A3(2)
MRTAIVLFDRFTALDAVGPYETMSRIPGAETVFVAERTGPVRNDTGSLALTADRTLADVPDPDVVVVPGGPGQDAQMGNETLLDWLRAADAASTWTTSVCSGSLLLAAAGLLSGRRATSHWLALDLLKQYGAEPTGERVVTDGKYVTAAGVSSGIDMGLTLVGRIAGDEHAQAVQLLTEYDPQPPYDAGSPDKAPAYLVEEFRTRNRFILN

SEQ ID NO: 21222 - protein, 532 aa, Synechococcus sp. WH 5701
MSHPSPSTEQPESSRLPAIVILDFGSQYSELIARRVRETEVYSLVLGYATSVEDIKRLAPKGIILSGGPNSVYDEGAPLCDPAIWSLGIPVLGVCYGMQLMVQQLGGQVEAAGRGEYGKAPLYVDDPVDLLTNVEHGSTMWMSHGDSVQALPPGFSRLAHTDNTPEAAVADHQRRLYGVQFHPEVVHSRGGMAMIRNFVYHICGCEPDWTTAAFIDEALADVRDRVGDKRVLLALSGGVDSSTLAFLLHRAIGDQLTCMFIDQGFMRKGEPEFLTEFFDAQFHIRVEYINARDRFLAKLDGVTDPEQKRKIIGAEFIRVFEEESKRLGPFDYLAQGTLYPDVIESAGTNLDPKTGERVAVKIKSHHNVGGLPKDLQFKLVEPLRRLFKDEVRKVGRSLGLPEEIVRRHPFPGPGLAIRILGEVSAEKLNILRDADLIVREEVQEAGLYHEIWQAFAVLLPVRSVGVMGDKRTYAYPIVLRCVSSEDGMTADWSRLPYDLLERISNRIVNEVQGVNRVVLDITSKPPGTIEWE

SEQ ID NO: 21223 - protein, 458 aa, Oryza sativa (indica cultivar-group)
MASSNSTSSARRRAARAPPPPNLGDLSGVSAPLPSKGLHAPSISTHPPKAANPHPSTPGASIAVAVRPATQPASPVSGDAGPEAEAEPPRGAPQVLVRRRSVPFSPDSPLAPGSRGGGERRSTFREDVSHAAAETYLVTRLAFILLRYLGVGYRWISQLAALIIYAILLMPGFIRVGYYYFFSRQVLRSVIYGDQPRNRLDLYIPRDPKKPSPVVAFVTGGAWIIGNFPQGTISDMVSDASDGISFVCETVGAYGGDPNQIYLMGQSAGAHIAACALLEQAAKESRGEQISWSVTQIKAYFGLSGGYNIENLVDHFHERGLYRSIFLSIMEGKKSLPHFSPETVAKKLSPETIALLPQIVLLHGTDDYSIPFSASETFAGVLKQAGAKAKLLLYEGKTHTDVFLQDPLRGGRDKLVEDVISVIHADDADAREKDALAPIPGRLVSEWQIKLAHRISPF

SEQ ID NO: 21224 - protein, 657 aa, Arabidopsis thaliana
MVRKHRQDPKCENVERNSHWPVLRIFLCLRNLAIGGVNAIVIGTLIGKSALLHKTANARAPPADFASCFVLLSLNPLIETPETEKWTPSATFPYFFTISLSRVAIEIGDFQNLPEAKPTHMRKEGLHTDPGMDFFHSREKRHGKRAGLFGHKSASKSNPSSPPHLAEGRSQPTTHFGMKRSESEYAFPISDEQTTHWKPQQQASERIPNSHQRPPVYRYSTPERPREPDEDVTPRSNGSGSPFRSARTRTHERGRDYSRERYEAEGNVTSRNRPSSPFHPSQSRSPPPHARLQTQRYNNGKDHFEGMYEADADITPRNSPPMSPVHQHTSYSPPPPFYSSSDDEDDNNSTYLFPEIATGRRSRGVSGSSTPVHYKYQITSVETYEQERQFEPPELPDESQSFTMQEIARMRGLQSYGKEEIQLAISETYVSVANYKVRMSIAATLEAIIDKHGDIAASSKLQSTSTRSFYLESLAAAVMELKSTALRDLTKTRVAEIAAVVKDMDSVKIDVSWLKTAVTELAEAVEYYGKYDTAKIVREECDREMTAGKKEMEEMREELRRREKETKECRERVTELAGRLGQLEMKDVRVKKNLELYESKVLKFDGHSVLLWKLRKFLNLASRNRCFFFYFRYIHMFFSFAVLSLSVFLYILLFFCY

SEQ ID NO: 21225 - protein, 921 aa, Oryza sativa
  misc_feature (175)..(175): Xaa can be any naturally occurring amino acid
  unsure (1)..(921): unsure at all Xaa locations
MPSASAALVLLFVAFSLSNAQPGFISLDCGGDDDYTDGIGIQWTSDAKFVSAGQKANLLLQNQQLQQYTTVRSFPADNRKYCYTMNVRNRTRYLVRATFLYGNFDNSNVYPKFDLSLGPTPWTTVVIDDARTPVVQEAIILAAAPTLSVCLSNASTGQPFISTLELRQFNGSLYXPLMKREFFLRLSARINFGAESNASVRYPDDPFDRIWESDLVRRANYLVDVAPGTERISTTKPIFVSTNEEPPQRVMQTAVVGKNGSLTYRIDLEDFPGNAWGVSYFAEIEDLAPNQTRKFKLVIPGKPGFSKPTVDVEENAQGKYRLYEPGYTNIPLPFVFSFGFKKTNDSSEGPILNAMEIYKYIEISVGSQDANIMASLVSRYPEAGWAQEGGDPCLPASWSWVQCSSEAAPRIFSISLSGKNITGSIPVELTKLSGLVELKLDGNSFTGQIPDFTGCHDLQYIHLEDNQLTGALPPSLGELPNLKELYIQNNKLSGEVPQALFKKSIIFNFSGNSDLRMGHSNTGRTIVIIVCAVVGAILILVAAIVCYLFTCKRKKKSSDETVVIAAPAKKLGSFFSEVATESAHRFALSEIEDATDKFDRRIGSGGFGIVYYGKLTDGREIAVKLLTNDSYQGIREFLNEVTLLSRIHHRNLVSFLGYSQQDGKNILVYEFMHNGTLKEHLRGGPDDVKINSWVKRLEIAEDAAKGIEYLHTGCSPTIIHRDLKSSNILLDKNMRAKVADFGLSKPVVDGSHVSSIVRGTVGYLDPEYYISQQLTEKSDMYSFGVILLELISGHEPISNDNFGLHCRNIVEWARSHMESGDIHGIIDQSLDAGYDLQSVWKIAEVATMCVKPKGVLRPSISEVLKEIQDAIAIELQRELPSSIHHLMSKTSPSEAVNTTGSLQDLEQNASFDELLMRPGLR

SEQ ID NO: 21226 - protein, 293 aa, Bacillus subtilis subsp. subtilis str. 168
MRNICVIGSCSMDLVVTSDKRPKAGETVLGTSFQTVPGGKGANQAVAAARLGAQVFMVGKVGDDHYGTAILNNLKANGVRTDYMEPVTHTESGTAHIVLAEGDNSIVVVKGANDDITPAYALNALEQIEKVDMVLIQQEIPEETVDEVCKYCHSHDIPIILNPAPARPLKQETIDHATYLTPNEHEASILFPELTISEALALYPAKLFITEGKQGVRYSAGSKEVLIPSFPVEPVDTTGAGDTFNAAFAVALAEGKDIEAALRFANRAASLSVCSFGAQGGMPTRNEVEELLS

SEQ ID NO: 21227 - protein, 196 aa, Triticum aestivum
  misc_feature (19)..(19): Xaa can be any naturally occurring amino acid
  misc_feature (33)..(33): Xaa can be any naturally occurring amino acid
  unsure (1)..(196): unsure at all Xaa locations
MAPTVMASSATSVAPFQGXSSPPAGLPVSRRSXNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESAPPSPAHSRQAIYKVPLQFCQL

SEQ ID NO: 21228 - protein, 193 aa, Ustilago maydis 521
MQTIKCVVVGDGAVGKTCLLISYTTNAFPGEYIPTVFDNYSANVMVDGKPVSLGLWDTAGQEDYDRLRPLSYPQTDVFLVCFSLVSPPSFENVRTKWWPEVSHHAPNIPTILVGTKLDLREDPETIAKLRDRRMQPITYAQGNQMARDIHATKYLECSALTQKGLKGVFDEAIRSVLAPAPVKSKKKNNCMIL

SEQ ID NO: 21229 - protein, 364 aa, Arabidopsis thaliana
MGKGGMSQGEGSKVEEENMAAWLVGINTLKIQPFLLPSVGPHDVRVRMKAVGICGSDVHYLKTMRCADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAEVGPETNVLVMGAGPIGLVTMLAARAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 21230 - protein, 298 aa, Methanococcoides burtonii DSM 6242
MELEKLRHGTELIKRGFAKMQKGGVIMDVTTPEEAKIAEEAGAVAVMALHAVPSDIRKEGGVARMADPQVTADIIASVTIPVMAKARIGHFVEAEILQALGSDMIDESEVLTPADEEFHIDKTQFTVPFVCGARNLGEALRRINEGAAMIRTKGEAGTGDVREAVRHMKQILGEIRTLKGMTKEELIMAARDIEAPIELVMETAEMQRLPVVNFAAGGIATPADAALMMRLGADGVFVGSGIFKAEKPEVMAKAIVEAVNNYNNPEVLAEVSKGIGAGMKGISVDSIPEDQVLQTRGW

SEQ ID NO: 21231 - protein, 136 aa, Griffithsia japonica
MARTKQTARKSTGGKAPRKQLATKAARKSAPASGGVKKPHRFRPGTVALREIRKFQKSTELLVRKLPFQRLVREIAQDFKSDLRFQSSAVLALQEAAEAYMVGLFEDTNLCAIHAKRVTIMPKDIQLARRIRGERT

SEQ ID NO: 21232 - protein, 556 aa, Mesorhizobium sp. BNC1
MYRYDEFDHAFVKARVAEFRDQVERRLAGELTEEQFKPLRLMNGVYLQLHAYMLRIAIPYGTLAPRQMRMLAHIARHYDKGYGHFTTRQNLQFHWPALKDIPDILEKLASVEMHAIQTSGNCIRNVTADHFAGAAADEVTDPRPYAEILRQWSSLHPEFSYLPRKFKIAVTGAQRDRAAVQVHDIGLHLKKNAEGKRGFTVYVGGGLGRTPMVAKKIRDFLPEEDLLSYTTAILRVYNLNGRRDNKFKARIKILVHETGTEELRAQVEREYEALKDSELKLPESDIRAIQAYFAPPSLPARPEGDAVIAAASAADAGFATWLARNLHTHKNPDYASVTVSLKGIGEVPGDMSADQMDAVADLAEHYAMSEIRVSHEQNLVLPHVARADLKAVYDRLVEIGLATANVGLVTDIIACPGLDYCALANARSIPVAQQISTRFADQARQEAIGDLKIKISGCINACGHHHVGHIGILGVEKKGAELYQITLGGSGDENTAVGEIIGRGFGPDEIVDAVETIVETYVGLRQDKSETFLAAYGRLGPAPFKEALYGSEAKAA

SEQ ID NO: 21233 - protein, 103 aa, Griffithsia japonica
MSGRGKGGKGLGKGGAKRHRKVLRDNIQGITKPAIRRLARRGGVKRISGLIYEETRNVLKVFLESVIKDSVTYTEHARRKTVVSMDVVYALKRQGRTLYGFGN

SEQ ID NO: 21234 - protein, 1394 aa, Saccharomyces cerevisiae
MSISKYFTPVADGSLTFNGANIQFGADAQGESKKSYDAEDSMPNPANQLNDITFQAEAGEMVLVLGYPTSTLFKTLFHGKTSLSYSPPGSIKFKNNEFKSFSEKCPHQIIYNNEQDVHFPFLTVEQTIDFALSCKFDIPKGERDQIRNELLREFGLSHVLKTIVGNDFFRGVSGGERKRISIIETFIANGSVYLWDNSTKGLDSATALDFLEILRKMAKATRSVNLVRISQASDKIVDKFDKILMLSDSYQLFYGTVDECLTYFRDTLGIEKDPNDCIIEYLTSILNFQFKNKNLGNLSNSSSASVLKTATGEVTKYTYNSDFDLYDQWKHSSYYRNIKQQIQGSSIDDSIKEVDPSDVSPIFNIPLKKQLLFCTKRAFQRSLGDKAYMTAQFISVVIQSLVIGSLFYEIPLTTIGSYSRGSLTFFSILFFTFLSLADMPIAFQRQPVVKKQSQLHFYTNWVETLSTTVFDYCFKLCLVIVFSIILYFLAHLQYKAARFFIFLLFLSFYNFCMVSLFALTTLVAPTISVANLFAGILLLAIAMYASYVIYLKNMHPWFVWIAYLNPAMYAMEAILSNELYNLKLDCSETIVPRGPTYNDVPFSHKACAWQGATLGNDYVRGRDYLKQGLSYTYHHVWRNFGIIIGFLVFFIACTLFASQYIKPYFNKDEIERNNSRLTRWLPFLNKKRGTRSSARNDSKYVGIPKSHSVSSSSSSLSAVPYQISPSNKEMALNDYNEQPITETVETQKHIISWKNINYTVGTKKLINNASGFISSGLTALMGESGAGKTTLLNVLSQRVETGVVSGEILIDGHPLTDEDAFKRSIGFVQQQDLHLDLLSVKESLEISCLLRGDGDRAYLDTVSNLLKLPSDILVADLNPTQRKLLSIGVELVTKPSLLLFLDEPTSGLDAEAALTIVKFLKQLSLQGQAIFCTIHQPSKSVISHFDNIFLLKRGGECVFFGPMDDACGYFMSHDNTLVYDKEHDNPADFVIDAVGNSNSSAGKDTAEEALTLNKEAIDWSALWESSVEKKLVKKETARLEDDARASGVDYTTSLWKQPSYLQQLALITRRQYICTKRDMTYVMAKYCLNGGAGLFIGFSFWHIKHNIIGLQDSIFFCFMALCVSSPLINQIQDKALKTKEVYVAREARSNTYHWTVLLLSQSIIELPLALTSSTLFFVCAFFSCGFNNAGWSAGVFFLNYMLFAAYYSTLGLWLIYTAPNLQTAAVFVAFIYSFTASFCGVMQPYSLFPTFWKFMYRVSPYTYFVETFVSILLHNWEIKCDMSEMVPGQPLTGQSCGQFMEAFIEEYGGYLHNKNTFTVCAYCTYTVGDDFLKNENMSYDHVWRNFGIEWAFVGFNFFAMFAGYYLTYVARIWPKVFKIITKVIPHRGKKPVQN

SEQ ID NO: 21235 - protein, 540 aa, Prochlorococcus marinus str. MIT 9211
MSLIDHPNMNLPDYSPNNSSLQWERFSELLWHNEELGLWVDISRMNVNEHELKELKPIFQKAFEAMNSLEKGSMANIDEERMVGHYWLRNPDLAPSRDISKLIANQISQIEQFTTSILSGDIRSDAGELFTDVLWIGIGGSGLGPLLLIESLQELNKGLKFHFLDNVDPIGIDKKLELLQSKLSTTLFVVVSKSGGTPEPQIAMDQARHVVETNGKNWPTRSVAITMCNSLLDNKAKQENWLKTFDLPDWVGGRTSITGAVGLLPLGLIDSDLKSFLLGASKMDELTRNNELLDNPAALMAMAWYSSGSAKGLKDMVVLPYRDSLEVFSRYLQQLVMESLGKKNDREGNIVFQGLSVYGNKGSTDQHAYVQQLRDGINNFFVTFIEVLTNNESPCLNNKLPGDYLSGFMQGTRLALSDSNRQSLTITLKTFDPLSLGALIALFERTVGLYAELININAYHQPGVEAGKKAAADILNLQLQIEDILSDYSNYSIEQISTRLSSSNSESIYFILRNLVFNNKYSAKGSWKNPSSLIFKREKL

SEQ ID NO: 21236 - protein, 570 aa, Zea mays
  misc_feature (131)..(131): Xaa can be any naturally occurring amino acid
  misc_feature (393)..(393): Xaa can be any naturally occurring amino acid
  unsure (1)..(570): unsure at all Xaa locations
MEAAPMRKASSQASLADPDDFDLTRLLNHKPRINVDRQRAFDDRSLGEISLAGAGTASRGGWGYGGGGMESYESMYSPGGGLRSYCGTPASSTRLSFEPHPLIGEAWDALRRSMVSFRGQPLGTIAAVDHXSSGEVLNYDQVFVRDFVPSALAFLMNGEPEIVRNFLLKTLLLQGWEKRIDRFKLGEGAMPASFKVLKDPKRGVDKLVADFGESAIGRVAPVDSGFWWIIILRAYTKSTGDMTLAETPMCQKGIRLIMNQCLAEGFDTFPTLLCADGCCMIDRRMGVYGYPIEIQALFFMALRCALLMLKPDAEGKEIMERIVTRLTALSYHMRSYFWLDFQQLNDIYRFKTEEYSHTAVNKVNVNPESIPDWLFDFMPTRGGYFVGNVSPAXRMDFRWFALGNCVAILASLATPDQAAAIMDLIEERWEDLVGEMPVKICYPAIEGHEWQIVTGCDPKNTRWSYHNGGSWPVLLWLLTAACIKTGRLKIARRAIDLAEARLARDGWPEYYDGKLGRYIGKQARKLQTWSIAGYLVAKMMVEDPSHLGMISLEEEKPTKPVLRRSASWTG

SEQ ID NO: 21237 - protein, 757 aa, Saccharomyces cerevisiae
MMRGFKQRLIKKTTGSSSSSSSKKKDKEKEKEKSSTTSSTSKKPASASSSSHGTTHSSASSTGSKSTTEKGKQSGSVPSQGKHHSSSTSKTKTATTPSSSSSSSRSSSVSRSGSSSTKKTSSRKGQEQSKQSQQPSQSQKQGSSSSSAAIMNPTPVLTVTKDDKSTSGEDHAHPTLLGAVSAVPSSPISNASGTAVSSDVENGNSNNNNMNINTSNTQDANHASSQSIDIPRSSHSFERLPTPTKLNPDTDLELIKTPQRHSSSRFEPSRYTPLTKLPNFNEVSPEERIPLFIAKVDQCNTMFDFNDPSFDIQGKEIKRSTLDELIEFLVTNRFTYTNEMYAHVVNMFKINLFRPIPPPVNPVGDIYDPDEDEPVNELAWPHMQAVYEFFLRFVESPDFNHQIAKQYIDQDFILKLLELFDSEDIRERDCLKTTLHRIYGKFLSLRSFIRRSMNNIFLQFIYETEKFNGVAELLEILGSIINGFALPLKEEHKVFLVRILIPLHKVRCLSLYHPQLAYCIVQFLEKDPLLTEEVVMGLLRYWPKINSTKEIMFLNEIEDIFEVIEPLEFIKVEVPLFVQLAKCISSPHFQVAEKVLSYWNNEYFLNLCIENAEVILPIIFPALYELTSQLELDTANGEDSISDPYMLVEQAINSGSWNRAIHAMAFKALKIFLETNPVLYENCNALYLSSVKETQQRKVQREENWSKLEEYVKNLRINNDKDQYTIKNPELRNSFNTASENNTLNEENENDCDSEIQ

SEQ ID NO: 21238 - protein, 566 aa, Borrelia burgdorferi B31
MPKLEIYKNLFLDKIGKNFTNLEISELLEPFKAEFDGFDESSGKIKIEFNDTNRPDLWSYLGLARQIKTYFFGEMPYYDFFSKKGDFKKFYGEILVDGKMSQIRPFIFGFLAKGLIINDKMLETLIQFQEKLCQNYGQKRRRIAMGMYNSNFIKFPISYIASSPNHKFVPFGMDYELSLLEINEKHPKGLEYSHIIKNFDKFPLLLDDNNNVVSYPPIINSNNIGSLKVGDTDLFVEVTGIDFEATLLALSIAACDFYDMGFEILPVKTVFREPFNLDFKELVCPYYFQEEVEFNVENINRLLGSNLTLERICLSLKKMGVNSYSKDFKNYIVPPFYRNDFLHEVDVIEDVMIGEGLSSFNPELPKAFAVGRLSPLEEFSRNVRNLMVGMGFQEMIYNYMGSKKDFIDRMNINDQNFLKVSNPMTENYEYIRASIIPNLLKSESVSSNFPYPHKIFEIGKVALKNLDTTEGTSTFTNLAFLMSGKEISFNEINSIVATLFYYLNIEINLIESKTTFYINGRGADIVIEGFNIGGFGEISPYVLNNFGIFIPCSVFEVNINKLMSRS

SEQ ID NO: 21239 - protein, 89 aa, Scenedesmus obliquus
SADLALGKQTFEANCAACHAGGNNSVIPDHTLRKAAMEQFLQGGFNLEAITYQVENGKGAMPAWSGTLDDDEIAAVAAYVYDQASGDKW

SEQ ID NO: 21240 - protein, 359 aa, Triticum aestivum
MPHLQPPRPHPHPTSRLSRASRPSPFPFFPAGTSRSGRLHPVPASGHSVSRTSTDGIKSLRLITAVKTPYLPDGRFDLEAYDSLINTQINGGAEGVIVGGTTGEGHLMSWDEHIMLIGHTVNCFGANIKVIGNTGSNSTREAVHPTEPGFAVAMHAALHVNPYYGKTSTEGLISHFKEVLPMGPTIIYNVPSRTSQDIPPPVIEALSCYSNMAGVKECVGHERVKCYTDKGITIWSGNDDECHDSRWKYGATGVISVASNLVPGLMHSLMFEGENAALNEKLLPLMKWLFCEPNPIGLNTALAQLGVVRPVFRLPYTPLPLEKRVEFVRIVEAIGRENFVGQKEAQVLDDDDFVLISRY

SEQ ID NO: 21241 - protein, 343 aa, Clostridium difficile 630
MKAVVKTKPGYDNVEVLEVEEPKATGDKVKIKVEYSGICGSDIHSFKGEYANIKAPVTLGHEFSGIVVEVGEDVKNIKIGDRVTSETTFATCEKCIYCETKDYNLCPTRKGIGTQVNGSFAEYVLSREESIHVLPENVSLLSAALTEPLACCVHAALEKTTIESSDTVLIIGPGPIGLLLAQVVKSQGATVIMSGVTKDKERLEIAKNLGVDRTVNVMEESLADVVNEMTDGNGVNKGFDCSGFMPAVNEALRLLRKKGTFVQVGIFAKKLNEMDQEAIIQRELQYIGSRSQKPSSWITALDLMASGKVNTEALVTRTVGLDEFKEGITALMNGEEIKVAVKS

SEQ ID NO: 21242 - protein, 350 aa, Clostridium difficile 630
MKAAVLHGTNDMRFEDIEIKPCESDEVKIKVMAAGICGSDPPRVLKHWKYPVPAIPGHEFSGVIAEVGKDVKNVKVGDRVVAIPFIPCNECEYCKRGLFSLCDDHGMLGAKSFGAFAEYVNIKATNVLPIGDMDFEDAAMIEPLAVAMHGVLNIGVQVGDTVAVMGSGTMGQLVIQGLKIAGAGTIIAVDISDNKLRESKELGADIIINAKDINPVEKIKELTGGKGVDIALECAGSKITQEQCLLITKKKSKIGFLGIAYSDITLSEEAFENIFRKELELKGFWNSYSAPFPGQEWTKGINLVNEGKIKLKEMVSHRFSLEDTYKAFEMIRDRKEEFNKILILPQGVEK

SEQ ID NO: 21243 - protein, 471 aa, Oryza sativa (japonica cultivar-group)
MEAAAPASHAAAARGRLRSRQYAVLGLTFAAYASFHASRKPPSIVKAVLSADWAPFSGPRGPHRLGELDVAFLSAYAAAMFAAGHLADRADLRGLLAAAMLASGATSAALGAAYFLGVHSLAFFLAAQVASGVVQSAGWPCVVAVVGNWFGHASSRGTIMGVWNSHTSVGNIAGSVLSAAVLEFGWGWSFLVPAFVIAALGVVVLVFLIAHPMDAGLDIEAIEVEMNGGSGEEVELLGEDKKEDEDVLEVEAVAELPRAIGFLEAWRLPGVAPFAFCLFFSKLVAYTFLYWLPFYIRHNAVAGQFLSHKASGILSVVFDIGGVLGGISAGLLSDKIGARAVTSALFLFLSIPALILYRTYGSISMHHNIGLMFLAGYFVNGPYSLITTAVATDLGTQDAIKGNSRALATVSAIIDGTGSVGAALGPLLTGYISTRGWNSVFFMLIVSISLALVFLIRLAKDEIVSKISARH

SEQ ID NO: 21244 - protein, 355 aa, Euphorbia esula
MEDSTQISLIFDGLYCEEQGIGEDFDDGNEDYVKKELSLSSVLLEQDLFWTDDELLNLISKEKETHFSFGDFSSHGSLMVARKEAIDWILRVKGFYGFNALSCVLAVNYFDRFISSLVFTRDKPWMGQLAAVACLSLAAKMEETQVPLLLDLQVEESKYVFEAKTIKRMELLVLSTLQWRMNPVTPICYFDHIIRRLGLKNHLHWEFLRRCELLLLSVISDSRFMSYAPSILATSIMIHVIKEVDPFSQMEYQNQLLDVIKINKEEVNQCYKLILELSGKQDQGYKRKYPSRPGSPNGVIDAYFSGDSSNDSWGVSSSISSSPSIPRFKRIKSQDQQMRLPSINRMFVDVLSSPH

SEQ ID NO: 21245 - protein, 222 aa, Prochlorococcus marinus str. MIT 9312
MSIFVGNLPFRAEREDVLQLFAPFGEVLNCSLPLERDTGRKRGFAFVEMADEAIESAAIDGLQGTELMGRPLRINKAEPRGSGGSRRGGRGGGNNGGGYGGGGYGGGNNGGGYGGGGGGGGGGYGGGNNGGGYGGGGGGYGGGNNGGGYGGGGGGYGGGNNGGGYGGGNPEPKTSYTNNSSGAEGWEDRSYGNSSENSEYESGRSRRKRGVSNESNLSNEEN

SEQ ID NO: 21246 - protein, 350 aa, Euphorbia esula
MANHSPLFLYDALYCSEEDNWEGEVVDIFHEQEDQGENTSVFPQNSSPVDLNWEEDELTSVFSKQEQNQLYKKLEINPCLAKSRRDAVDWMMKVNAHYSFTALTSVLAVNFLDRFLFSFDLQTEKPWMTQLTAVACLSLAAKVEETQVPLLLDLQVVDSKYVFEAKTIQRMELLVLSTLQWRMNPVTPLSFIDYMTRRLGFKDYLCWEFIRRCELIVLSIISDMRFIPYLPSEIASAIMLHVINGIEPSLGDEFETQLFGILGIDKEKVNNCREMIIELGSRYYGNQSNKRKYGSDPGSPNCVMDVSFSSDNSNDSWAVGSKSSSVSSSPAAKKLRAVSGMNHENAIILS

SEQ ID NO: 21247 - protein, 528 aa, Burkholderia pseudomallei K96243
MDKTKQPPRAAKRCCRATLLAAAAFACCCGSYAAAQEAASAAPSTTTQPRDEAPLSAPLQVVQDAISAGTADVSANASADADVAMPLAEVAPPCSAPGACGAELRLAGGMGGNGEGAGAGGIGSGGDNAGSGRGSSGGANDGNGAVGAAGIGVGGTTGSTAGGTAATGRGNSVGNASGGGTSGGGASGHGTSGRGAAGGGASSGGASGGGTSGGGASGGGASGGGTSGGGASGGGASGGGASGGGASGGGASGGGASGGGASGSGASGSGASGGGTSGGGASGGGTSGGGASGGGTSGGGTSGGGTSGGGTSGGGTSGGGTSGGGTSGGGTSGGGASGGGASGGGASGGGTSGGGTSGGGTSGGGTSGGGTSGGGTSSGAGHGGHGGGTGGGGGHSGGHGNGNGGGASGGSGSGNGHGSGNGGGNGNGGGGGNGGGSGNGTGNGGNNGGGHGNGSSGGGTSGGNGHGNGGGTSSGSGNGGGNGNGSGHGNGGGHGNGNGSGGAGNGGANGVGSGNGGHGNGGGHGNGR

SEQ ID NO: 21248 - protein, 448 aa, Streptococcus suis 89/1591
MSNAKAYIQASFEAVKARNPHETEFLQAVEELFSTLEPVFEAHPEYIEENILARIVEPERIISFRVPWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAAEKATAKYFEGSVWNYDGKADIALPCATQNEINGEQAAALVKNGVYCVAEGANMPSDLDAIKVYKENGVLYGLAKAANAGGVAVSALEMSQNSLRLSWTHEEVDGRLKDIMANIFNTAKETAEKYDLGTDYLAGANIAAFEQIADSMIAQGLV

SEQ ID NO: 21249 - protein, 219 aa, Escherichia coli
  misc_feature (42)..(42): Xaa can be any naturally occurring amino acid
  misc_feature (90)..(90): Xaa can be any naturally occurring amino acid
  misc_feature (92)..(92): Xaa can be any naturally occurring amino acid
  misc_feature (138)..(138): Xaa can be any naturally occurring amino acid
  misc_feature (174)..(174): Xaa can be any naturally occurring amino acid
  misc_feature (182)..(182): Xaa can be any naturally occurring amino acid
  unsure (1)..(219): unsure at all Xaa locations
MTQDELKKAVGWAALQYVQPGTIVGVGTGSTAAHFIDALGTXKGQIEGAVSSSDASTEKLKSLGIHVFDLNEVDSLGIYVDGADEINGHXQXIKGGGAALTREKIIASVAEKFICIADASKQVDILGKFPLPVEVIPXARSAVARQLVKLGGRPEYRQGVVTDNGNVILDVHGXEILDPIAXENAINAIPGVVTVGLFANRGADVALIGTPDGVKTIVK

SEQ ID NO: 21250 - protein, 410 aa, Oryza sativa (japonica cultivar-group)
MVMPMPTEGSEPLLPRKQRDGGDDGAASSHDHFDGASFSGAVFNLSTTIVGAGIMALPATMKVLGLVPGLILVMLAAVLTDASIELLVRFSRAVGATSYGEAMGDAFGAFGRGLLQLCVVVNNVGVMVVYMIIIGDVLSGKSSSGGVHHHGVIEGWFGPNRWNGRFSILVIVTLGVFTPLTCFKRVDSLKYTSALSVALAVVFVVITAGITTIKLMRGQIPMPKLFPDVHDWSSTWRLFTAAPVLVTAYICHYNVHPIHNELKDHSQIRPIVRASLLLCLAVYTTTSFFGFLLFGEATLDDVLANFDSDLGIPYSLVLDDAVRVSYVLHLMLVFPIVFHALRFNMDGLLFPSARPLSSDNRRFGAITAALLTVIFLAANFVPNIWDAFQFTGATAAVAIAYIFPAGMALR

SEQ ID NO: 21251 - protein, 688 aa, Ostreococcus tauri
MARGGRTARAAAESDTAGRFARGRALETTSAVRLGEDVAVDRVVRFVRARRPDRPLIDADSLRDVVVLNGGALVEETTTSNKGTDAEDEMPRGMSTRGMDRGDDLYATRDVRMSWFGARRAGAGLANLGNTCFLNSVLQCLTHTPALAHFALSGEHKKYKTSGSFNAMYEIGEHVARALNSSGRTIAPTAVVKNMRALSKTFRKGRQEDAHELARCLLDAMHKKCVELVKPKISPNSARGETSFVWKVFGGKLRSRVNCKTCGRNSETFDPFLDLSLEVGRAKSVLGAFKLFTHTEILDGDNKYKCEGKNPGQSKPHFTKASKQFTVDQAPNVLAVQLKRFAYVPFGRGKLSHFVEYPLVLDVTPYLSDEDRNSKNRAVYDLYGVLVHAGSSSNSGHYYCFVKTATGTWCEMDDESVSSVSEKTVLKQQAYLLFYARRNAPGTFEQMKKLCQNVPDAARALNSLETKSAAAELKTQPAEKRKQETVENVRAKKETVSKENVSTPSLGKRKLGDLNGRASPVRSSVGRSIVRSKSPSVRSAFDSAKRALLLRRLRRLSHDVGVTLEDIPAVIASDAPVRTRNAMKEDDGEALRDWLAKTSTSAKWDEEDGDAQQTKKKKKTPPHEPQTKMSASGTRARRAYDQFDEEYDRGKTPKHRRRKEKAASAPPLPKPGAHRARQRNPFQKRGAV

SEQ ID NO: 21252 - protein, 364 aa, Borrelia burgdorferi B31
MKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINITRQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIKIHIPKGINNEEQILIKNAGMPILQTEKFGNLILITKIKTPKNLNSNAIKLFENLGKELKDGDEIDLLKA

SEQ ID NO: 21253 - protein, 137 aa, Griffithsia japonica
MARTKQTARKSTGGKAPRKQLATKAARKSAPITGGVKKPHRYRPGTVALREIRKFQKSTDLLIRKLPFQRLVREIAQDFKSDLRFQSSAVLALQEAAEAYLRGGLFEDTNLCAIHAKRVTIMPKDIQLARRIRGERA

SEQ ID NO: 21254 - protein, 206 aa, Ostreococcus tauri
MPSEEEIARWREIRDDPWTRRALEATATTATKERGKRRKGGTEAKDGKPNDDDARMKKLMEVAKDAVEKANEATRLRAEESARFLETRNFAGKMVEVETEYVEGTKEAKAHAKRAEALAKGGIDAVLAQLMEPKKLNVLDKTRADWRSVKDDDAELQEDLQHHARGGRTYREQQEFLQNADYREYELERDARLASRGRTGARAGAP

SEQ ID NO: 21255 - protein, 461 aa, Triticum aestivum
  misc_feature (140)..(140): Xaa can be any naturally occurring amino acid
  misc_feature (187)..(187): Xaa can be any naturally occurring amino acid
  misc_feature (196)..(196): Xaa can be any naturally occurring amino acid
  unsure (1)..(461): unsure at all Xaa locations
MGIGDASPSENQSAHKEKRDETTPLLPVKAEEEDGIHEFNGASFSGAVFNLSTTIVGAGIMALPASIKMLGIIPGILMIILVALLTEASIDMMVRCSHQAKITSYGWLMGDSFGQWGRIALQASVVINNIGVMIVYMIIXGDVLSGTSTTWCSSPGVSLRGWFGPHLWDSRPVGLLGTTIFGVGPLXVSLNRLDSXLRYTSALSVALAVVFVVITAGIAILRLIEGTAEIPKLFPEIHELNSIWELFTAVPVLVTAYICHYNVHSIDNELEDRSQTKPIVRTSLALCSSVYVATSFFAYLLFGEGTLSDVLANFDSDLHIPFSSVFNDIVRVSYVVHVMLVFPIVFFALRLNLDGLLFPTSRHISHDNRRFIIITVSLLAVIYLAANFIPSIWDAFQFTGATAAVLIGFIFPAMIILRDSYGIATKRDKVLAVTMIVLAVLSNSVALYSDAMSIFYRKVEA

SEQ ID NO: 21256 - protein, 436 aa, Cunninghamella elegans [sequence omitted]

SEQ ID NO: 21257 - protein, 885 aa, Azotobacter vinelandii
MQDMQDLDPIETQEWLDSLESLLDHEGEERAHYLLTRMGELATRTGTQLPYAITTPYRNTIPVTHEAHMPGDLFMERRIRSLVRWNALATVMRANKKDPDLGGHISTFASSATLYDIGFNYFFQAPTAEHGGDLIYFQGQAAPGVYARAFLEGRISEAQLQQFRQEVDGDGLSSYPHPHLMPDFWQFPTVSMGLGPIQAIYQARFMKYLEHRGFIPAGKQKVWCFMGDGECDEPESLGAISLAGREKLDNLIFVINCNLQRLDGPVRGNGKIIQELEGVFRGAQWNVNKVVWGRFWDPLFAKDHAGLLQQRMDEVVDGDYQNYKAKDGAFVRKHFFGARPELLELVKDMSDEDIWKLNRGGHDPYKVYAAYHQAVNHQGQPSVILAKTIKGYGTGAGEAKNIAHNVKKVDVESLKLFRDKFDVPLKDEELEDLPFYRPDENSPEMKYLRSRREALGGFVPQRRRKSISIPTPPLDSLKAILDGTGDREISTTMAFVRILAQLVKDKELGSRIVPIIPDEARTFGMEGMFRQLGIYSSVGQLYEPVDKDQVMFYREDKKGQILEEGINEAGAMSSWISAATAYSNHNQPMLPFYVFYSMFGFQLIGDLAWTAGDSQARGFLIGGTAGRTTLNGEGLQHEDGHSHILASTIPNCRTYDPTYAYEMAVIIREGIRQMTEEQQNVFYYITAMNEAYTQPAMPEGAEAGIVKGMYLLEEDKRDAAHHVQLLGSGTILREVREAAKILREDYNVAADVWSVTSFNELRRNGLAVERRNRLHPEQKPEQSYVEQCLNGRKGPVVASTDYMKLFADQIRQWVPSREYKVLGTDGFGRSDTRKKLRHFFEVDRYWVVLAALEALADRGDIEAKVVPKPFAKFGIDPDKRNPLDC

SEQ ID NO: 21258 - protein, 337 aa, Medicago truncatula
MAFLQDQFQRHYQQQQQPQPQTKSFRNLQTIEGQMSQQMAFYNPTDLQDQSQHPPYIPPFGFAPGPVIPADGSDGGVDLHWNFGLEPERKRLKEQDFLENNSQISSVDFLQPRSVSTGLGLSLDNTRLASTGDSALLSLIGDDIDRELQQQDLEMDRFLKLQGEQLRQTILEKVQATQLQSVSIIEDKVLQKLREKETEVENINKRNMELEDQMEQLSVEAGAWQQRARYNENMIAALKFNLQQAYLQGRDSKEGCGDSEVDDTASCCNGRSLDFHLLSNENSNMKDLMKCKACRVNEVTMVLLPCKHLCLCKDCESKLSFCPLCQSSKFIGMEVYM

SEQ ID NO: 21259 - protein, 304 aa, Brassica napus
MASIAATGVLKVPPPAAASCEAVPTMTLSFSSSVSLRATVSHRRGSVLSRNRVRNPMIVSPKAVSDSQNSQTCLDPDASRSVLGIILGGGAGTRLYPLTKKRAKPAVPLGANYRLIDIPVSNCLNSNINKIYVLTQFNSASLNRHLSRAYATNMGGYKNEGFVEVLAAQQSPENPNWFQGTADAVRQYLWLFEEHNVLEYLILAGDHLYRMDYEKFIQAHRETDADITVAALPMDEERATAFGLMKIDEEGRIVEFAEKPKGEQLKAMKVDTTILGLDDKRAKEMPYIASMGIYVVSKDVMLEL

SEQ ID NO: 21260 - protein, 500 aa, Agaricus bisporus
MPSIFTHQWDTPVYKGSTSINTGLFINGEFVDGVKNTTIDVVNPANGKLITKISEATEADIDIAVEAAHKAFETTWGLNCSGSKRGDMLYKLAQLMEKNIDDLSAIEALDNGKTFLWAKSVDLSLSISTIKHYAGWADKNFGQVIETDEKKLTYSRHEPIGVVGQIIPWNFPLLMLAWKIGPALATGNCIVLKPSEFTPLSALRMCALIQEAGFPPGVVNVVTGYGSTTGQAISSHMKIDKVAFTGSTLVGRKVMEAAAKSNLKNVTLELGGKSPVVIFDDADLEQSVNWTAHGLFWNHGQACCAGTRIFVQEGIYDKFLQKFTDKIKEIKLGDPFGLGIDQGPQVSQIQYDRIMSYIESGRAEGATVHVGGERHGNEGYFIQPTIFTDTTPDMKIVKEEIFGPVGAVIKFKDGKEVIKQANDSNYGLAAAVFSQDINKAIETAHAFKAGTAWVNCANTIDAGVPFGGYKQSGIGRELGEYALHNYTNVKAVHVNLNWKM

SEQ ID NO: 21261 - protein, 338 aa, Zea mays
MGVKQVLVRPRYGDGDGDDDGGTSSSSSTGRCDEDVVDQSPPPMSSCGRYLLHRVCRFDTLAGVAIKYGVEVADVKRANGLNADLQMFAHKTLRVPLHGSHQPAAAPPSLPSYSPRNHADRVAREWTTRRPPKNAASMDPFLKPPRSTVSPSMSLLQGYYGLPPTPQENLTYEGTEMATYAQGHHRKARSLSSSEHGDGADDAEKPIRRRQKADSELTTGREDNGGCLLPRAGQGLALRPKSGSRPDGNGSQLDLSATWVPSYGDGLHTVKKSSSTPEFQDSDSISIASEWLKSKWNLKPDAFTLTLPPLPLLDSIPKPLLDNIPNSIAAWRNKAAKD

SEQ ID NO: 21262 - protein, 436 aa, Bacteroides thetaiotaomicron VPI-5482
MKTDLIYGVEDRPPFKDALFAALQHLLAIFVAIITPPLIIASALKLDVEKTSFLVSMSLFASGVSTFIQCRRIGPIGAKLLCIQGTSFSFIGPIIATGLVGGLPLIFGSCIAAAPIEMVVSRTFKYLRNIITPLVSGIVVLLIGLSLIKVGIVSCGGGYSAMDDGSFGSWENLSIAALVLLSVLFFNRCKNKYLRMSSIVFGLCLGYGLAFALGKVNMSALNVEMLMSFNIPQPFKYGIDFNISSFIAIGLVYLITAIEATGDVTANSMISGLPIEGDSYLKRVSGGVMADGFNSLLAGIFNSFPNSIFAQNNGIIQLTGVASRYVGYYIAAMLVLLGLFPIVGAIFSLMPDPVLGGATLLMFGTVAAAGIRIVSSQEIGRKETLVLAVSLSLGLGVELMPDVLKQAPEAIRSIFSSGITTGGLTAIVANMVIRVK

SEQ ID NO: 21263 - protein, 458 aa, Burkholderia pseudomallei K96243
MTQQQRTFDSIVEREKGLRRGLSSAQMAMIAIGGAIGTGLFLGSGFAIGLAGPGVLVSYAIGALIALLLMGALAEMTVAHPTSGSFGAYAEHYVGPLAGFLVRYAYWSAVVFAVGTEVSAIAVFMKYWYPGVPGWYWVVGFSAVLIAVNMTSVTLYGVVEYVFSMLKIAAIVAFIALGAYFVAAAPVSSGIGFANYSAHGGFFPKGFSGVWVAVIVAIFSYMSIETVAIAAGEARDPQRAVSRAFRSTVFRLVLFYLLTLALMLAIVPWTQAGTDESPFVKVMAATHVPYAAGVINFVVLVAALSAMNSQLYVTTRMMFSLSRARLAPAMFGRVGANGVPLAALAVSSSGVAVAAVLVALYPQTAFTLLMAIAMFGALFTWLMIFVTHLRFRARYRGPTPVFRMWLHPAGSLTGAALVGAVLVTTAFTREFRMTMMVGVAFIVLLTLAYRWHYRARHA

SEQ ID NO: 21264 - protein, 486 aa, Pseudomonas putida
MKEIKHFISGELVGSASGKLFDNVSPANGQVIGRVHEAGRAEVDAAVRAARAALKGPWGKMTVAERAEILHRVADGITARFGEFLEARMPGHRQAEVAGQPHRHSARRANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKPREKVPSYYQQAVDDGATVVTGGGVPEMPAHLAGGAWVQPTIWTGLADDSAVVTEEIFGPCCHIRPFDSEEEAIELANSLPYGLASAIWTENVRRAHRVAGQIEAGIVWVNSWFLRDLRTAFGGSKQSGIGREGGVHSLEFYTELKNICVKL
